United States Patent 7,504,493 (CHARACTERIZATION OF THE YEAST TRANSCRIPTOME) - sequence listing, part 5

SEQ ID NO: 12217 - DNA, 784328 bp, Saccharomyces cerevisiae
ccggctttctgaccgaaattaaaaaaaaaaaatgaaaatgaaaccctgttctttagccctacagcacttctacatagccctaaatagccctaaatagccctcatgtacgtctcctccaagccctgttgtctcttacccggatgttcaaccaaaagctacttactacctttattttatgtttactttttatagattgtctttttatcctactctttcccacttgtctctcgctactgccgtgcaacaaacactaaatcaaaacagtgaaatactactacatcaaaacgcatattccctagaaaaaaaaatttcttacaatatactatactacacaatacataatcactgactttcgtaacaacaatttccttcactctccaacttctctgctcgaatctctacataataatatatcaaatctaccgtctggaacatcatcgctatccagctctttgtgaaccgctaccatcagcatgtacagcggtaccctcgtgttatctgcagcgagaacttcaacgtttgccaaatcaagccaatgtggtaacaaccacacctccgaaatctgctccaaaagatattccagtttctgccgaaatgttttattgcagaacagccctatcagcatcgacaggaatgccgtccaatgcggcactttagatggggtaactcccagcgcaagctgatctcgcaagtgcattcctagacttaattcatatctgctcctcaactgtcgatgatgcctgctaaactgcagcttgacgtactgcggaccctgcagtccagcgctcgtcatggaacgcaaacgctgaaaaactccaactttctcgagcgcttccacaaagaccgtatcgtcttttgcctcccattcttcccggcactttttttcgtcccagttcaaaaagtactgcagcacctctgtcttcgattcacgcaagttgctccatactttataatacaactctttgatctgccttccagacatgcggaaaacttggctcccttgcttgcctcttgtcgaatccaatacactaattgtttctcttcttctagtaatggccaggtaccaagcataatttctctgtatctgagagtagatctctcccctttttacgctaaaaaatttcaaataccctacagggtccccatgatatggctcgatgtcttccaagtattctttgtattcctcgtcatttcgcagcattctctccacagctagtgcttcccaagccatcctccgatacgatactttctggccagcccaacagacacagagctcgaacatcttttgacagcccttgcataatccgtattgtgtgaatactccctctgggcagaagtatacgtcaataccatagaggaaaagatgtttaatttcgtcagaccgaaatccaagaaactgtaagacattcatattctcggaagtattgggaaattgtgctttcagtttctttctctctagcaaaaccatttgactccctttccgcttatacgactctttgttaatgtcggtgactggatggaatctattatcctcagcattgccatctttattggcgtcctccttggcactagcgttggtactttcagtggtagtggcattagtgctggagttggtgctagcagtggtagtggcattagtgctggagttggtgctagcagtggtagtagcactagtgttggagtcggtactttcggtggtagtagcactagtgttggagtcggtactttcggtggtagtagcactagtgttggagttggtactttcagtggtagtcgcactagtcctgacgttgatgctggcagtggtagtagcactagtcctgacgttggtgctggcagtggtagtagcattagtgctggagttggtactttcagtggtagtcgcactagtcctgacgttgatgctggcagtggtagtagcactagtcctgacgttggtgctggcagtggtagtagcattagtgctggagttggtagtcgcattggtactggcattagcactaccatgaatgcacgtgtcgctgtcctcatcactgctgcaatactttctgcacctgtcactgctattgctctcctggaagctagacggtaacgcaacgatcgacatggaagctgtcgcctgtttttcagccaatctgtccattctttctatcagttccactgtgtcagcagacaggtctgtcctggagccacagcatccaacatgctggcccttttttcctttctttgattcaagtccatagaactcgcgtacctgttcggttatacagccttccttaatcggtggtaattcacccttacgattccttgccgcccaactgttttttctagataatagataacagaggcccccatctcttagtctccctacgccttgaatgagctcaataatattaagtctattatcaagcatgatcaccatcatcaattgcttaatgtcaattccttcagtcactaatttcgttccgatgagaactcgcatgctaccgtcagtgacaaactcctttgtgcgagacaccttttctgcagcacccagcttcccgtgtatccataccaccctaaaatactttctccaagagcaggccaattcttccacttcgttggttgtgcttgcaactacaatggccttcgactctggttcaatttcaaagagggctaaaagaagcttcagtgcttcttcgggctgtgattccactttcttccaaattttatgaacatgccctaaaggcacctcggatttctccttgattagattaaacatccgtgttggatagctggatagacctctgctgagatcttccgaccgtttgagctcgttgatgtccatcgacttcttggccagtcccgtaagcccaatacgctgcaacgcagcatcagctacagcctcaggtgctgtgccgctcaaaaagattgctttctcaaaagcgtcaaaatcaaggttagttatgcccccaaattgcgactgccggtagacctccgtttcaaagttgtgaaactcatctacaatgaggtaacccaattttacgttgttggtcctaaaggtgcactcaacaatattctcccacgcagctatcctgtctgtgaaattagtgctagcaagatcatcgtagatccccacgtataaatcagtaacgccatcgcaaccttcttcaataaagtttcttacaggggccacattcaagcaaccgcatcggctcaacctgatcatgcaattagcaagcaacactgtgtacggtacaaacagaaacgacacatatttcacgtcgcccttagacgccagtgctatcaaggggagatgaaataactccgtcttaccatagcccggtggggcctgtactgccacagagggtgtgtctgccatgtatatttcatgacataagcgcaactgatgcaagtccctgaattcaaaggagctgccaaagagtttctggcctgcgacgaggatatcgtttgtactcttgggctctcggggcctttttcgcgttactcttgaaattttttgatgatgatctgaactcgccgcctcacctgccactacgtcttccgcattccgagtactagagaatgaacaatggtagtcgctttcaaggcctaaccattgaatccagcgctcggaagctcgttcctgcaataaagtggcggtcgtcccactgacactagttaacgaaaaggaatccacaccgtaaatatttcgccctgtttgaacggaatgattggccatgagttcactcgtcgccgactcgtacaaatctgtttcaaatctgctacctacgcagtgccgtcctagggcaatcaacccctgacgcatctcccgaaaattcagcttctgaggtgcattcttcggaagttccctcatgtactgccgaaaagttgcgtattcaaccagacagcccttcgcggtattcagaaacatgtaggaatacaaaactatcctcgaaatgtctcgatttgttacttgatctggatcctcaaatcccaccacatccatccaaggatcatgattaaaagcgtcataactgttaccaagcgcacatatttgcatttgccttagcacagtgacaaaataaaacacgtaatctgaagtgagtccgtcaagcgtcttaagtcgaggctccgatgaaccgttcttgttgtaatcagtgtacagttggatgcgtcttgttgtatcatcgacgtatacgttgcgctgaggaccggcaaaagcgagtagctgaagctctggataacggtaagggtatcctacggcaaaatggatcatccacataagtggcaccgtaagctcgtcaattgcaacagtgactttatttttaagagccgcggtcattttgttagtatctcttctcaacttgggcagcacaatttcacgatatttaacaggtatcatttgaaggaaagaatcgttctccagatactcgtcaattcctcgctttggctctctgaacaaaacttctcgattacgcaaaatgaggctggcaatatcaaccactgtaggcatataaaagcagtcgttcaattcttcccaaaggttatcaaactgagccttgcatgcaaagtaaaagccgcggacatactcgcgattaaacagttttccacatactgatacaccatcagaagaaggtaccaaagttattctataagagtccttcagcgcggtttcctgcgctacttcgtggtacagaattttgatccatttccacatcgcaacgccgttgttgtcatcaaatatatctaaatcccttgcggtacaagcacaagacgacaccaataaagctttcacggcatctagtgtttttctgagtcttcgtggagtgttaggactgcgcaacttacatactttcaagccatgctcgtccacagagggaataatgggttcttcattcgtaatggatcgatcctcttcgtcaccagcgccaccacggggacccgccccgaaattgagcgcacatgctcgcaagataatatgcaaaatatcacccaatcggtcctttttgttcatcatatcgttacatatctgtgaaaagtactttatctcagtgggtttacgtgggcatagatcacgcttcagccgctctgtgtcgactttcttttcgccaggtaaacttgcttggtatgcagaaaaaatcgatagctcatctacgtgtagtaacaaaaacatgtagggtgccaaattgtatccatatttccttatggtgcttttctgaagaccccttacaataggtgtgccagaaacaaagtcagtgaaagtacgcatcgtagagctgtcgttcggcctggcactcgctatttcgtaacaacgttccaggacacggaaactcaactcattatagtatcctctgttgaggtaaaaaagagaaagggtatcgtaatcctttctattgaatttcaaagtatgcacttgaaacaacgtgtagaccatcaagttgattttcttgggaataagatactttgaagggattggtccgccctggaaatctggttcgtcttcaacaaacgtcaggaacttttgtacatttttcccgaccatgacggaaacgacaattttttcaaaagaccttttcctatccattgcaccagttctgaattttaccactttgattagaccagacttttcgtcttcgtagaatgaccgcacttccgtggggatcgattcaaataaagttattgagggacaatgtaccaagtcgtttttgttatttagagccgactcaaactcgtcaaagtttgctttttcaaacttacgcctatcggaaactttcattttatttttgtaagtttcgaaattaacaatagtatgttgattgttatgctttttgacaagaaatccatcaatataaacaaaagattgtccagtttccgtcttatcatcatctaagaatgtaataattaagctattgagaagatgcagaatctgcgctatgcaggtgcaaatctctagcagcagcaaagtaaattcagttagtaagaaatctcactaagataagcgactgtctgtccccttcaagcacaacatagaaagcagaaggatgtctcattcatcgcttgatttccggcctgcaaaaataaagtagtcggtacgtacgttcgttttcaatttccatggtgcacagtatcttaactatctgcttagtcgaggagaaccaggattctgttcgttgctcagccgcttcgtggatattctcttggatactttaaatatggacctacgcttagcctgcgcttagcctacaacttcttccgctctcgaaaagaccaatataatagaaagttataaattacatttccttattaggtatacgacctcgcgcttcgaagtagaggagccctttttggcgtacctacatatggcgcgtcagacagacaaacttcccccaaaaatgtattaccccgccgaataagaaaacagacccattcacccacgacgtatcaagttacttccttggtgcaatgtcccactataaaaaaattccttgacgctagatcgttggactaaaatctgcgtcacaatcgcctaaacaggaaatattgcctattttcgtacaaggttacttcctagatgctatatgtccctacggccttgtctaacaccatccagcatgcaatacagtgacatatatatacccacacccacacccacacaccacacccacacacccacaccacacccacacccacacacccacacccacacccatcacaaccctaaccctaccctattctaaccctgatgaacgtgtctctcaacttaccctccattaccctacctccccactcgttaccctgccccactcaaccataccactcccaaccaccatccatcactctacttactactaccatccaccgcccatcataaccgttaccctccaattacccaaatccaactctactaccattaccctaccatcgaccatctgctactcactatactgttgttctaccctccatattgaaacgttaacaaataatcgtaaataatacacatatacttaccctaccactctaatcccactaccacatgccatactcaccttcacttgtattctgatcggtcatacgtacacggatgctacagtatataccatctcaacttaccctgccataacattccactccactccatggcccatctctcactaaatcagtaccaaatgcacccacatcattatgcacggcacttgcctcagcggtctataccctgtgccatttacccataactcccacgattatccacattttaatatctatatctcattcggcggccccaaatattgtataactgctcttaatacatacgttacaccacttttacaccgtatactaaccactcaatttatatacacttatgccaatattacaaaaaaatcaccactaaaatcacctaaacataaaaatattctattcttcaaccataatacataaacacactcaattgcgtatcaataccaccatgacgtcattaacttaaatgttccttaatacgtcataccactatgctctattccatatattgtaatataactgtactctatagtcatacagacgcttttacttcaccccatcttctcatactattgtcatagaatctcacactgacgcatgattaaaacgaataatttttactgtaagggctgccatccgcgctctatccttttgtttgcaatatttatatacagaatctcaaaacaagcgggagaagtgctaattacccagaggtcatgcataatctgagtaccaccgtacctctaggttttgctttgatccgttttacagtgacaccgaacataaggggaagctattgacatggtatcgaaaggttgtccacattgggaagtaacttggttctatgaatcttcatgtcagatacgtaggacagactcttcctgtgtaaatatttgtgacagctacgtctattttctactagatgtttacacagttttgtcacaggaaatctacgcttaaaatatgtatttcattcaagcggtaaccgctgtacgagcagtgacattgctggtcgcaccttaaatgtaaaccaacgttacggcacaccgtgatgtacccgcattaaagttttgtaaattcgttattacgattatcgagttggctagatagaaaaccggaaatgaaatggatgcccttttcgaatagctgagtttctttgcctaaaatagcccaatattgtttccctttttctatcacgaggttactgagccattgcatgaacgcgcgcgcctcggcggctttttttttctgctgtgctgtataaaagcgaaaagccagaagttactatctcgaataaaaaacccctcgaactgccatctcactaccgaaaatgaaagagaatgaacttaaaaatgagaagagtgtagatgtattatccttcaaacagctcgaatcccaaaagattgttctacctcaagatcttttcagaagcagctttacctggttttgttatgaaatttacaagtccttagcgtttcgcatctggatgctattatggctaccacttagcgtctggtggaaactttccaacaattgtatttacccacttatagtttcacttctggtcctgtttctgggaccaatatttgtccttgttatttgtggactttctcgtaagcgttccttatcgaaacaactcattcagttttgcaaagaggttactgaaaacacaccaagttctgatcctcatgattgggaagttgttgcagcaaatctaaattcgtacttatatgaaaataaggcttggaatactaagtactttttcttcaatgccatggtctgtcaagaagcgttcagaacaacccttctcgaaccattttctttgaaaaaagacgaagctgccaaggttaagtcatttaaggattccgtcccttacattgaagaagcattgggagtttattttagagaagttgaaaaacaatggaagttgtttaattctgagaaatcatggagccctgttggcctggaagatgctaaacttcccaaagaagcttaccgatttaagcttacttggtttttaaagaggatttccaatatttttatgttgataccattccttaattttttgtgctgcatatatgtgtcacggggaatgtgccttctattacgcaccttttatctcgggtggattcttttcatgttggtacaaggtttccaaaacatgaggatgatcgttttatccgtgaaaatggaacacaagatgcagttcttgtcgactattataaatgagcaagaaagtggtgcgaatggatgggacgaaattgcaaaaaaaatgaataggtacttgtttgagaaaaaagtctggaagaatgaagagtttttctttgacgggattgactgtgaatggttttttagccacttcttctaccgcgttctctctgcaaagaaatctatgcgggctctatcattgaatgtggaactatggccatatattaaagaagcgcaattatcctgcagtgaggagtccttagcgtaaagataaatacaactttttcaatttatatattttgtagtttgtcagctgcgaataaccaaaacgagactactttttaccattacaaccattttctttttccctatttctcactggttgacagaaatcagtgtgctatcatcctaccatatgcgctaaacttattgtctttctcctcctagagatgctgtattccatgcatattctgaacgatgggttggtgtttttatcaagcaaggttaatcacatggcgtggcttgctccacacatcagtagaaaacgcataccgcagcggaatccttaaataataagtgattttactgttcatcaactacaatcggactctttcacaattacccttcttgttttccacatttactgttaaatgaagggatgtacagaaggcttaggaaaacctgtgctgaatactggatggacactgcattcccacagtgaaacttttatagatacactgtcagttattttcgaactttcatcaagttgctgagttttagtatccctttgccttagctatatgtttgaatgagcaaaatatttgcaatgtctctagctttcttgaaatattggtttatattgagggcttggtaagatttcaaatttcactttgaaatactcaggagaaaaatcatgctcttttgataatttggtgactaaacatacataaaacagtttaattttgggtggtaatggctgtgtgactagctatagaaagaaaaaaattaaaaaaaaaaaaaaaaatcaagtagttcctgcactgcgacgtccattatagcattatgaattggtccctgatttacgcatgcgataaactatttttagcgcagccgcatattatccgagaataacttccgacataagaaaattcgcagaaaatagataaaaaactgctcttggcattcttcacttcctctattacacactgtgtcataccacaatcatctcacagtatgtatttgtatgtttatacatgctataacgtaaaacaatgtagaatatatatctaaatacctcacggttttagtttagtgcagcccacatactacttttttccttttgtttttttttatatttcaaaggttaaactcgcttagactatgtctataatataaaaaaaaaaatagctctattccgtttcttttattctatttgatatttccatcacactttcatcttaatcacggatgtatactgataatagggttgactgcgcctgtacggattacagtgccctcttcaattggaaaatccaagctttcaagatgcgtaactgttattcaaaggatcctctaagataaaacacagatcggcagatccgagagttggcttctgtgccttgggctcaaattcctttcccacctcattcaaattgatttttctgactccaaaaaaagacaaagccctgcgatagttcccgaatgttgtaacatcaaagccaagcactcctttatagaagtcgcatgaacgttgaatactagcagctggtgaaactacagggtctaaactaactagtatccatatcgttttgagagcattgaaagtatacggagtacaagctgggttagaaggaatttttatcttaacagcaatgaaaatcaactttctagactgaatccctcaagaaaattgcaaaagactaaccgatactggtttaaaagagaaagatgtcaaatatgcggagttataccatcaaacaactttggacggccccgaaacaaatgtccgcaaaaaagatcttattaaagtgcatggacactatcatttctataatacaaaatactccaccgcacaatagtttgtcgggaagtcatcaatcaatcttgtacgagctttacaaataactttttaggatcggtcccctcataaaattatatataaatgggttagtttccttcttcttctgttaacatgaagttgcttcgtactgttttttgccttgctcctcttcaaaagaatcaatcatgtcacagtacggatttgtaagagttcctagagaggtagaaaaggccattccagtggtgaatgcacctagaccacgggccgttgttccgcctccaaacagtgaaactgctaggcttgttcgggaatatgccgctaaagaattgactgcccccgttctaaaccactctttgcgtgtttttcaatatagtgtagctatcataagagaccaatttccagcatgggacttggatcaggaagttttgtacgtcacctgcttacttcatgatattgcaacaacagataagaatatgagagccacgaagatgtcatttgagtattatggtggcatactttcaagggagcttgtatttaatgcgacaggtggaaatcaggactacgcagatgcagtaactgaggccatcattcgtcaccaggatttgactgggactggctacattaccaccttggggctcattctgcagattgctactacgcttgacaatgtcggatccaataccgatctgattcatatcgatacagttagtgccattaacgagcaatttccaagactgcactggttatcatgttttgctacggtggtggacactgaaaactcgagaaaaccgtggggccacaccagttctttgggtgatgatttttcaaagaaagtcatatgcaatacatttgggtataactaaataggtaagtttcaatgaggcgagttcagaatgaacagtgatgatctcctttctccataactatactatacgtcccttttatttactgtagtttttaagaacaaattctctgatgaaccagtcgtgaaaccgtatatcgttttctgccaattccggatgaaatgatgtcgcaagaatattgtttttttgcttagcggcaacaattagttcttgaccaccattatccttcccatctaatttgtacaggacctgcacatgttcaggatccagcacctcttctattactggggctcttataaaagtagcaggaaaatcattgcagtgaggaataaagtttgaaaagtcgcaaatccgggtagaagactgagcttgtctcccaaatgcatttctttttactttaacctttagtaaattcagcgtcttgaccagtttttcttcgttagataattgttgtgaaatataaatcatacctgcacaagtaccccaggttaccttgcttgggttgtgtacgaatgcgtagagatcgtcgtaaaatcctgttctttctgcaataagggacattgcagtcgactctcccccaggtatgatcaatgcatcacattgagctagttgatttttatccttcactgtcatcacagatagttttttttcatagaaatccctgttttcgacgatgcatttttctacgtgtcgcacatgttcaatgaacgcaccctgtaatgccaagactccgataacgacggtcatttttgagatattactcttgtcttggccccagcaaccggggtcatggtaagtgtgcttgctactcaaacagaaaaaaatgggcttttatcaatgaataactttttttttttgtagctgaatgatgaaagatggctcaactattcttacagtttccaataaagtgacgcgccgcccaatggcataacagtagtaggcacattatatcgtttgaatggcaaaatgttgtggcaaggaaagatcagaattatttgttcatgtggaatgaatttcacacacacacacacacatatataaaactagtatgtttctccaccatagtcacattattattcgacccttctaggaaaggaactataatagaaaaataagtatatcgtaaaaaagacaaaaatgtcagaattcaaggttaaaactgggcttgcccaaatgttaaagggcggtgtgattatggacgtcgtcacacctgaacaggctattatcgcagaaagagcgggcgcttgtgctgtaatggcattggaacgcattccagctgacatgcgcaagtctggccaagtatgccgtatgtcagatcctcgcatgatcaaagaaattatggaagctgtttcaattccggtgatggcaaaggtccgtattggacacttcgtggaggcacagatcctggaagagctgcaagtagactacattgacgaaagcgaggttttgactccagctgattggacacatcacattgagaagcataacttcaaggtgccatttgtttgcggtgccaaggatctaggtgaggctttgagaagaataaacgaaggtgctgcaatgatccgtaccaaaggtgaagcaggtaccggtgacgtttccgaggccgtcaagcacatcaccaagattaaggcggagatccagcagtataaagagaatttgaagaccgaatccgattttgcagctaaggccacagaattacgcgtccctgtcgacttgctgaagacaacactatcagagggaaagctacctgtagtcaattttgctgctggtggagttgctactccagcagacgctgctctattgatgcaattgggttgtgaaggtgttttcgtcggttcaggtatattcaaatcgtcagatcctgagaagttagcatgtgctattgttgaagccacgactcactacgataatccagcaaaactgttgcaaatttccagcgatttgggtgacttgatgggtggtatttccatccaatcaattaatgaagcaggaggcaaaaacggtgcaagactttctgaaatcggatggtagaactagcgatgctcacacaacgctaatttgtttccttcgaaggggcagtcggctattgtagtttctatatattatgtagcacaacatggaaaccatattcagccagtttgtatatatgagaattaaacgttaaaactttttcatcctatcagtcttacacattggccttgctaaagggcacaatcgttcacgtatatacatatgtatgtttacgtatatatatatgtgtttacaaatatgcatgtatattcttttcgaggaagattattatatgctattaggcgatgagtcggcttaattttttagggggacgagattggcgcgttagtgcataaagacagcaaatcacctggaggtgacaacattaatgcatttatcggtttttggctatgatgcaatgagtacagttccaattgaacggctcatgaactatgaaatatacgaattattcaactagcagaaggcttgaaatattacttattcagattatgaaaatggtgctgttatagcaaaataagcaacatcaatctcttgcgacgacagcaaacaaaacatataaaaacctcgtattatcatcttcatgaacaatattcttgtccattctttcgttcttttaccttttcaattttataaaaataccacaacaacaataaacacacttccaagctatgtctacagacaagatcacatttttgttgaactggcaaccaaccccataccatattccaattttcttggctcaaaccaaaggttacttcaaggagcaaggtctagacatggccatcctagaaccaaccaatccttccgatgtcactgagttaattggatctggtaaggtcgacatgggtttgaaagccatgattcacaccttggctgccaaggcccgtggtttcccagtgacctctgttgcctctttgttggacgaaccatttaccggtgtcttgtacttaaagggcagtggtatcactgaagacttccagtccctaaagggtaagaagatcggttacgttggtgaattcggtaagatccaaatcgatgaattgaccaagcactacggtatgaagccagaagactacaccgcagtcagatgtggtatgaatgtcgccaagtacatcatcgaaggtaagattgatgctggtattggtatcgaatgtatgcaacaagtcgaattggaagagtacttggctaagcaaggcagaccagcttctgatgctaagatgttgagaattgacaagttggcttgcttgggttgctgttgcttctgtaccgttctttacatctgcaacgatgaatttttgaagaagaaccctgaaaaggtcagaaagttcttgaaagccatcaagaaggcaaccgactacgttctagccgaccctgtgaaggcttggaaagaatacatcgacttcaagcctcgattgaacaacgatctatcttacaagcaataccaaagatgttacgcttacttctcttcatctttgtacaatgttcaccgtgactggaagaaggttaccggttacggtaagagattagccatcttgccaccagactatgtctcgaactacactaatgaatacttgtcctggccagaaccagaagaggtttctgatcctttggaagctcaaagattgatggctattcatcaagaaaaatgcagacaggaaggtactttcaagagattggctcttccagcttaaacgtgcttcgtcactcgttcagcccagccttcctctacgacttgtttatgatttcacattagctgttgtttcctactcgatatatagacatacatatttacgtatcagagcatgtatacaagctttaaatgaacttcgtttatcttaacactttatttccttgcaaaatttgcacacactcggtggataaggcaactgcgtataatttgtagcttcttttcaaaatatagtagatggatattaacataaaataatcactttaactaattgtcaaaagctatcctggcagacatcgatgtgaggggtgaaagcttcttggttaccgctgggtcatctcctattaaacttttgggaaagccaacatcaaaaggaacaatactttccaggtattctatttgttccggtgttaatttaatactcaaagcctcaatgttctgcttgagatgttcaattttccttcctccaatcaatgggaaaacatttttcgctttagagcgaacataggcaatagcgatagcagtaacagactctgttccatgttcctcagcaattttagtcaatgcttcgctgattttaacctccaattctgtttgttcggggccacccacaaaagtacgcagaccctctccattcttcttccgttcttccattgcttttttactctgaaatcttccacctcccatgacatcccatggggctagagccataccaaaatgcctagccattggaataatatcacgctcaaagtccctgttcaatacattccatttaccttgatagacgctaaaaggagttttaccatgagatgtagcgtagtaatttgccgcagaaacaacccaagcaggtgtatcagatactcctaaatataggaccttgccctgctgaactaaaatatgcaaactatccataacttcttcgattgaactcatataatcccaccagtgaatgtaaagtatatcaatccaatcagtttgcaatttgcggagagaatccctcacactcacatgtaaactacgcttgtgattaccacagtagttggcacttttaccaccacctacttcatacttcttataatctccggtaaacttggtggcaattacaatctggtcacgcagttttcttgatgccatccattcacctatccaaatctctgactcttcattttggtaactgtttgcagtatcaatacaattacctccagcttcataaaaagcatcaagaagttcaaaggcctgttccttattcatagagcccataaagcctgaccatgcgtcgccgattgaagctcctcccagaattagcggtgaaacccttatgccggcagttttagaaagaaccctgagacgtcccaattcggtaggtggttcaggtagaggtttaaacaagtcagtcatgctgaatagtggttttttatgcaatagacaatatgttaagtaaaatacaaagccgttcagctaattggttagctagttaatgaagagaagaacagcatgcatccttgacttggaaatattgtcatacttaaatatggttggaaattttgccccccggtttccttgaatacgaacaatgcaacttatttgagtcttcgtacgagatctgcttactggttttgtacagcgctgaaagcgaatttgaaaatatatgcaattagaagagagtgaatcagatgaggatagggttaatactgtaaaattattaccaaatattgaatgacatataaaagtcgtagtaaccgaatttgttttttattatgaataaagacttcttgttttcgcatacttcgatgatttaagaaattaaaagtcatttacccaggcgtgattataaattatattggcaccgctttatcaacagcggtgggacgagacgtttagatagtaattacaatagaaatacaactgtttcaatattaaaatatctctagtatgtaaataacacatataggcaattttcttcgaaacgtatgggacgcggttgatgtatgaacggaacgcatcaattaaaggtttgagaaaagtcttttgcaaaaaaattgagtttgcacttctcatacacaattggatagcgtcttaagtgccttttattcacttttcttcttttgtttcacattatttatattcgtatatacttccaactctttttttcaatagaattcattgtcatgctcaacatgtaggtccctcgcatattgcgaaccacccttcgtatctttagcctcggcagaatcttcttcaacatcacccaaatcttcggcatccctaggtgtgtgattcaactgaacactaggggcatactttgtgttttccaaattagcaaatatattggtcattaccttgtcaagatattcgggagtatttacattgaacatattcgaaggtctaacacttaacttataatctggaccgtaatattcgtaatattcattgtacggtaaatctttatccaagacaacgttatttagtagacctgtttcaaagcaccatgtccttgcaacatttctcatagtatagcctcctccaccaacaaccatcattgggatcccaaaggatttcacatagtttacacaattagcatggccttccatggaaagattaaagcaaccaagacgatcgccggacaaggagtccccaccacactgtaacacgacagcagaaggttgataccattccataattttttttatcacaggttcaaacacagatctatacgtagcatcgtcaataccgtctcttaatggcacattgaccgcgtagttttttcctgcacccacccctatatctctcagttcacctgtgccagggaaaaactcaccatatttgtggaaagaacatgtcatgacacgatccgttgtataaaacgcttcctctacaccatcaccatggtgcacatcaatatcaatatacagaactctggggtggtatcgtagtagctcaataatgcccagtactatgtcatttaaataacaaaacccagaagcttccgatttttttgcatgatgcaaaccacccgcatagttgacagcaacatcacatttgcctctattcagacgagcagctccttccatagagccaccaccagatatgctacagtactcatagagcccatcaaagacaggacaatcatctccgacattaaacttgacactttctcttttaaacatttctaaattatctggagtaaccctcgataaaaaatcaatgtattcatcagtatggaactgacacatttcttgtttcgttgccggcttagctctgtaaatttccatcttcttgtacaagccataattcataataagggaatgtgccattcttattctatgcggcttcatcgggtgacctgctccatatgcatagttcccaacgtctgcatcgtaaaaatatgcaacgcgtcttttatcgcttggcttgaccgtgatcggatcaaaaggtgttgcttcatataccatctgcacggatatcgagttgtagccacgaatgttttgtatggcgcaattgttttatgaacctttatggttattacttcaaatttttattatgtataatcaactactagtatcttttctgtttttccctttcgatagatactatgagccggggagggtaagtaaataaaaagataaatttcaaggcaaaatatgggacatatatttacaaatttacctatacgctctgagttgatattacttaagcaccttcaaaattagctctcaccgcttcataatgattcagttcagcccgcgacacacttggggtgagctgctcttgtgctttcaagaagtcttccatttttacgacaaccttagtatcctcttttgtcgcaatcttatcaaaccagcgacgtgtagaaatattctctcccgtcaattcgttatgctgagaaacttttttttctaccatgcgtgcaattcttgacatggcgttaagcattgcatctgagcagagagcataaaaatctgccccggtgtaattaaatggacatagctttgccaactcaataagctttacgtcgttgtcgagcacgaatttgcgagtcagagcctctaaaatattcaattgtttggtatccgtatccggaatgcctaaatataacaatttatcgaatcgtcctggtcttagtagtgcttcgtccaataagtctggtctgtttgttgctccgataacaaatacaccgtcagcgtcggtactcataccatctaactctgctagtaactgtgaaacgatacgatccataacaccacccgaatcaccttgattaccacgtttgggtgctactgaatcgatttcatcgaaaaatatgacacaaggtttagcctctctcgccttttgaaacactctgcgcacattagcttcactctcaccaatgtacatattcaacagttcagggcctttaacactaaaaaaatttaaagaaaaatttgttgcaatggccttagccattagagttttacctgtacccggtggaccataaaaaagaataccgcttctctttttcatacctgaggtaaataattcaggatgttttagcggcatgtctattgtgtccaatatttcacctttaacaaaatcaataccacctatatcatcccaagttacgttagggatttgtggggcaccaatcgaaaccgagaattcgttcctagctttcgaagtagcttttgataaatcctcctgagtgatcaaaattgattgcggaagccatccacacttctttgattcttggtaaaaacgcgcagtagccgtcattcgtgccgtttccacaattgatttgatgtctaaaggagttaaaccagcagaatatgaagagagtgatgaaaatgaaatattatccatgtaagatactggaaccttttgttgaacatctctgtttagttcatgtgaagataagtaccactgaaagatacgcagtctctgtgcttcagacggaacgggtacgagaatctcaaatctcatatgtgatctaaagctggaaggcacgttatctatgttatttacggagccaacaaatgtagttcctgggaatttaaacgtaaaatcgtccagaagtttagacatttcgaagtttatagatttttgtaatttgattgcctctggatcttgattagcgtttacgtcaagcaaaattgaatccaaatgagccaaaaaaatcacagcaggtgatgcgtacggtaggacattttcacatttagccctaatgtaaccaataatcttagatgttgaatccagttgtcttgaatttgaagtgagcgaaaggcaatctatctccagtagatgtataccaagatattttgaagcaaatctcaccattgtagccttgcccacattgtttgtagtggaatgaagtaacacagaggcatttagggtgattcccctttgagaacaattgaaggaagtttctaatatgttaaccaattgtcttacataggggaagatatgcaaatcatagtaaaaagtttcagcaaaaccgtaatatctctgaagattggatctactcaagggtaatggtcttctgttagtgatattagttgttattagcttcgtccgattgggatcaataataaaatgagaattatctttagagaagcaatcgagctctgcgcttgtgacaaagaaccatacaagggaatcgttcttgtagtactgccctagctcatcttcgtcatcagactcatcattttcctctgctatattgagatcagccatacttgaatcaaaagcgattgggattaaatcattttgacaaagaatccttttgctctcgctaaaaaactttttcaaggttgttagaataatattttgaaagcatttctgagattgaagccagcctccaactcttgagatgaaaacttgattagcaatgggaatatctgtatggcctatattggactttgatattgtcacgacgctgcagtctggaaagcttgctattattttgggaggtgcgtatattgttctttttttaaagccgttggggagtagtaaaacaaacagcttaactagcctgacgcaacccatatttgacactgttataaacgatccacttgtgacatccaggcgcagtagagtttcagcgtctgtaaaggcatatattgaattatcatcattgatgtgaggtgcaggtcgcaaaagatctcttgaaattgtgcaggggagagattcaagatcaattgataaagcagaatttgtccctattttaggtaatgcatattcttcatcttcgttagcatattttagagcacttagtttctgctcagtatcatttactaatatcaattgggtttctgtaaaatcaacaaggccctgcgggaaaggtgagcagtttaaaatttggcaaagaccagatgttaaaatatctcgagaatgaaccacggtttccatggagttgatgttatatttgtaatgcaaaaattgtatttgttgcatctcttgcggtaggtccattagttttgagtacaattgttcattaatcagaaacgttacgctatccagtacaggtactacattgtctaatatgggttcaaaatagcaaaaatccatagtgggctgtgtcggcataaacccaaaaagtttggaaggtacaacaatgctacagaagggcagtgaatcatccaggacacaatgtacaattttaccaggcgtgcaacctggaccgtactgaggcaatctaattgtcccatataaacattcagcttttttatcgccgtattcgagatatatatccctagaaatgctacagggggcgtatattccggagagactaaacgtaagcgatgccttcatattaatgttactataatcgctttcttttggagggtatgcaaacacatatatgctctccactactgttctttgttctaattctaatgacttgtttgaaagtctccgatggccgcactttcccggaagtgttgacgattatcgccgtatactatgtggtgtaaggaagtgtagcaattggctacatgatatataaagttcttttatctctttcttagtaaaacacttctttcgagaacttctttcgcctcatttatcttggccgccatgtagggactccctcctctgtctgggtggttacgaaccatagccttcctgtgcttttttttcagtaatttttcatccaagtgattaatctctctggcggagatatccaagatgagcaaggcttcgggctctgtcattcgcggtgcaaagcctccctggtactggtttaatctatttttcagttcttcgtctatcagtgagcttttgaacttaagtgcatcgcggtagcccgccgtcgggttttctatgcgaatgttatttagttttgcaatagttaaaggggacagggtcttgtagacggtccatgcattgagaccagacttgacacttagagcaaccattgtcacgcccaaaccaattattataggcaaaaccatgctggaatatcctattctttgtggctatactgtgtattgagtggatcctagcaacgaattcgtttgttgttatttttttctagattgtatctccgtttccgaaattgttattcacaatgagcgtttacctcttgcaataacaataatcagagaataagctacaagacgaaaaatgacgttgagcgtggcagtaatgcataacgaagatcaatagtgtatgggatgttggatatgtcgtttccctgccaaagaaaaagaaacacaaaaaagaaaaagcaaaaaaaaacagtgctaaggatttgatattaaacgaagtcccaccatggaggatcatatcccaataaatttatgcatagaatggtaccattcacaactaatatagcctctgctggttcctttagtaacctctttagtaacctctttagtgaaatggttcttgctggctctattattttcctaattcggacgcgctggctccgcgccgtgaggaaaaacagcaggctgacaagggactaatttactgacactttcggctgacacttccgaaaaggtactcaagcttttatgagtaagatgctggtttgatgctaagaatacgatttagtacttcctttttaatgtggcttgttttttttttattcgtccataacagtacaaatataaaagcagaatacattcttgccgacctaaaacttgtgtccttagactcaaactttctgatggttttctttcagtagaatcaacataaacaagcataatataaaacactacaatgaataaactattgttacatctagtacgagtcatttcgatactcggcctagcaaacgctctcacacaaacgcaaccgattttaaaagatattcaaataacagatagttataccaaaacaaaagaatgtacggatccagatcattggttcataatagaagggcaactgtctattccaaagggaagtcagcaaaatataacattccaagtaccagatgctttcagctcattccctcaagaacccttcagcataaaacataattctaacagtgttgccacgatatcacgcccagataaatcgacgaacaatttcaccatttctattccagaaaagagttcagaagatataactactacatttaacttccttgcacagcttacatcagatgctaaatccaaagttacagaaccaaaaagcatcgtttacagtttctattcagaaaatactatgtttaatgacgttattgattacgtcgctaaaaatacttctgctataacaacagatggtggtatatacaaaactaataataccgcctggtttaccgttgacttaccaatgagaacgttcagaaatcccgtttatttgacttctcagacatcttcctcctcagattacgtattcgatacttcgttaactaagtttgaggttgtcactgccgttgattcttttaacgaacctattaatgctatcccatatacaactgttcatgactactccacagaagatgaaattagatgtttatttaattctacaatcagcggtgggctatacttccgtgtgacttatttcacaaagaagctatctacctcgtccatatcaaatactgtcgaattaacatatcccgatgaaggtacatctgtcagacttttaggaaagagagatacttcaaccaccctagcctcagaattatattctgagtcagctgctaacattgattccaccaccagtgatgacacaactagctctgatgctgctataacaccaacatactcaaattcaacgctttcttcttatacttcgcaatcatccgctatccctgaagttgcggttactgcatcattgagtagcgggatcctttcttctacagttgacggtgctagcacctcggcggacgcttccatgtccgctgtctctacggtttcttctagcagtgaacaagcttcttcttcaagtatttctttatcggctccaagttcttcaaactcaacctttactactccttcatcttctctgtctgctactgaaacatatagtattatcagttcagctagtatatctgtcacacaggcttcctacattgataattctacaactaccgctgttacccaatctacttctactatagcagtttcatctgctgaaaaattgtcaagcactctatcatacaccagtaacgtcacaatatcagtatcatcagctacccaacatactactactccttcatatgttagtaactccactacactctcatcctcatctgttcttgaatctgtaattagctctccatacctggcaaacactactgtttcaggagcttcatctgcaagtcaatctactaatccgccatatgtctccaactccacaacatcatccgcaactcaattagccaccattgctccgttcgcgattaacataacaggaacaagtatttcttctagtatcactaatacttcttcagttagttctactacgtccagtttatcatccggcccatttgtttcaaacacagcggttgcctctgggtcttatattctaaccactactacagagtctgcacaacttactgaaatagggagtttgataccaatctcgactattactactagtaccaccacttctggtaccgataaaactggtagtaataaggtggcctcttcaactgaaatagcgcaatctatcgtaaacaacagttcactttcggtgtcaacaatcaacactaacgctgcgacagcagctgctaatgccagaaatgctactttcactcatgcaacccattctggttcgcttcaaccctcatatcatagcagctcactattatcgtccacaattgacaccaaggtaactactgctactacaagcaccagtagagacggtagttcgagtttggctttcaccactgggctcaatcaatccgtagttaccggtacagataaaagtgatacctatagtgtaatttcatccacagaatcagcccaggttacggagtacgacagcttacttccaatttccaccctgaagcctacagtcgttacaggtacaagtagaaacagtacctttagtatggtgtcctccaccaaattgaccgaagctactgcaacggataaaggtgatgcgtatagtgtaatttcatctacacagtcggctcaagttactgaatatggaagtatgcttccaatttctacgctggaaacaccaacagtcattatgagtaccgatgaaagcggctattttactttaactacatgtactgagtctgggcaagctacagaatatggtagtctgattccaatttccacactagatggttcagttatatatacatttactggcgaaagtgtagtggtgggttacagtaccacagtgggtgccgcccaatatgcacaacatacaagtttagtcccagtatctaccatcaagggttccaaaacttctctttcaaccgaggaaagcgtagtggctggctacagtactacagtgggtgccgcccaatatgcacaacatacaagtttagtcccggtatctaccattaagggttccaaaacttctctttcaaccgaggaaagcgtagtggctggctacagtaccacagtagattctgcccaatacgccgagcacacaaatttagttgccatagatacattgaaaactagcacattccaaaaagcaacagcaactgaggtttgtgtcacatgtaccgccctttcttcccctcattctgcaactttagatgcaggtactactatttcattgccaacaagttccagcacatctctatctacaataattacctggtattcctcatctactattaagcctccttcaatttctacatactcgggcgccgctggtcaattaaccatccgtattggcagtttgttgctagggttaatctcatttctgctgtaagaactattttatcaaatagaaagttataaataaaaactaagagttcttttggtataatgcataaataatttttttatataatgtttgtaattgtaatgataaatttttatcatcttggataattttcgtattatcgtaacattcattcgttctagttttatgactaatttgcatcgataatttctacagacgccctatcggcttctaatgagggtcttggtgttactcttctcagtaattgatcttctaaacatctactacttagcagtcggtcttgtacttgaggtcttacattaaaatataaacctttttcatcctttgtgtgtttagactttttgtacttgaaggtctcaataggaagtatccactctaaccaagatgtacccattatatcttgccagttggccattgaagaacccaagtcaaatatattctctaaatgctcatttgttccatagctgtcattgaggatttcaagatcccttcgataccttctcattccgtgtacctcgatagtagtttggtttttacaaacctgataaatgctgaaacaggtaaatgctaaaacagaaatgaaaacagcaaccgccaatagggccacccctaatagatgaaaatctatcaattcacggttgaaactaccggagttaaaccacgtcccaagctcatagcaagtataaattaggactaagaacgcgtataatgttgtgtacattaagaattgaataaaaaatttttgattcctaaaaccagtgcattcagcgaaccaagggcaatgatgatccattttcaatatgcaaacatcgcatgatgaacaatgatgacagcgatcgggcttccaaacatggcatacttggcacacccgaaatcttccatcatgttttaaggtcaaacacctttttgacatatactccggaggaagttcaagtccattttccgctgcctttaaatcgtggactaacaaatcagggaaatctagaggagaaccgggacctctagcaataaccttataataagtgtatagagccactgccaatgtcggaactattgttagcgcgagaaaccacctaggtatttgatgaatccttgtcaatgttatgtatgcagtccaaatatacaaacatgtggtcaaacacctgggaaacagacttgtcaacgaaagcctgtcattcatttgcgaaaaagattctatcgaattccaagatcggcttctttgtcttgtatttggtacgacttagttatataggtttttttttttttcttggacgcaatcacataaaagtgtaatatatctcattagacaaaattggaaaagttagataattagcgtaaaagccttcattaatgataatagcgtgggaggtataagatgcgcttaataacgctgaagaatataaagtttcttatacattcaatgaaacaaggaaattttcaattttaaatttaagttgaaatagcctttagcacctaaaaataaaaaaatattaaaacaccaacatgttgttgaacaagttttccagagaattgaccgaatatttaaatttctatttaagagtcatataaatttattgaaaatcaagttgtatatctttagaaaagcacaaatccctgtaaagctgcaaattgtcgggcttaatgtgtataacagcagaatagtcatcaagagcaggtttataatcatcgacattgaggactttttcgtaaaatttttcgtcaacagacacatgatcaggagcaataagaagtgcttctgttgtcatctcgtcattctcatcgtcgccatcatcatcatcatcgtatacatcagtgaaatcttctgcaatatcaactagtggttctcctattacttttctcattggtggaatctcactactttcatgactgataaaaattggatattttgaatacgaaaatgaattcattttctcttccaacttttggcttctgtcagatattatgtgcaggtaatgttcatacaattctaattcttgctttggagatgtatctctgtctaaatcggtagtctcaactaccctaccttcagccttttctaaactcttactggatgtgatcatctttagcttattattcagccaactttgcttcctagaagtgaacggcgacatagccttgtcttgtttggacaaagcattatgatatcttcttgttgaattcatattatatgcaaagagatcgcgaatccaagttactgatcttggcagataatattcattccagtaattgtcaaaggcaccaggataacctcttacgttttttataattttctctcttgtcacatcattacctgttgcaataagttcttcattaatcaattcttttacacttttgatgttgtaatcattccaccaatgaatatagctccttttaggcatattaagactataagcattatgcaagtagaaatcggtattcatttcccataaagagggaaatccttctctccaggagtagtgacccaggaataaattaatcgcatcttgcctttgtgcatcaacgaatgaattactgtagaatctttttatactttcgatcatatcccttgaatgggagctccactgatttatttttctatatgtctccatggtgttaaccaaatgcgaaccgccatattgtaatgcaatagtatctcccagatcatgaaacaattcagttagtatgttgacgatatcagagtcgtactctaaataactattatcgataattcctaaagatttgagctggcaaccaagtgctctcttgccaatgacgaattgggcggcgttggtcctatcaagacagtcaatacaattacttcgacatattccttcctggatctttgtagaagcaaagtctggaccattatgaaatattcctgtcgtcgtgacagtgtttaccgcgtacttctctaagaattcaataacaccttgaccatcttgtttagaagccctgctcatatcccaagaggtgtaatctaatttctttagtgttggtaaaaattcattcagataatctatacattgttcaaattcccagagtaacttagtttctcttggcgtcttttctttggttttaattaagttcagtatttgaatggttccgccaccatatctttgaaacaagttatcaaaatgcaacgcagccggagaaaaaaatggatctaccacattgattcttataggtggctttgtggttaaattggacgcatcctgggtccagtataaggggattgagccacgatgctgtacaaaagaagtgtatcgatcactatcaaaaaatccatttcccggttgatggaatggagtcaaaatcatatctgttacaatctgttcagtttcgacttcgttagcaacatgacctttattgttaacaccacgctttagaaagcgtgcaccagcaaaatggtgggatcttcttgcgattaaagtaatatatatggacttacccaaaactgaaacattaacctggtcaataaatccatgtataatgcattggaaccaatcaaaaacagtgtcaatacaagcaaaaataggagataataaattgttattccaaacaaacatttcgttatagtcggttatcccgcaaggtattgtaatatcacatcggtcaaccgcttttaatttctctcgcaatatattggtttgtaaagtatttgtgatatcgtaggtataactgaaataaaaggtttttgttaggtctaaatccttaaatatattcaatagccttgcctcatctgaacttttttcaggttttttatagttgttcgtaataggaataatatcaataccatcaatgtgataaataccatgaccgccaatcactgcaacttggctatacttggtaaccattattaaatagtaccaacaggtgaatttaatgaatcccagaagaccgtatcctgtaattttcttatgtagaccatcttcagttgcttcttctaaacttgctagtacattcatgatttcatttctggtgaagaagacattatcctccaacacagttaattctccacggggtacagtaagatcaatttctagaatacgaaacatggtttcccttttattgcttccaacaatatacattcgatctttggtttcgtataacgtatatttacccattacaaacttagaggtctttctctgcttagacccagatgtggtaagtatacctccaccaagggtatgctccattgcatcattgttcatccttgtcctgtttcttttttgctttgcgttacgttactacgtttcaaaactaattaatttcaaataatatcacagcatttacatttcaatagtgctcggctaagtagatgaggactatcgtaaagagaccaatagaagagcttgaaaactttacaagaaatatatacatgtatatattatatatatatgtttaatgcaattgcaagaggtattaacaaatcaggaggacaagtaaatgaacgtgctgcaataaacccaaatggcgtaacgagtgtagtgcgccttagtgaccaccgcaagatagtgccagtaactagtgtacaagtgtggcaaaatgcaaatgagcgttctggtagtatgtgtccaatgttgtagtgtcaactttgtctgccgttctggtggcttttgacagttgattttccaacgattattattatgcgcgaaattaaagaaaaggaatcttgtatgatgataaaataaatagatcaaattaaatcatcagtacagaccagaaaacaattaagtgtccttttagaaatacgagagggtggtaaaatattgaagaatggtaaatttcgatttgggccaagttggtgaagtattccgtagaaaggacaaaggagctatagtgtccggagacaacccagaagaagaagaagacgtcgatgcttctgagtttgaagaggatgaagtaaagcctgtgcgtacaaagaacagaagacccaaagaggatgcattcactcaacaaagattagcggctataaacccggtgttaacgccgaggacagttttgcctctttatctgttaattgctgttgtatttgttattgtaggagggtgcatattagcacagaactccaaagtggatgaagtaaccatatattaccaggactgtatgactaacgcaacctcatcatggagcgacatcccttctgaacattggcaatttgtatttcacaaatataaaacatataatactgcaccacaatggaggtttgtggatgatgaatcagatgacttcacaaaacaaagaggtacatgccaaatcaggttcactactccaagtgatatgaaaaataacgtatatttgaattatgtgctggaaaaatttgctgccaatcacagaagatatgtactatcttttagcgaagatcagatacgtggggaggacgcctcttatgagacggtgcatgatgcaaccggtataaattgtaagccactatctaagaacgccgatggtaaaatatactatccatgtggcctaattgcgaactcaatgttcaacgacacgttccccctgcagttaacaaatgtaggggatacgtctaacaactattcattgacaaataaaggaatcaattgggaatctgataaaaaaaggtacaaaaaaaccaaatacaattatacacagatagcacctccaccatattgggaaaagatgtatccagatggatacaacgagacgaatattcctgatattcaggattgggaagagttccaaaactggatgaggccaggtgcttttgataaaattacaaaactgatcagaatcaataaaaacgatactttgccagcgggtgaataccagttggatatcggtctgcattggccagtattggagtttaatggtaagaagggaatctacttgactcacggttctcaccttggcggtagaaatccatttttaggtatagtttacctgattggaggctgtatttgtgctgccatggcattgatattattaacgttttggctcttcggcggtagaaagattgctgatgcatcaagtttgtcatggaatatgaaatagaaaaggagtgatggttttctttatttttaaccctgtaaaatttttttatttttttatttttactcttatatatgtatatgtttgtgtttatttctgaataaaaatttataagaaccaaattaaaaccgttaatagcccacccaaaattgaagtaaacgaactcatacctagatgctgggcctcattatgcgaaactgttttctttattgcagatttaataacgcctacagtaccggttaaagtacccatcccaatagaccccacggagggagaagcgactgttacgtactgggaggagaaacgctggacaaaagtagtttgcacagtgatagtgttgccctgtctaacaacagtgacccacatggacgttggcgcacgtgtggttgtgtaagtggaggttgtaccttcagtgatggtaatgtatgagtcaatagatagactagtgacagcagacacaggaggttctgtgaagtctgtggaggggtctggcctggtgcctgtttcagctactgcgctccctgtcgatgtggtcgtctttacactggaggatgaaccagacgaagatacagacgaggacacagacgaggaggcggatgaagtagcactggtgctagaatgtgtgaacgtttgagtcaatgtaactgtggtacccaaatcgtttgtcgtggtaactgtagataaatacagtcccgaagacaacgatgaagttgcggtaggaacagtggtggttgtcttaccagtagatgaggtagaagtcgtcgtggttggtagcatagtggctctgttgactgtctgagtaagagtgacggtggttccgacatcgttagtggtagtgaataccgtagtgaagaaacctgtttgagcggtagttgtagcagcagcagcagcggtggcagggtcccatattgtggtctccgtaaccagggcccctgcgacatttgttaccactgtaacctgagttgtcacagctgccatgaccgcagctgaccacaacgacaaagaaagtagcagcgtagcgaatgaatgtaatagcgtgcgacgcatcattttttttttgattgtcttgcagaagttgaagaggtctttactgtagcatatacaagtgcttaattcttgatttttattttctttttttcataatacacgttatagaaaaagccccattctcagtttatgaaaaaacgcgatatcaccatacacgctgaggtagggggatacaaggtgaagaatgtacgcaataaggcgaagtatatggcacaattgagcagtaaaagtgttaaaatatagtgatatatatatataaaatacgagagtaccaactattatgatcttttaatgccctctttccgttgagatattcataatagtaaccgtcacggaactgtcgctttatacggtgaggggattatttagttcctaatttatattagataaagaagataataaacatgagggatgctgtaaatgaaagtgaaataactgctagctagaagagcggtaagcagcaatggccaaaaataaccacatttctgccagtggtaacagtacctctggagaccatcgtcttaaagaggaggttctgaccccaactacatctgcctcgactcctcatagaatatttagcgtggacgatgatccaaaggagatccaaaacgatatcaggtatcttgagggtctgcatgaagggttgaagttcgccctgcatgccaataaatccaagcgatctgtaagctcgcaatcaccaatcgtacatagcagcaacaacacgctgcaccaccacgagcaccaacaacacttgccgcccacactagagtcgctatcctccaagtcgcactctgtgccagacttaaatacagctactcccagctctccgaaacgaatgcattcatctatccgggaattacctcatgatgacaatgatgacgaggacgccaatgatgacagtcggttcattatacacgactcgcacggccatgatttacttatagacgagatcaattgccagtcgccttcacacttggaaaacaatgaccaggcgtctaatgcttcgtccacagagtcattcactttacgagaaagacaggacgccatcaacgagacccaccccttcggtatcaggatatggaagcctgctttatataagaaacaccgttcagttcaaagaaccgcggcgcaagacattcacgagactcagttgaagactattacctgggaggtgacttgttccaatgtgctatggtttattttgttcggtttccccattgcgatactcttctactcggcggctattgtggtatttttactaggcggcggaggactggtaacgaactctgcgaaggagtactccaagtgtctgtataaactcgccaattatttcctttggccttttggcaaaatggtatacttgttgcaggacgagcaatatttacaagaagataaggatgaaggtattagtatgcagcaattctacaattgggtgacttcatactccaacaggctggtcttccaccagtctcaggccaagtttcagcaaagagaggaccatccggcccctgcaacggaatcttcgtctttgatgccgcccgctaacacaacagcaacaccgcttaactcgaaccatccatcatataattctattagacacgaaattccgcacgcagcggctcaaagacggtactttgggagaggaaaatggagctggggtcgtgttcttttctatacaatcttccatctcgtcttgcaacccatccttgccgtcttatctctttgcctctggctcctggtgtttaccattcccatgagtaatgttctttggcaaattatgtatcattgcagaagacatccgcttgcattaggcttcaaatatgtcgagaactcctcccaatcgcacgaaaatgaaataacccagcagcaattgaacaaaaatatcctcttatgtacgttccgtgccgctggctggcattactacaagtacacagttgatggtacaaatgttattgttgtgaatttaatatccatcgttttctttacaatttttgacttttatgttttgaaaaatttcctgcattggaaaacgtggttcacatacgaatcctcaatattcattctttgtttgacatccaccatcccactagcattttacattggacaagcagtcgcatcgatctctgctcaaacttccatgggtgtcggtgctgtcattaatgcatttttctcgaccattgtggaaattttcttgtactgcgttgcattgcaacaaaaaaagggtcttctagtggaaggatccatgattggttccattctaggtgccgttctattattaccaggtctgtccatgtgcggtggtgctctaaataggaaaacacaaagatacaaccctgctagcgctggtgtctcttccgcattgttaatattttccatgattgtaatgtttgtccccaccgttttatacgagatatatggcggctactcggtaaactgtgcagacggtgctaacgaccgtgactgtactttctcgcatcctcccctgaagttcaaccgtttattcactcatgttattcaacctatgtccatatcttgtgccattgttctcttctgtgcttatatcattggcttgtggttcacccttagaacacatgcaaagatgatttggcaattgcctattgcggacccaacctcgaccgcaccagaacaacaggaacaaaattctcacgatgcacccaattggtcaagaagcaagtctacttgtattttacttatgtctacgctcctgtacgcaataattgcagaaatccttgtttcctgtgttgatgctgtcctagaagatattccctccttgaatccaaagtttctaggtctcaccatttttgctctgatccccaatacgacagagtttttgaatgccatttcatttgccatccatggtaatgtagcgttatcaatggaaatcggtagtgcttatgctttacaggtttgtcttttacaaatcccatccttagtcatttattccattttctatacgtggaatgttaaaaagtcgatgattaatatcagaacacagatgttcccattagtctttccccgttgggacatatttggtgctatgacgagtgttttcatgttcacctatttgtatgctgagggtaaaagtaactatttcaagggttccatgttgatattactatatatcattattgttgtaggattctacttccagggagctctttcggagtagaaagcaactgtccccgcttttcacctggatacctaccaatttttctttttcttatatctttgtattgtttgtctttcttattactttttattctatatagtctttagttaattaattacccgcaacgatcattaacacctcttaaattgatctactcacaattgggttgttcttatacttagagaggtgcgttcctcgaaataactcgaatcaagcccacacctgctcccttttttatttctccgtcaattgcactgtagaatccttttctggtctcatgttgtggaaagtttctaagatgttcttgggtggcttggtagcgctaacaacaatatcggttgcgaccctttatcactaccaaaatcgcctagtctacccatcatgggctcaaggcgccaggaatcatgttgacactcctgattcccgtggaatcccttatgaaaagctaaccctaattacacaagaccacattaaactcgaggcatgggatatcaagaatgaaaactcaacaagtactgtgttgatcttatgtcccaatgccggtaatattggatactttatactaataattgacattttctatcgtcagtttggaatgagtgtatttatttattcgtatcgtggttatggtaactcagaaggttcacccagcgaaaagggtttgaaattggacgctgattgtgtcatatcgcatttgtcaacggattctttccattcaaagagaaaactagtattgtatggtagatctctaggtggtgctaatgctctttacattgcttcaaaatttcgggatctatgcgatggcgttatactggagaatacatttttgagtattcgaaaagttatcccatatattttcccccttttgaaacgctttacgcttttatgtcacgaaatctggaattcagaaggccttatgggaagctgtagttcagagacgccattcttgtttttaagtggattaaaagatgaaatcgttccacccttccacatgaggaaactgtacgaaacatgtcctagttcgaacaaaaagattttcgaatttccacttggttcacacaatgatactattattcaagatgggtactgggatataataagagattttctaatagagaagggttttatctaaaagtaataatcaaaatatttgatagatttatttactttactgtatgtaaagaaaatgtggtcagtcctcacggccacttagttactgatggttatttattatggaaaaaaaaactgcactttgctacttcttctatttatattatgtaatatctactccggttcaaatattttattgatctcttgctcattctttttcctcgtttcaggaactagtatccaactgaatattatcaacgctaataggcaagcagcaaatatgtatcctagtttgaaatcaattttggatacaatcattggtgttaaaagtgatattaagaaattgaacatccaattgataaatgtgcaaatagccattgatatggccctcgttcttagagggaacaattcggacactagtacaaatgtaactgggcccaatgttattgcaaaccaaaaaataaaacaacaagtcacgataattaaaacaatatttgagaagtccgtttctcttccaaatgtccccacagtagcatatgtcatcatataaaataataaatttgttgaaccatataataaacatgtcttgtggccccatttctccacgtaatatatgcctaatatcgtagaaaggaagttaacacttgacagtatgattgaagtaatataaggatccttaatcccgacacctttgaaaacagacgttccgtaataaaagaaataatttattccggacagctgttgaaatgccattatcatcataccaataatcagtctcaaccataactttggctttcccataataaattcaaatgtgtttcttttaactaagctttgcttttttgattcgttgttagtttcctcattattatagttattttccagcaaatcatcgatgaattcaattaccatgctatccgtcgcagggatgccattcatcctcgcaaaagagtatttagcagagggcacatcatttttgatttttgccaagtactgtggagattcaggaacgtaaacaagtgacattccaattataattgcccaaatgtatcccaagaacaatggcaattgccaggctatattttgtgtaggatctttataacatctttcgcatatgaaatttaaaatgtttcccattagtatgccaaatgttacaatcaattgatacgtagataccatggagcctctgatttttagtggagaattctcggagagaaacattggcaccaagacagtggttactcccacaccgattcccgttacggctcttcccaatgtcaaaaaataccaccttccataggagagaatttgaatggttataccgatgcagtacactactaaggcaaaccatataccacctttcctaccaatccaatcaccgatttttgacagagttaaagcccctacgccacaactgatgttaaaaatactgataattaggcctatttgcagatcagtaagtttcttagtagatacaaaaattgtttcatcgtcatggataatattagttgtgccaaatttttcttgaaagctaaccatatttgtcattccaccgatggttccaatgtcccatccaaaaataaagccaccaagcgagattaccaagcacaataaaacgggaatatgcagactcgcattgtgactaatctttgctgcttggccttctatattttcttctttatcatctagatacttaatggttacattataatcccttcccctgcctgcatcaagctcattattgtgaaaatgagagatgtatcccgagctatgttgatacggaatctgagcagtcatttctagcaataattgaagtactttacttcctaagaatacgttaacaaattctttgttagtatttctaattaaaagtggttaattgttctgttaaacagtattcaatgttgctatttgaatttgtgtcatcattagaattactgacatttttattttctatttttttttctattttttttcctcttcttttgagggccgacgtatcgatttgtcaagggaagtataattaaagaaagcactgatatacaggttgctgggtagatattaagaagctcaacatagacacgttatggacgggcataatcagaaccagtaccagaatcagaatcaaattcagcagtcacaacaaccacctctgaagaaatatgtgacacagagacgatcggtagacgtgagttctccgtatattaacctatattacaacagacgacatggattaccgaacctagtggtagagccagaaacttcatacacaatagatataatgccgcctaatgcctacagaggtcgagatcgagtcataaatttgcccagcaaatttacgcatttaagctcgaataaagtgaaacatgtgatacccgccatccaatggaccccagaaggcagaagacttgtagtagcaacttatagcggagaattttctctatggaacgcatcttcgtttacgtttgaaaccctcatgcaagcacatgattcggctgtgactacaatgaaatattctcacgacagtgattggatgattagtggggacgcagatggaatgattaagatatggcaaccaaactttagtatggttaaagaaattgatgctgcacacacggaaagtattagggatatggcattcagtagtaacgactcgaaatttgttacctgttcagatgataatatcttgaagatttggaacttcagcaatggcaaacaagaaagagtattatcggggcaccactgggacgtgaaaagttgtgattggcatcccgagatggggttaattgcctccgcatctaaggacaatttagtaaaactgtgggatccgcgttccggaaactgcatatcatcaattctgaagttcaaacatactgtcttgaagacgcgatttcaacccaccaagggaaatctattaatggcgatttcaaaagataaatcgtgtcgtgtgttcgacattagatacagtatgaaggaactaatgtgtgtaagagatgaaacggattatatgacactagaatggcacccaataaatgaatctatgttcactctggcgtgctatgacggctcgctaaagcattttgatcttttacaaaatctaaacgaacctattttgactattccatacgcccatgataagtgtatcacctcgttatcatataatccagtaggacatatatttgccacagcagctaaggatagaaccataagattttggactagagcgaggccaattgatcctaatgcatatgatgatccaacttataacaataagaagataaatggatggttttttggcatcaataacgacatcaatgctgtgagagagaagagtgaattcggtgcggccccgccaccaccagctacacttgaaccacatgcgttaccaaacatgaatggattcatcaacaagaaaccgcgtcaagaaatcccaggcatcgattcaaacatcaagagttccacattgccaggtttaagcatataaaagtgcgctttgacgagattttaggatacataaataaaaagactatataacatattatttgtgataatatctctcatttctggggaatgtaccccacaggcaccactgtttacttttgtcgctgatatcttcatagaatttttctttattctttggggtattcttctcggtgtaatattcaatgaaaaataaatatcgccagtttctatcatgttcgtccaaatggaatggtctagagtttatagaacacatgttgagtgaatggatttttagtatgttcaaaacatctaccaaagaaccagggtcatcttgacgagtagtaaaggtgagtaggttaacccgtagtaatccagtgtcttctacttcattgtcgcctgcgttctcccttctcttcaatactaaaaatcttgttgtatttcctagcttatcatttatcgaatgttcaatgatgtacgccttatgcaattgggcagctgtttcactagcaatggctaaatgcagaatgttgtcgcaatcggccgttgatgaccgaatgcattggttcactgattcagatgtggaagaacaatccaatcttataaaggtgacctgcggaaatttttctgccatggaccttaagtaacattcaacctggccccatacttgcggatgtgagtgtattatgacttcttcaaaatttccaagggatgcaataccatttggtagttggattgggctgattagacaatgggtaatgggtacatattgctccgctataacttctatatctggtgtaattctattagtatctgctggagcaggtaaggatagggcttttttgatcatcctatcacgcaagagatcataggaaaaaactacttgtccattggtggaattttccaacggtaccactgaataatctatactagtgtcgttctccaattggttaaaacattgggggatagaggctgctgggaggtactcaacatcagatgttgattgaaattgttgtaatgcagcttgatgggaatacgtacctttgggacccagaaaaagaaccctcaaagtcttgctggccataattgaaggatgaatgcggaaatataatgaagttgcttttcgtacttttttagcctgttctttctgcgtattatattcatctactaaaatttttattttcatttttcattatgaaaatacaagagtcatgctgataactgtgtaaagaaactgtacgcttgtcgcagatgatgtagtacgtattttatttacaggtgtcattaatatatatatatatatatatatacgtatacggaagtaattcttcgttaattttccatggactgtgatagcgaaatcaatttctcgacggtgaatcccggagaggccttagagaaatctcttaacaactgcactctctgtttagcaactggagtttcttcacccattgcaccataaaacctttgcacgtttagcaataacagctgtgcatcctgtacattcacgtttgtatccggttcaacatggccattcataaaaacaattcccttatccttgaccaaatcagaatggaactgcaaggtagtatgtggccttgcaaattcctggtgtagtttgtattctgctagggaagtcatcatacaatgtgttgtttggggtccgacaaactgccattggatgtagtgtagttccattccctgttcttcgttcggttttgcatcctcagattgaacttgtctaggaagtggcaacacgaatatagggttattcctggcatttgccatcatcttatcataaacggagacaggaatcacagcgcataatgtattatctttttgtgcccatcttgctctccaaagaaactctacttcctgtttcgataagtccttcagttttccaacatccaaaaaagagtccaatgttttgaagggaactttaggagcacttggatcgagaggacttcttgatttcgtcatcaaatgcttggagttgttattttccatttgagttttttgttggtaatcctctagttctttcagggggtcgattttattaaattcccgcttcttagactctatagtctctttcaaatgatttttcaactcttctatgctgttaaaaccttgtttttgagcctcttccaaaagtttctttctatacttctgctctgggctggaagaataaaaacgaaaaacaggaactgttccaattgccttgttaaaaatgggcgacagctgattagaaatatggattctagtgccgatttttctggttagtctccacatagttattcttaaatctcttttgttctctattttcaagtcttgataagttcttcacatccttcgattacggcgtcaaaataagcgttatttccattcgggtgagttgaaccattgataacaacatggtttaacgatactttgaaaggtttaggcggagccaaccataatggatgaatcggtggatcctgtggagctgcttctacgactactgatacggcacaaacctcatctgaaaccatatgcctacagacaagatagctggcaaagggtgctcgatgagtacaacagacagactgggtcaagatatagacaatcaaggacgttaaaaaccaaatttcgtcgactgaaggacctcttcagcgcagatcgagcccaattctctccttcccagttgaagctgatgggagcactcttggacgaagcaccagaacatccaagaccaagaactaaattcggaaatgaatcatcttcatccttatcatcatcttctttcattaaaagtcatccggggcctgatccgtttcaacaattatcatccgctgaacatccgaataaccacagctccgacgatgagcattcaggctcacaaccgctgcccctggattcaataacgattggaattccgcctactcttcacacaatccccatgattctgtctaaggataacgacgtcgggaaagtcatcaaaagccctaagataaacaagggtacaaataggttcagcgagacagtactgcctccacaaatggctgctgagcaatcgtggtcggactctaatatggaattggaaatatgtctagattatcttcacaacgaactcgaggtgataaagaaaaggcaagaagattttgagtgtaaagttttaaacaagctcaacataattgaggctctcctttcacagatgagaccacccagccaaggagataaaatataaaaacttctattagatatgcttgattcatgtccatatgtatctatttatacaaacattacgtaatatacacagattatacatgaaaggtgctcttcatatttggcttcttgcttccactagcctatcccaaccaggagagtcatcccatctgcctttgcctttactcattagagctttgatagtagatctacatttgtatttccagtctttgcaaaccagactgcctggcccatatttaccttccatttcaccaagtgattcataggcagccaccaaatcttcacaagcatccactgtatcattccaaaccttttcttcaacttctaaatcaggattgtgagaaatggccctataagccttctcgtggcattctagggcggcccatggtctcttcctccaaagttctactcttgcgaccagtcgccaacatcttgcactggttgtaattacctgaggtaaagtgttacagataaactcagtacagctcttttgaaaataagataattgctgcggctcctctggatattcactagtcactaatagttctactagtttttcaataattggtaagtcgatggaaccttcgccagatttgtccctcctaatactgactaattgtttacatgcagttaagacatcctcccactcattcaacttaacagcaacaagcatgtaattctcccaaattttccagttcttttgagcgtcacatgaaatggctcttttcaaacaactataagcttctttcaatttatccattttcgtatatgcagcgctcaaatttgaccatgaaagagcatgataagggtctaatgaaacacatctggtaaatgcctccgcagctatctgcattttaccacattgtaatccaacgcaaccataaaaataccacgtttcaaagcttaatgggtattgccttaacgagtcatttaaatgtttcaaggtagcagagtaatttggttgtgctccagactttggaggaggattaaagtaatactttgcaagggaattttttgcgttgacgtattttccaatctcccaacttttttcccatagggatggatcctgttttatatcacccaaaatggagtaagccctggcatccgaatcattttcatttattctttgaagaaggatttcttctgcctttttttcatctccaacagcggcataacataatgcagtctcgcatgccataccaagtctttcataaatttccacagcggacttcaaaatacccagcgacatatatttttcagctaaggtggcatccaattgccacctagggatgaacggcagctggtggatgtatgacagcctgctagcaacattgatttcgcttgaacttggaaccaatttactcttaatcttcaaatccaattcttctacgagggattgcatttgtaaaagtcctctttcaatagttttagcctttgttgtctcaataattgacctttcccataatgatcgggcgaaaatagaccaatttttgtcaccgttttgatataatattctagaaagcaaagcagtaagttcttcttccacaagaggatccttggccggagttgtgttctttatggtgtaaagacgtaacagcaactggatgttgtcgtaatcagatagggtaggttgatcgttagggttcaaatccagcaacaactttggaatattttcttgacgtagtgccaatggcaatagtttatcttcttcataaccttcatttaggtctaccttttgtcttttactataaatttgctcgtctagaggttcatcagcaatggactcaaaatgaggcttctccaataatagatcggactctaaagcaaatgtttctggtgtagcagatgtcgttctcaaagcaaaattttgaaatgtgaaggatttggcaagaatgatcaaaccggcatgagccttttgctgatatttagttctagtagcgcgtgcacccgtcattacaaattcaaaatttgttatctttttcgctctggtcaaggatggcaggcacaaatgttctgtgttgatggccaatgaacatttgacattctctagatagtacattgcacaaagttctcttttgaaatcttcgtgaatactctccggtaattccttagttatcgcatatgcaaggtcagcagactgatatattgcagatgcaacactagcttggaacccagaaggttctggaatcagtgacaattgcgtcaaaagagctcttgcccaccaccaataagctacagctaataatccaggagtagactcagcagagataataggtagcggaatttcttgatccggggtaacatcaaataagcttttttggccggttatcctttcaagtaataatagtgataaaaccaaatacaatggatcatccataaattcgtaggcaggctggcccataatggctaatgagcgggaaagggctgtattaactgctcctatttcaattccagttttgccaaacaaacctgagattgctttcaacctagctgctgggccggtgtagttattttgaataaaggtctgtaagagggcaatagccaaaaatagcatctcattttcttggcccattttgaaaacctcaacgttaagaaagtcatttagagcagcaataacactagatgtggatatttctcccgaaatactaatttttcccttaaatttgtccacaaattgctgtactagctggtatgattcaccactgatgatatgttcagcctttttcacatatgtctggtcgaaagaaccacttttcagagattctacttctgcagacagcaataattttgcatgcaataacgtctccataattttgcaaccactagtttactttttgcctggtctgatagcttctttttagcaattcctttggcctcgatgagcttccattttcaattttcatcttttttttcacgatgcgaagtttcttagataattatcgccatatacgaaacgcgttaggaaacgcgttctttcctttataataagcaatattatatcaacttaaggtggaagtaatgtggcaaaatcgatagcgactatctagaacaggctagtttaagcatatacataatggcaagtatgtattagtgctaggaattggaggatttgctcttttctgcatcattttttttatttttattggcgaatgttaaaattactaacaatggatgggattccaatacagcctatcaaccatataacgaatattcatcagtaacgggcggtggctttgagaactctgagtcccgcccaggtagtggggagtcggaaactaacactagagttaacaccttgacacctgtgacgatcaaacaaattctagagtccaaacaggatattcaggacggccccttcgtttcgcataaccaagaacttcatcacgtttgttttgtaggtgtggtgagaaacattacagaccatactgcaaatatttttttaactattgaggatggaactggtcaaatagaagtgagaaaatggagcgaagatgcaaatgacttggctgccggtaacgatgactcttctggtaaaggttatggttcgcaagtcgcccaacaatttgaaattggcggttacgtaaaagtttttggtgctttgaaagagtttggtggtaagaaaaatatacagtatgcggtgattaagcccatagattcattcaatgaagtgttgacgcatcacttggaagtcatcaaatgtcattccatagccagtggaatgatgaaacaacctttggagagtgcatccaacaacaatgggcaatcattatttgtcaaggatgataacgatacatcttccggctccagtccgttacaaagaattctagaattttgtaagaagcaatgtgagggcaaagacgctaattcattcgctgttcccattccattgatctcgcaatccttgaatttggatgaaactaccgtcagaaactgctgtacgaccttgactgaccagggttttatctacccaacttttgatgacaataacttctttgccctatgaaaatatatagattatttttttagcatttcttagtattcgtttgtgtatttctactaggtaagtaccaaaatttgccggaaatagagtggaaaatggaacccgttccaagaaggggtaagatgcatgaatattaagttggttgcataaatatgctatataaagtccactacaaaaagtcatttatttttgcccgtaagaataaagaacgaatccgtccttatctctgacttcaatgggaacatttacacgcagtacgggcttcaataatagttcccagtcgtatctggttctaggtgtacataatgaaaaatgtctcagcattcttattttgacagctttgaattttgacaaatttctcaggaaacaccagaggttaatatttggaatatctttaaaattctctggatcttggaaatcattgaaaaaattttccaatgtcacattttgtaagaactcctccacatctaaatctctatattcgatggttcggttcttcaatttgattaaactatctcttaggcaacgccttacagagttgttccaatagtaagtgtggtgaatgtctgattcagggctcattactgtacttaaatttggaactgcattagcatttggtatgttatctcttatggaattattttcgtaaccgattaatgtttcttgatcgttctcgtcgccaacatcctcatctgtctcatcaacactagtaattgttcttgctagatgttcccaaaacgatagaggggataaaggatacacattggtaaaggggatattgattacgttaatagaaatatttttacttggaagtctctcccaaagtaagcggtaataatggtagaaagaatgaaattcagggattctttgtcgttgaaaattttgtagctgtgccgcagttaacatggcgggctttttgttattgtctggtgatgggttatttgaaacatcatttcctgtagttctagaaatatagttcagatttaaggacaatacaactgaagatgtcggcggaggagtaattatcttcgaatctgatggcgcttcaaataatgtttctgtcatggaattgcagtcatcaaaatcatcttctgtatccaaacttcgctgttggaaataatatgattcgccgactacctgttcgttagtgaaacatttgctattacaatcaattgttagattggataacgatgggaaacaactgcataacaataagtcgaatttactgttaatcttcagtaaggatagatgtttgaccattttaaagtaagagtgaaacaaacgtaatattccatttccaggaactacatcacatgaatctaaagtaagtgcagtgataggagactgtaaactgtacagttcattatcttcgttctttagaaatagtggtaagaattccattggagtatctagcgattcggtgtctatcgttacattttctagtttaagttcattaattatgccgaaacagcagaataaactcggtcttagtacgagcttttggtgatggcgttgacgattaaaggttctttgtcttttattattagctttgatttccagtattttcaaccttggcagagaataatacttggattcgtattctttgacaaattttttggatagttggaaagtcctcaaatcttcgtttgtgatggattgctggcccttgattattttcttgaaaaaatctctagatccatcgttgaatacagagtaccataaaggaattttaaaattcggttccacatcactcagaatcactctggtcaggttcggtagatagtctataatatcaagcattagctcaatataagtataatggaagtagttgctttccaatttatcaagcagtttgattcgttctgaagttatgatgggagtctcatcgtttagtctgatgttattcagtttttttacgtctttatcatacgaatcgagtttataagatccagcaataatagaatcttggccactcttattatagaacttactgtattttaacaacgagtcttgggactgaggatttttgaattcgatggatcttacgaggaaccttgcattttgtgatctagattgtgtgctacaatcaccgctgtgtgtgacaatgttcgacgtgtggaactcggagtgtatcaaagcattgaactttaacaacgaaagttttgagtccaaaataacgttttggaaaaggaactcattcgtaatcaaattgtagaacctcgaattgacttggcatagtgttactaatgtattgaagtccaaagttcgcagtattaacagtagaacttttgttggcaaacacatgagggacgatttatcgttgaagcgtagtgatctcgatttgatatcatggctcgtactatgtagaaggcttttggcatcagcacagccctcttcctcttcttcttcctccttcgcagcactggagaccagcgagaaatattttgatctaccaaacaattgcaaccgtttcatgattcggttggtttgaacgtttgaaaatgcggttcaacttttcatatctagcagtggctcatctttatgtactctagtcctaaatcttctgctggttatcgcaaaaaaatatgtgatgtgcgggtttttggcagtaatcatgactcagtctctggaaaaacgtgctatttaacggttatatatctatctatgtacatgcctgtgcatgagctcttcattcatttctgggaagggtgagggagctgggatgcattttctgagttgttcttggcatattttcccaggacgtcctttagcgaatctgggatgtcttcaaactccaagtcgcccacgtcttggctaacttgttctccgttagctttcattaactgttccacggtaacatgatgatcatggaatattttcagatggtctgctatcaaatgtctcactttgcagtgcggacaagagatcaagacagtacctttctcgtacgcctgcttggacattgtgtgtgaagatcgggtgttacatttcttgcaggtgaaagctatcatcatcttaggcttgtctaccttaaaagaccccaaatgaaccttcttatcgtcctttttcacttcattatgtgcgatgatattggtatgcaacgctgctgcgggtagagtacggcacacgttgtagcgtacgcgaggcgcccaacatctggcaaagtacctggtaattggtattttactttgcagtagtgttctagtcctcggaatcatgttcagtctcttgatattccagttgcaccggtgctgctttagtatcgctgatcccttgaagccaacatgacgctctttcacctttcctctcataattttgatatcacgcgaaaatgcaagaaaaaaaaattacaattatgaagtgcagaaggaaccaaaaatatcatcgaaagaaggagtacgtagagcgttactattttcaatcagtgttcccattgtgcatacaagaaatgtctcaaccccagatgtcccctgaaaaagagcaagaattggcctccaagattttgcatagagctgagttggctcagatgacgcgtcaattaaagcttggtttaagtaatgtcccatcaacaaaacgaaaacaggactctacaacaaagaaaagaagcggagaggatgccgaagatgttgatgaggaccacaaaactcttttggaagccatatcgcctgcgaaaaagcctctccacgatgatacaaataaaatgactgttatatcgcccgtaaaatttgtagagaagccaaatactcccccaagttcacgccaacgaaaagccgaagaccgctcacagcagatcaagcctaggaaggaggacactccatctactccgagggcttctgctacacctataatcttaccacacgcttcgtcacactaccagcgcccccatgataagaatttcatgacgccaaaacgtaataataacaacagcagtaaccatagcaataacaataataatatcaagaagaaggcagcaggctctaaggatgctccacaggacagcgacaacactgcgggcgctgatctcttaatgtatttagccacaagtccatataataagtcatcacatcatggaacaccgatggccgtaaggatgcccactactccacgctcttatcattacgcgtcgcaattgagtttgaacggtaatacagcaagcacatcaaacgatgcagtaagattctctcatatcaaaccttcagcgtcttctccgcagtccactttcaaatctaatctgttaccgaattttccggacgaatctctcatggattctccatcactatacttgagcaataataacggtagtgtccaggcgacactatcgccacagcagagaagaaagcccaccacaaacacattgcatccacctagtaacgtacctaccacgccttcaagagaattgaacggtaccaattttaacttactcaggacgcccaacttcaacatgggagactatctgcataatcttttcagcccttcaccaagggtccccgcccagcagggagcgtcaaacacgtcagcttcaattccttctgttccagcgatggtgcccggatcatcttccaacacttctgcgatagcaacagctgctatatcaagccacaccacaaacaattttctagatatgaacgcaaacgggatcccgctcattgtaggacccggcaccgaccgtataggcgaaggggagtccattgatgacaaactcactgattgatcgttgacggccatatcagttgatgattccatacttcctgaaatggaccactcaaagggacaaaaatgacaaatgttgaaattataaaattacatattaatacgtaaaatgacattcttttttagggaaattcggagatagattatcactatgtaagcttatgtatcgtaatatacagggccgatatttcacctagtttactttttctggtggcctttatgtttatgactgtgccccctcttgtgtttgcttttagaggctttctctacaggtatcagtatggtgtcctcatccttctcccctgcctctgcttcgactggagctaacccattttcgttcttaaaagttttcttcctccactctcttaatcttcttgccttcatcactttccttttatccttcgctcttagttccttggaacgataaggtgcaaatttcttcaaaccaataaattcatttaaatcagtatcatcggcggcgaaaatctctcttgcggtcaaaccgaaactctcaggagaaacttcacggtaacgaaacttcaaatcttgctcctcttttgtacggcttctactctttctttcttcttcttctttttcaacctcctctattagtgctagtttgttttgttccaaagcattttccactaattcatttacctttctcttttctttcttcttttgcagtttctcttctttcttgctcttctttctttttggaccttcttcctcgtcttcttctttttgttctttttccacttcaccttcttctgtttggtcatcaccatcggcgtctgcataaaagtcacccattatttcgtcatcctcgttccaggtaggctttccctcttgttgataaaattcttcattaaataattcagctaccacgttatcccactcttcttctttgaaatcgttcttcaatagggtgtcagtgatttttttcaccatgtcggcattaatttcagcaccatattcctttgttagttgctctaaaatgtcagtcaatttattcaattttttagtcttctttttctgaagagctgtctccttctctgcttttatttgctctttaatttttcttttttcctctctttttcttctgcgtgaagagtcatcggatcttcttagtgtagcttgactacgtgcataagatataatttcagctgcgtttgggtcctcgtacctaaaattgtaggcattctcaaatttttctgcagcatcttcaaattcttcatcgtcctcttcattattgttgaggtcaagagaaatcaccttgtcccccttcttaggaatccaggcctgttgattcacaaattcttccaagaaattttcttcatttacggttggatccggtaaattttttccttccttcttcgtagaaggttcctttttcttcaaaaacccatcgtcttcatctccgctagactcttcattttcttcatcgctaaaggcactcttgatttcatttaaaagctgagttttctcttcacgttgttgcgagacgaaagattgctttccgtcaacagttgcatgttcgtattcttcgtcatcctcctttaaggcatcaccagaaagtatgttcatacggtgataatcttttaggtaaataggtttatgcttcccctcacgattggccagtttggcagcagcagattcgggatcctcgaagaatttgactttaggatctagtagtttgtccgtcttattgtttttgatggcatctagcacttgattaataccgttttccacttcatcagtaatcaattcaccgtaatcatcttcctcctcttcttcctcttcgtcttcttcctcatcttcactaggaacgtacgatttgcttgcttcgattgcaggcttaactgtcgtcgcagaggtttcagaagtttttatggtagcagtatccgttgcaggtacggccgcttctttttttgcttgttctctagctcttttagcggcagacttttttcttggcattgaatttagggtatatcacactgttgttgaaaactatgagcattttgctttctgaagaaatggttctgttaactagatgagatgagattgatatatttgaaaaattttaaccgatgaccttgcggctcctccgggtaatacttttttctcacataaatatcaaaaaataacgacggtatttcaataatacttttatataagtaatgataacatgcgaggcaatttattacaagccacgtaggcctaattaaaattataaactaacactaaagtaataataatatttcagattaataaaagaacaggaaataggaaagagataaaaaaaaaattaggaacataaaataaaaaataaagaagaaattgaaggagtgactggataaaagaagtgtatgataatatcaaatggaaatttgaatatattttattccaaaaaattttttttcttttccaagtgaaatataaacagcggatcaaaggtgaaaaaaatcatagtattttgttcattaaattttccgaggggaaagagaacaaattaatagaaaattattattcagcaactttcgtaggtttaattttatcagcaaattcacccagaatttgtaactcaaaatcattaaaatcaaacaaatttggtagcttgattggttcagtgaaacctcttggtaagaaagtgtcatcattccttaattcattaaagaactgatgggcaaggattcttcttggagacagtctttgttgtggttcgtagaccaatattttcatcaaaagatcgataccatctggaccggaatggccaaaatacttctcaaacctctgttgcgaagagcccgagaacagtggtttggaaaatagagggccatcgtaggccggattcgaaaagaaaatgaatcttttatcgggaggacctaacaatttagcaatttcccttagctgtagaaggggttcttgaccttgaaatatggctttgccgataagcatctcgcccatgacacaaccaagcccccatatatcgatctgggtggtatattgggtacaaccaatgatcaattcaggcgctctataaaatcttgaacagatgtaactaattgaaggctggttatgttccaattttttggcagacccaaaatcgcagattttcaagacaccggtttccgggtctacaagaacattggatggtttgatatcacgatgacaaacgccaagaccgtgtaaataaagcatcccgcgggcaatctgataagtgtatagcctgatatgttttaatggcatttctagcttgtttgtcacataacgattaatctcgatttgtagagtttctggtaagcattccatggcaaggtgttgataaactttattatcttgcggggacaaatgagtaaagaaatactgcaatttaacgatatttggatggtcggcaatcctcagaatctgtaattccctggacttgtactcggtatgagcagggacttttttaattgcaaaggggcccaaccagtttttcttatcctgggttaaatatgcttgtacaacagtcccaaaggcacctctaccgattttcctgtactctttcaccagcatccgcctcgtgttgttcgatttattcgaggttacatcgtctgcaatgaattcagatcccctttgcagaggaacaccattctgctcttccgtagacatatgtactagaatgtgatggagtgggggtttcggaaaataaaaagaaaattgaaagatgaagcaaagaactctgtagtcttgggcttaactcctatcaataaacacgttacgggcctgcccacactactaacacgacacaatggcactcacttgcgaaatctatgtcgttttcccttggaggttacgcctgccctcttccgcatatgaaggtcgcttttttcagtgttgtttgtgggtcactgaactgtcattacatacgaactgagtggaagcaagaatgctgctttcgaaagccactacagctacgtgtgatcatataattcctgcataatatggctgcatgctttttaatgatagcttcaattatgatgataatcactgagctactagtattccattattcagcctaagattggaactttctatagcagcggagagtgtttgtttcgtacttcgtgactgtttggcataataacgatgaattgggaaagagggaagacaaaatgagagtaaatcaggtggaaagcagtggttcttctgaaaagaaaaagtgacagtgtgaactgttatagttacgtgtgatgctgttacaacctgtttggaaaggctgccgatggacgcagtttgtcaggcctatcagaagatggaattctaccggcacgaatagaggagttcctttttcatttaaggatatttcaaatcaggaggatatcacgaatatctcgtatccttcgtcctctgactcagttttgacaaagtcaaatggtagtagtgaggtttacaagcccaaagaggaagtagttaagtacattctacatggcaagtttactaaaaataacacgcatttgacattttcaagcgttgtggaggacaagaactttcataagaataagggacttacgtataatgatacaatgctgtactatttgaacttaccccagaaagtgaagatttcgctatctacaggttgtttagggtttaggaaggcagcaagaggggagtatgaagctgcatttcaaaccagtggtagaatgtttgaattgattaaggaaaagaacatgctgaacaaagatatcgaagtggtgatggacgactttgggaagggcagagctgcttttatttccgctcttgttggtaaggaaggggccagtgtggtgaaaaaggttgtgaagatcagcgatgccaccaaattgaagtttggtggtgtaagatcaccaaagatgagaagactatgatcagctcccactatgtatgaattataaactatgtaaaagaagaagaaatatatatatattcgtgtaaataattcgatttttccctttttttaattgtcgtcgttagagttggccaaaatccttaaaatagacaaaaacaaattgacgatgtccaggtaaagcatcatggcgcatctaacttcttcatcaggatacactttcctaaaaatcagttgcgtatcgatgaaaagatacgcggtaaataaaatggcaccaagccagccgtaaagcagattaaacttggaagagtgggtattccagccgaaaagcaaggccgtgagacccattccgatcataatccatagaccccagtttaaccaatagtatattgacgttgcggaattcagcacgttctcgaatctctctgatagtgcggtcaaggaaacgccgactacgacgatggtggtgatcagcagagccgaaagtactgtatccttatcgtacgctaaggttaccagcgacagacagtaagcctcggaaagagtgaaaatggagagcagcgtgagcttttgcttgtacgaggacaagacgtaccaaggcagacgcctttgctcttgtgccggctcttcgctgctgcccgtgagcaacggttcgggaacactggcctcgtagtcttcgggacgaggacttactgccagccaaatgcacgatactagcgataccaccatgcagatgtagaagagggcgatatgcgacatgataaagttctgcaaagaagtggaaacgctagcccagtagcagaacgacaaactggccagtaactggcatgacagcagagagtaaaccttgtgcataaaccgctggcgaatgatgggttcgcacgagataaccaccgtggaatatttaaagtcttccgggatgaaagcgtttccatcctggctgctcgcaggctggccgtaaagatgtgagctttgctcttcgtaaggaggtggaggacctgacatattaacttgattctatatccttttatttgctgttgctcttgaaatattgtcaagagtaagatgagtgttatagctgattcttttctttatcccggaaagatccttattatagcctcaaaaggggagcggccgggtaccctggttgcgttgccgccccaatctgccataggcccacccataagagtttagaaatgaattattcctgggccaatgctgcgatcacgaaaattatcaacatcttgataaattaatagcaagttggactaacttacaggttttctcgtgagggaagtggaagagaaagaagaaaggagcgtatgcaactgcccttggcagccgcccatcgtcactcatggccgttacgcgccgcggccgaaacacgccaaatgctatgtacataacggaaatgctaatacgtaacaatataataatataaagctttcataagtcttggcactggcacttgcatcagcatctcgtatattagatacatcatcaagtccatatgtcccagagaaagcgatactcattgaacgtcgtcacgtccccgtcgataccgtcaccgacacccagtgcaccgatacggactaacgaatccaattgggaagctgttcgccagcgagtgctgcatcttcatttctcccgaatgttcatcatggtggcacggttttgaatcctgggttgggcataatgaggtcaccttcgttgaacaagtctggtgcgtttggccggtccggcagcagtggttccagtacagtaatagaaccgtccaacataaagttgctgctaattggagatgcaaacgtagggaagacagctatgattttgagctattgccgggaactgttgacacgagcggaaatgtcacgatcggcgcgactgaggcaccagcagcagcaacagcataaagacttaggattgaagaaaactgtggtgaaccatagattaagcatgaaagagaaaagaaaacggtacagctctaacgattttgaaaaggagttcaaagatattaatcattttgcagacgaaacaagcgatttcggaaacccgaacatcggtgatgataacaaccacgaaatggcggatcctaatgagattgtcatcgaaaccagaagtactatcggaatagacatcaagacgaacttggtcaacatagataaccggttttttaatgtcatactgtgggacactgcgggacaagaacggtaccaaaacgcaatcattccatcactgtacaagaagactaatgcggtgatattaacttacgatataacaaatgcgaagtccttccaaagctgtatggagcggtggatagttcaggcgttggaaaacttttcttcccaggatttgttaaaagcaagattttttctggtgggtaacaagattgacctttataaggaaaggcaggtaacccattatgatgtggtgcaaatggttcaggaaatgcaactgaaacatggtattaaaatttcgggaaactttgaagtaagctgtaaatgggtcaacgtggtggagagaaccatgaatatgataatactagacctggttgagaacggatgtttcgaaaacaatgatccttgtgtgtcgattacaacatctgacgacgtccagggacatgagcaagaattccacgatacagtagaagagcctttcaatttcactcggcaacgtcaacaccaacttgaaaaaaataacacagtggatattacaaaacctaatgacgacattgcaaataatcaatcaatttgttgcgtttagtcttcgacaaattatacaacaagattcgcaggcagccattgtccaatacgccaatgtcattatatgtaccaatatagacgcattatacaatcctacaatttatatcattgtaaaattatttactaccacttattcttcaatggtgtttttaatgttttgtagaggaaaacttaaaagttgtcatttttattcagatcgcaatccatggtttgacacattctatcttaaaaaaacaaaatctatttattttggtttcggctatattgatgatgatgaatgtacatataaaatggcaaaatttaaataaataaattatttaaaatcaattttgtttgagttaaacgataatactatagtataatgataatattaataaaaatcttagctttttatttttaacaactcgcttattcgtcttcttccaaagtttgagcggcaatacgatccaaatctctttgaccgttttcagagattcttctaccaccctttggagagatttcgacaataccgattttttccaaagcttgcaagacctttctgttgatagaaccggaagcatcaatgtgcttgtatggtctgacacctctgctcttggcaccaccgtacaatttgttcaacttaccaacaccgacttgctttctcatgtaaatgtgtctagcaacggaggcagcacgcttgtagaaccaaccttcagcgtcttgtggtggcatttcattaccagaagaggtcttgacaatgtcaacgtaacctgggacttctaatttaccttgtctttgcaagaaagaagcgtaagcattgatgaaatcttgagctgcaacgtctctaattgaaaaaatgcacaattgaaatgcttttgttagtaaaaagttttctcgtaaaaatagaatatggaatgctcagtgaaatgtttattgagacaacttcttggtgcggcagtatcgtggtctcgggttgttgcttaaattaacggcataaaaatcgcttttcattgcttttgcattaccacggttacagatttccttccaacttaaacgtcttggttcaggttctcctatttcattagaaaacatcccacctagttaaaacctcctatcaatcaattccaataaataaatgattacctcttcgtctgagaacttcattttgtatagttggctcaaaatattctctccacaattacagcaattatatcataatagtttaactcattcgttcggtaaatgcacagtaaagatgaacttcaatttatcaggtaatgggaaattctgcactaaatcctttttctcaatcccatatgttttcatctcgttgttttccacctaatatccattcattctctaaatactcattcaatgagtgaaagttatacgtacctaacggaaacacctgccatctttattatctttggttctatacctttgttgtcaatattcacaaaaatcccactttaaaatttcattagtccattttaacgattgtatcttcactaatgttcgcttattgaaatgggcacaccaaccgcgttacgggtggctcccagggagccgtaaactggagatctcaatacagtagaaagaacagcaatgtgcaaaacctcaccaaacaccagggcttgtcactagagctccgtcctgctgggctcaaacgcgcctaatttattcagggagaacggacggacgtagacgcgatttttttgtcaaagcacaaaaagctgacatcaggaagaaaatcaatagtgcaccaaaggtatatggtgtgggttgctaaaatgttcggatgtaaagtagtattgaaaaaaaatgggaaaagtgtgtgaatgatagtttgtaggtttatgcatagggcggaatagctgacttgatactgaactgataggtttagattatgaagttattatacatgtatatattgtagtcagtcatatggtatggaaaaatccctctttcccaacctaatatacactgaaacaaggaaaaaggaacaaagaagaaaaattgtaaggtttcaaaccatactagattacaccttgaaacccttagatcttcttctacctctagctctttcgaactttctaccggtggacaagattcttggagccttacccttgtgtggacccataccgaagtgtctgaccgcttctctggagtttcttggacctctcaagatcaaagtgttttgacccttaggagctctgacagctaattgatctaaagtgatacattcaccgccagccttaacgatcttggctctggcaccagcagtgaatctcaaagcagcaacagtggtctttgggaattcgaagatcctggcatcgtcagtaacggtaccaacaacgacaacagtcttgttggcagcaccttcttgcttcaaagctctagcaattctggagactgaaacaggtggtctgttgatcttagacaagaacaaagccttcaaaacaaccttgttgaatggagcatcagtacgacctgtgattaagacaagaaaaacaaaagtttttacgttatgttagtaaagggataaaggatttgttggtattctcgataggcagcttttaatttcttccattaattgaagccaaaaagagtgcaaaacgaaaaagtaccaatttgtttttctctttgaagaaaaaagattctgctcagttaatagttggtccgcacttgaaggtcgtattgtacttcctttagtactcgcagaatttccagaaaactaccgctttctgttctagtggaaatctttaacacaaaagagaacaaattccacttttgtctaagagatccgtcgcacgcaacgatactaagactgaagccattagaagatcgccgggactagaagttaataatatcacagaatccttttatcctgaagaaaattgggagggagatttcaatacatacgagctaggaaagtgtatagtttgaccaataatttcaaatagacgttatcggattttggagcggttctatgaccggatcttttgtgttgcttggaagtgtgatcaatacccattttgttttttgttttcttctaattgattttttctttctatttcctttggtgaaacaggtagttttgttcaaaagaaatcattcaatggtttaaataaaagcaagaagtatgaaaatttttttattttttcttcagaattttatcatagttgtcgtaaaataacgaggtcgggtaacgtgtttggtgtactgaggtcttttttaaaagaagctccagcaagaaagagttttgtgtgatggctaatgaagtgtcaattgcatttggaaagcagcctgatttcttgggcgtgaatatgaaattcttcttttgttattttataatatgaagtatgaatgaaaacataaagcgcgctgagacaacgactgttcaatgtaaaataaagaaaatctatcgttctcaagacgtggtcccatttttttttactttgaatttcgtcagcagtgtgacatggttagaatgtaaccccacatttgcaaagagattgttacaggagcgttctaattgtcccgtactggtacattcataagtgaaaagaaagccatatcgggcgcgctggtttgtgagccacagaaaccggacaaggcacttcttgaatacttcccaaggaaagcgccaaggtttacggttctgatgggaatgcaggggggaatctagtcttgaagtatccttattccttaaaaaaaatattggacatcctcttcgaaattaacaacgacgccaaaaacttgtctatgttttcaaaaccgcgcgtcacgaaaaagcaggaagcacaaagaagtgacgcgaaaatgacggtatatatagccattagcagtcgccaaaaggtgaagatcctgacacgaaatgtagcagagtcactacattgatactgatcttgtacttccgaataaggcaccgccagatcaattctgtctgattttggcgtcttctggtatagtcttgtaatgaacggtggtgattctcgaggaaaataaaattcgtgataaatacatgcatgtgtatatataaggcgctatatatggccttgaaactttgttattacgcctactccatctttattggtacatatatcatttaaaagagtagtccatagaaaaccaactgcattccttccttatccctgccttcggctaattttaaaccaactttttaccttcctttaatatcaatatcaaaatacaatgaaattctctactctctccaccgttgctgccattgccgcatttgcttccgcagattccacctctgatggtgtcacttacgtagatgttaccaccaccccacaaagtactacatctatggtctccaccgtgaaaactacttccactccatacactacaagtaccattgccactctatccactaaatctatcagtagccaagctaacaccaccacccatgagatcagcacatacgtcggcgctgccgttaaaggctccgttgcgggtatgggtgccatcatgggtgctgctgcctttgctttgttataagttgcatggacaacttaaactaggaaggatattccgcttcatttcattaatttcacatttttttatctacatgatatgtattttccctcagttaccagattcgctagcttcgaagcaaggactccttggtcatacttaataaaggaacgtctgcttcattctcctaaagttcctttcgataaggacgcagaaggcaccttactagaccattgtataaactcataactacatactaattcaacgatatgttacatttattttcttgtggttaccccccgcaaatttccaggcatctcatctcatcgcagttaaaaaaaaaaaagttgtaaaaaggtaataaagcgatacttgatgaaagcaaacatctgtaataacagttcacaaggttaagctggttcgtttcactagcgtatcattttttatttttcaaataaacaaacgagggcggagtttattgggtcgtcatgacaaggctcaaagcaaaatattcacctacaaaaggtaaaagaaaagaagataaacatacaaaacgtatgcgtaaatcatccttcacaagaacgcaaaaaatgcttgaagtatttaacgataatcgctcgcattttaacaagtacgagagcctcgctatcgacgttgaagacgatgacactttcggaaacctagtcttaatggaaaatgataaaagtgatgtcgacatacctgtaatagaagaagtcacatcaagtgaagatgaacaaagggcagaatctagcaaaagaaacaattctctcgaagataatcaagattttattgctttttcggacagctctgaagatgaaacagaacaaataaaggaagatgatgatgaaagaagcagttttctgttgaccgatgaacatgaagtttctaagcttacttcacagcaatctctgaacactgaaagcgcttgcaatgtggagtatccttggataagaaatcattgtcattcgaaacaaaggagaatagcagattggctaacttcagaaatcaaagatttcgttcattatatctctccaagcaagaacgaaatcaagtgcagaaatagaacgatcgataaactacgccgggcggtcaaggaactgtggtcggatgcagatttgcatgtgtttggttcttttgccaccgatttatatttgccgggttctgacattgactgtgtcgtaaacagccggaatcgcgataaagaggacagaaattacatttatgaattggcgagacatttgaaaaacaaagggctagctataagaatggaggttattgttaaaacgcgagtgcctattatcaaattcatagagccccaatcacagttacatatcgacgtttcatttgaaagaacgaacgggttagaggctgcaaaactcatcagggaatggctaagagactctccagggttacgtgaactggtactgataataaaacaatttttgcattcaagacgattgaacaatgtgcacacaggaggattgggaggtttcacagtaatctgtttggtttattcttttttaaatatgcatccgcgaataaaatcaaacgatatcgacgttctagataacctgggtgttctactgattgacttcttcgaactttacggaaaaaattttggttatgatgacgttgctataagcatatctgatggttacgcctcttatattcctaaatcgtgttggagaactttggaaccttcaaggagtaaattctcgctagctattcaagatcctggtgatcctaacaataatataagcagaggctcctttaatatgaaggatataaaaaaggcctttgctggtgccttcgaactgttggtcaataaatgctgggaattgaattctgctacattcaaagaccgcgttggaaaaagtatactcggaaacgtgatcaaataccgtgggcaaaagagagatttcaacgacgaaagagatttagtgcagaataaagccatcattgaaaacgagcgctaccacaagaggcgcacgaggatagttcaagaagatttatttataaacgacaccgaagacttgccagtagaggagatctacaaacttgacgaacctgcaaagaagaaacagaaggcaaaaaaggataagagagaaggggaaatcaaaaagagtgccattccatctccacctccggattttggagtgagcagaagcaaattgaaacgcaaagtgaaaaaaactgatcagggctctctcctacaccaaaacaacctcagcatagatgacttgatgggactttctgagaatgatcaagaatccgatcaagatcaaaaaggaagagatacccttcgggacaagatgagaaatcaccactggaaactaagacagtagatgctcaaacgagaagggactactggctctctaaaggccaggctctttaacacaatatagactcttatagactatttactatttatacaagaataccacatcgatgtccaagtgaaacaataagctaatgatatcaaacgcgtgggtattttccctttccggaaatatagagccaccaaaaaaggatagtttcccgatatggaaattttctcgagccggtaagatgacgaaatttttcatctctggcatgatagaaacatagtatggaacgtgcaggagagtctgattcgagacacataatttgaaagaaccttctagcctgagccttgtacatgtattagcgttgccagttatttgcttctgctgctaataagatcaaaaccttaagtcctttatttcgatcgaacgtactgcgctactgaaaaccattgcatcttttgctatcattcattcctggtggtttctttggtgtaataaatcgaacagtgaaactgaaacataaaagaaatagtgcaaaatatgtctctttcagctgcagcgaataagatatctgacaacgatttccaaaatatcggaccggcacctagacctcccagttcaaatagccagggccgtacttgctataatcaaacgcaacctataaccaaacttatgagtcaactggatttaacatcagcgtcccatttaggtacaagtacctccaaaaaaaaaagcgggtgggtgtcctacaaagatgacggtatactttcatttatatggcaaaagagatacctgatgctacacgattcgtatgtagccctttacaagaacgataaacaaaatgacgatgcgatcttgaagataccactaactagtattataagtgtaagcaggacacagttgaaacaatattgttttgagttggtgcgctgcagtgaccgaaattctgtatcatcaggatcctcgtcctctttgaatgtatcatcagacagtaactccaaaaaatcaatatacattgctacaaagacagaaagcgatttgcatagttggttagacgccatttttgctaaatgtccattattaagtggtgtatcttctccaacaaacttcacacataaagttcacgttggttttgatccagaaacaggtagttttgttggtatgcccaccaactgggaaaaattattaaagcactccagaattacaggagaagattggaacaataattctgcggctgtcattcaagtgttgcagttttatcaagagtataatggagccggaaatcccacaaatactttagacaagcctcaaagtggtgaaacttcctcctctcaaaaatcgctgccaaacagctataatgataacaaactcagaaataattcagtaaattcaaagtcatcttcaggcgtttcttcaagtatggtatcacagaggaaaacctcacaaccaccaaataccaaatcgcctgtttctctaggaagcggctcactgccaccaataaatacaaaattgcccactagtcagtcaaatattccaagacacttacaaaatgttcccaaccaacaatatcctaagatgagaaacggacactccccaaccaatggccaatttcctaggggacctatgcatccaaacaattctcaacgatctttgcagcagcagcagcagcagcagcagcaacaaaaacaacagcatcaacaatatccataccaccatcaaggaccatctccatctccatccccatctccgtctccattaaacccttataggccacatcacaatatgataaatccttattccaaacaacctcaatcgccattaagttcacagtcgacccaaaaccaagcaattccacgttatgcacaaaactcaagtcctacagccgcacactttcaacctcaaagaacagctccaaagccaccaatatcagctccaagggcgccatacccatcaaatcaaaatgctactagtaacacacatgtacagcctgttgcacctaagaatgaccagtcaaccccacaaacaatgaggcaggccccaaagagaccggatgcagatgtcgcacaaccgggtggtgtggccaaaccgaagaagccagcaaggcctaccatgtcaactgcagaaataatgagtaagctgaagaaagtcaccgtaaatgcggatccatctcaatgctttaaagtgatcgagaaggccggtcaaggtgcaagtgggtccgtctaccttgcagagaggacgcatattccgacagaaagtaatatgatcgaactcataaacaatgatattgatgagccgcacgtaggagataaagttgctatcaagcaaatggtcttatctaaacaacctcgtaaagaactcatagtgaatgaaattttggttatgaaggattcacgtcataaaaatatcgtcaattttctcgaggcttatttgagaacagacgatgacctatgggttgtgatggagtttatggaaggaggttcactaacagacattatcgagaatagtcccaccaacgataattcacattcaccactaacagaaccccaaattgcatatatcgtacgagaaacttgccaaggcttgaaatttctacacgacaagcatatcattcatagggatattaaatcagataatgtcttgctggacactagagctagggtgaaaattaccgattttgggttttgcgccagattaactgataaaagaagcaaaagagccactatggttgggacaccttactggatggcacctgaagttgtcaaacaacgtgaatacgatgaaaagattgacgtatggtctttgggtatcatgaccattgaaatgctggagggtgaaccaccatatttaaatgaagatccactaaaggcgttgtacttaattgcaactaatggtacaccaaagctcaagcatccagaaagtttgtctttagaaattaaacgctttctaagcgtttgcctttgcgtagatgttagatatagggcatcaaccgaagagcttttacaccacggttttttcaatatggcatgtgatccaaaggatttgacatcactgttggagtggaaggaatgaagcacacaactatttctataagcatatcatacatactacaatcttatgtatttcttttcttttagctatgcataccaatggcataatatataaatacgttcaccttaaaagttttttttttaaagtaaataaaaaaagacctgcaacgatacaataatcaatccaatgtcgtttaatattactatttatcctacgtgatttttaaaaatattcgtccatgcttcagcttctagtctagtttcgtaaatccaagtgataattccaaaactttatcttggaggccatccattttatgagatactgggatggttcttaaaatcaacggacttaatgtttgtaggttttcaactccaatttgtttgttgccaagggtcgaattttgatctagaacacctcttaaaatcacgcatagcccatttaatagagtagctagttctgttttacgcaattttggtattggtgctcgcccaatcaagtattcatctgagatatatcttctaagagcaagggcaattcttgcagaaagataaggagcagttaactttcttaatttctcgtttgtgttcaacataaaattaaccaaatcttgcaagcactctaaagagcacttatattttgtctgaaagcgaggatttgtggtggatccaaatatacatgaaaaatcgaacgaagatagtttttgagacaattcagaaaacgtaccacagtcttgcatcaaagcattttctaattcatcgaattcatataaaaatgaacaatcccagacggcataaatgaaagtgtctaattgcctttcattgaagagatcaatgattctgttttccagcaatatctccctatatttggaatactcattcaaatcgtctatctcggttaaattatcgagctctgggttgattctttgtaatgtgacaacaataacatttataaataaatcacaaaagttatcctttaatggattttctgcatcttcttggagtgatttgaaaattttgttcgacaaatcacagaagcaattggaagcaagaacccatatggggatttcatcactctctgaccctgtaataagcgattttcgcttgatgatttcagccaaatttttcaatattcttaaaatatgctttgctttcagtgtggatataccaaattgatctatttttgctattctatttctcaggttagaacatgacatatagctgattgcctcaaaagttggtaacctgttaagtgatgcttttggaagctttggtccaagtttttttgttattttttcccttgtatcaaaagccaatatcgatattgtacttaactggagaagaatcaaaatttctgtatctttagaatcatttgtcataaatatatcaagtccagacaatatggccttttgcatagaggacggtttagttttgtcttggacaaactcaggtaagagaggatattttatggcagaattgaataaaagaagaactttttccacaaattcatctgtcatcgcatcgtatttcgatattaattggtaaagaggaggaaatccggttattagttcgtatatacaatcgtattcagttttgctcgatgcgtttgtggagagatcactgtacgtaatattgtagtcggtaaatatttcgcagcactttttcaatatatctgatggaacgtcctcaatagtgatgatttctttcagcagggtttgataatttaatattacagcattcttggtattattagaagtggaagacaacaatcttttcaaaaaatctaataacattgaccattccttggcgcaggtagtgttgtttttgaagtccttaaagtgttccggataaagcttaattaatccttgcaatgttacatttataaaatcagtttcattttcgagttcttcagtggaccattccttggtaagcagtggttcaataacctctaagaaaattaggtcccatggggggaagcaaacagaatgggagtcgatgattctgaaaaaagtctgcacagcaccgtttttaacttctactctatcatcattagtacaattgatcaaatttttcaaaagatatatccataatccgttgtaaagttcccaatcatgagatgaactggatgtaatgatttcaattaatttttgattattaatcttttcggagagacttctacgtttctcatcacttaaatttaatgtttcgggattgaagcggactctgagataatctccaactaaccagaactgactaatagaagaaaaggagatattaagatttcgcttctgacttacgaaattgacaagcgtatcaataacgaatttaatgacactcataggtaaactctgtaagaaatcatcagaaattagtttaaaaacatcgtatgacacttggatcatgttcttatgcttctgaacgataccttcaaataaagatgaatcatctatatcctcattcacggaaaaatcagtatcctcaactgtccactcgaatggtgaattaatgatgttgaaaatattggtccaagagttcattaacagttcaccaaattcgttcagaatctcttttaaagttagtagcaattgaaaaagaatatctgattcaacattgatcgtcccattgtatatttcctgcttaccaatatccaactgttttatcgagtttatcgttgccatcaagctatcgatgactaagttttccaatgtaccaaactgtttcactttattatcttgctcatcggaattaccaacctcattagtagcctttttgatgatatctgtaaacactctcactgtgtataaacgtaaagaatcgttatccatttcacggtttgatatcaatttgatcatataggtggaaatcaaactccaaagttctttaccattttttccaaagagaaattttttgcaattataagttgccagttcaccaattttgttaacaaaaaacgccttgttgtaaatgcatggtataatttcatcttttgcatctaaaggatgatagccaatgtcattattcaggttgaggttcgtttgttctaaagtgagggtattttttgagtccaaaattaatctggttaataccaaatgaaaagttgagcaagaatagctgcttgtactttcaaaaaatttcgttagagagctttcaatagatgtaacgtctgatttagtcagtattggaggtggtggaatatcttcagagtaaaagctctctttgaaatctgctgatggaccatatatgtagtaagttatccattgccaggttaaaaaagtgtacctccagctttctgaatcgaaaataggacctagtgatattgataatgatattaatgcccttagtaaactaacttgtcttgaactaatattcctggggtgcaaacgccttttcatttccttattttgcgcagaatctgcaatcgacctacttggattttttgttgattctacgggactggtcgtgacactagatgtggatatatttcttgtatgttgattttttgctgacttacttgtatcattaaaagaatattgattggatgatgtaacgttgtttgttatcaaaatcgaaaacaatttcatgcatgcccttaatttgtcctttagtgacagaacgccggcactatgagctaatttttgaaaagctctaaccaccaagtggaatatcgatgtctctaaggaggtcgaatataaaaagagtttgtttagctcaaataggccagaaaacaggccgctataaacctttacaactgtcgaatcatttccagttccctcttcacgttctttgtcctcaattttcttctctaggggagagctttccagagccgatttgttcaacccctcgcataagtggttacagatggtcagaattaatgatataatgtaagtaatattaatggacggagcgtttgatttgtccaataaatgcataaactttgttttaactgtagagttttcagtagttatcaagggagaatccattttctcgactacttttgatggcgccaagaaagtaatatactctggcgaatttaataagacaatacattctttcaaaagatatttgaacacatgttttttatctggataattatcatagtccatatagagtgtattgacgatttcggggtcttgtgataaatccttgaaaagttctagagatagtactctttgccatccacttaaattggattcgacagatatgccatggattaacagcgacaagatgacctctaattctaactcgagtatgcttaggtactcttttcttatcaacaacttcaaacaacgacaactccttacagcggtggagaagtgtctcgaagaagatatgcaacgtagaagcaatggaatcgccttaactctcagtagatattgtaaatcttggcattctaaaagatttttctgactattcttcaaaatcgattcaaggatttccaggccatagtctattgggatgtccccaatgtctaacagcatctcctcgtcactaactgccccatttgagcttatttcatttaatgaacagatattatcgaacaatttgttagcatcgtatctataaacattgaccttaattgactcactattacttatgaggacttcatattgtttatcatccactacagattcaatggaaagcctatcaaatatttcatcgataagctgctgtaaagtggcactcgcagtaccaactactacgggtgccttattaggtacatgcagcagatttgagcaacacagcaacaacttcttacaaagcggcccatagatgaacttcccgtatgtcttaaaaaaaatgggtaccacctgtaaaacttttaattgaatctccatcgcgagatgagtagcctcaatgaaggcatccaaaatttcagacagccggcttcgaggaatagatggaacggttgacagtccctgtaggcattgcattgccagggtcgtcattttagcattccttgattggcaagccaacacgaaagggagtgcgaaatccggatgtctttctagctcctcaaaactatgtactcttttcaatatctcaatggatttatcactagcatggcgaatggttgaatttcttcttttcgattcggaagataaagaacgcaattctgcttcaagttgcctttgcatggagtcaaaccctccagtgttcatggccatatgaatggtgtgtaacaggtcaagttggtttactttctttgaaaatcacttgtattgcatacagtctacaggctttatttagctgggcttaggtcaccttaattattaacacggacgatttaaaggtcatccacgacgaccagccggctttatcagaaagtgggataatgaagacttcgcaatgactttatgaagaataagagcaggaggtttgaggaagtctgcaactcgatctgaagagagtatttgttagctgctaggacaatattggtatacccctttagtgtgctcaatttttggtgaaagcagaccgtatcattagatcattgcagaagtagtgagatttagtcgtacgttacgtcatggaacaccaagcacttcgaaggcttgtactgtactgccccaatttcatccgacgtggtgctcttaggcaaaatatgactagagtgagctgtagacatatgtcaggcaagggtggagggagagatgagaaaggtgattgcaatgaagaaaaggattcttccaaagatttggggagggtaccgtcgaagatgaaacgagcatatgatggtgaaacagttattaaagagggagattcgcatgctgagtcgctagcgcagcagggaaagcagcccacagacctcgcatataacagcagatcgaagatatctggttctaatttgcatttattggttcctagagttgcgtctacagactatatttcgaataaagaggttcacacggagggcctgtttgccggctatcgacccttgtttctggggaactcaggttttccgtctgatgcaagaaagggtaaaaactttcatgagttagacgacgttcttcccaatatacaggtagtggacgcttccgagaaagatggcaaactcaatgtgcaggagattattgaggacttacaaagaacaagtttgagagaaagcattcatagtatggaacagttaccatcttcgcacaaacgtaaacccgtaataccgtgggacgcatctataagtggcatggtttataatgacatgcctttcaaatatgtgcccaaaaatattattctgaaaatgaagccatttaaacttttgcgtattgagagaaaaagtcaagcgaagaatgcaagaaagcctactatgataaaacttcagtttcacaatcgaagaatcaatgacaccccagagttagtgaatttataccataataaatcccgtttgcacgagtcactttacaatacaaaaccccttcaagaatctggatattcaagtgcaaatacaagtaaaagacagaaaatgttaaaagcaagaagcgactttgaacataaacagaaaaattatgcatacaaacacacatttatcaaaaatgatcaggaactgttccgcaatgaactaactaagttaaataagatacttgctagagaattcaaaaaattgacaaagctatccatacataatgagttcaagagagaacacttgcccctggccgtttatgtgagcaaatcaaagggcacaaagaaactgtttagaagatcactgaagatgaaaatcatggaccacatatacccagtttataccacgatattgtcaactttaacaaattccagagactctaagaaatttgaaaacaaaatcaaggcgtatattgaaaaaatcatagtgcggttatcagatgaagtaccatccacatattttttccaagatggcgtagattgtattattcaaccaagtccgattcataatttcaagagaatgcattggttaagatacaccaagaggcacaataccttttgggggaggactatacataaggacgttcaagtcagcttcaatgacaagtatgttgttactaggagcggcgtgaggtatacgaggtatcccactaatttgaatacacaattattggaaactgcatttgaagaatgggactactatgagtgattttgcattgagtacttatccactgctctattatgtgacatattcgcaattcgtgtaaatattatgcatatgcatcttgagcatgcatggaatatataaatatgtaggtttgttgtaatactgtttctgctgtgtccttcaaatatggcctatatggtcgctggtaaaagtggcagagctattgttattgccttcactgccaacttcatattcatcgtcatcttcatcttccgcgttctcatcgtcatcttcatctgaattgaaaacgacatcctttgtcgaataaatgtatatgcctggtttgtctaatcccaaccgtttcctgaccatggcctttctctgtttggttttttcatttttcgagctgctgctattattgtggcctacgcttttctggacgatttggtctgtaaagtataaaattttatcacgcgcatagcctaatttcttcagcgctacatctttataagttcccctatcattgaaatgcattcgatcaatgcttctgcccactgatatctgatcttctgggtcgtagcgtgatatggtctgtaaatcacatacttccgaattacttgacgtatcgtgccgatccgttgatgcgtcctgagattccctcctggttaaagcgttttgaacccttaaggcgtacttggcaaaccgatagtcttgttgctcttcctcgaagataggtcttcccaaaatgctttgcgcttcctcttttctttccaaaacatttaatctatccagccactcccatgtgatcacggtcgaagtgacatagcatgtcgtgttaaacacttcacccagttccgatatccataagttcgacacatcggcaaggaagaaacccggtaatagaagcaccacaagaatagtcaatagcgtaagtaaacccatttgattgaatttaaaccacaatttttttttctgccagatgtgataaatgacgattgatgcatatgacgtggcgatggcaatacggaaaaggtaaacaaatggccgcagaatctgccagtcatttctgtgttttgtagtatggttagcaaacggtggaattacccataaaatatttgcggttattgttaatatcaccccaataaaaaaaattattctcttttcctgagctctttgaaatagcctaatgacaatgccgacttggcaaaattggaacattaaagtagccaagaaatccaagacaacaaatgtcatatcatcggaaaagatgtgcataatggaatgagcccgaacgacaccatagacattgtgctctttttccaatctccgcaacaccttcgtgataaaaatcgttaagttcaacgaggctaacaacgaggctatcctcagtagttgtagaattctcttatatgcgcgcccgctgatatttatacagcatatcacagtcaggaacactgtgatgacaaaattagaagttatcgacaaaatcacagcataaatcgcatactcagcagaaccgccgacataatcgcttacttgaatgaatttttgccagtcattgatcacctcatcaagatacctatatggggaagagtttcttagcaccgtagatacataaacgggcactctttcacagcagaaactcctaaaagtaatatcttctgcatatactgccgaattgtcataaagaggcaattgtatcagcacccctgaacctagcttcattggatgacagctattgtaagcagccaattcttctggactatgtctccacaagttcatgtttgcagaatcgactattcatcgagtgtcttcctccttatgtgctactaaaaacgatagtctaaaatgactgattaagtgcgcacaggaaagaagaaaacaggtaaaggacaccgaatctgtagtaccagtcttttgtctttcttgtaactaaacgatgtgggttgctcttctaaagtacttatctttactcgccgatacaacgggttccatcttctctttcaatagctgctatttttctgttcgggcagtatcagaattaacaggatcaaacctcgtttatgtcacgtagaaagaaagtagctaaaaatagctaaagggacatctagaagctttgtaggagtcaaagagttgcgcacccagaaccattgtaattagcatgcagaacgatcaacagaggttctccctgcaaaataggacggtactggcgcatccatacaaaaggctaggaggggcatttacggtgaaatcaccgtctgttcctaactttcatgataaaatgcattcagatcatagttctagcgactcagctctggtgaacggaagctttagagcgaatgatcatcgctctgtggaaccaagttgtttgggccaagcatccccctctgaacatgatgggaatttaagcgttattgacctgtatggagacgaagtggaatcccaacgtgccgaaggagaggatgatgatgataataatggcgataatggtaacgaagatctggaggaagtgcacagtgatgacctcgatttggttcctgatgatgacaaccgtcagcgtgtagaattggagggtgccgctagtgccacaagtgcgaattccaatggaatcaacaatacccattttgatcgatacggtttcaaaaaacagaataattacatatctgaagcagaatacgataagtggtgggtagaatattcgcagtactgcgttcgccgtaagcacaaatggcaattgctgttggagaaaagtgggttgccagtgaccgatgattctccttcacgatttccatcaaagagtgaacggttaaaaaggtatgtcagaaagggcattccagcggaatggagaggaaatgcatggtggcatttcgctagagggcaagagaagttaaacaagaataaaggcgtctattcacaacttttacgaaagatgaagcagatcaagaaacaaaaccctaatgaaaaacaagttcaagacttggatattattgaacgtgacttgaatagaacatttccggacaatatacatttccaaagtagcttgcataacaaagagggacctccgattataaaatctttacgccgggtgcttgttgcgttctctctctacaatccgaagattggctattgtcaatctatgaactttcttgcaggcttgctattgttatttttagacgaggaaagggccttttggatgctagtgattattacttcaagatacctaccgggggtgcataatatcaatctagaaggtgttaacatcgaccaaggggtactgatgctatgtgtcaaagaatatattccagaagtttggtcgtacattaagccttccattgaccaccaccaaaaaaataacaaaactttttctccgtcaaataaaaaagttttattcaatatgcaaaagaatgagttcttgtacagacttccgcccattactttgtgcacggcgagctggttcatgagttgctttgtcggtgtagtgccgatagagaccacgcttagaatatgggattgtctgttttacgaggaatcacattttctattcaaagtttcgttggctgtcttaaaattgagcgagcatgacctttcgaaaataaaacctcgtaacaattcgttgaattattcttggggctctaacttaaaccagagaggcggatcaatgggccaagaagatagcgatatggaaatttttcaggtcatacagacattccctaagacattattgaacccaaatgagatctttgagaaaatcattttcaaaaggagatttaatttaaataggttagatcaggatgaaatagacaggtgtcgaaaatttgttgccgctcagcgtctcaaatttaagacatatggtgaacttcttggaaattcaacatcagaggcagatttgccaattaatgataatacagataataaaggtatccacataacaagtgatgcagtcaatgaagcattatcttcagaggtatatgggtttaaaaagagcctagctggagttcattggaataatagcatcaaggagaaagtgaagcagatgaggaagaaaaaagacaagggtgactaacttttgcttcctgtttttgtttttgcataaacaaatatgtgataattaactagcatataaaacatatacatatacacagacttatttttttttgagcatctatatttcagagaattttgtttggcgttttttctctggtattgatctggcaattttccatgatatcttctaacagcgaggtgaaaaatttgttaaagatgagctaagcttgtaaattgtgtaagttagggcatcacataaaaagaaaactcaatcaaggggaacatgaatggaatatttgctattgagaagcctagcggtattacatccaatcagtttatgctaaagttgcaacatgctttaactaaaagtcaagtattctcgaaggaaattcaaagggcaacagcggaaagaaagcagcaatatgaaaaacagacaggtaagaaggccagcaagaggaaacttcgtaaagtctcaaaggtaaagatgggacacggaggcactttggatccgttggcctctggtgtcctggtaattgggattggagcgggcaccaaaaaacttgcaaattatctttcaggcaccgttaaagtctatgaaagtgaagccctgtttggtgtttccactacttcaggagatgtagaaggtgagattttgtcccagaactccgttaaacatttaaatttcgatgatttaaagactgtggaggaaaaatttgttggacaattaaagcagacgccgccaatatacgcagctttgaagatggatggcaaacccctgcatgaatatgctcgagaaggaaagcctttacctagagccattgagcccagacaagttactatttatgacttgaaggtgttttcagactctcttaaacgtgatcatgactatcccttattgaggcccactacagaagaagctgttgataccgtgaaaaatttgaatgcaaacatgctaaacgatgttttatacttttcaaaagaatatacagagaagcacggccttgattctgaggtggcaaaggtagaagaaccatttccgctgagtgaacaagaagagcaagaaatccaaaaagaaggagattcttatagggctccaaaattgcacttcaaagctaatgtgtcttctggaacatacataaggtccttagtgagcgacatcggtaaatctatgaggagctcatgttatatggtgaaattgatacgtttgcaacagcaggactggtctcttgaaaaaaataatgtgttccaattaacggattttactgaaagagacgagaaggtgtggagtaaggtactggagaaggttctagacgagggagcaactgttgatgttatagaagagctaaagaaagcagaaaaggaaataccagcggacgtgaaggaatgtatagtttcgagtgatcaacctggtgatgaggctacggctgaaacaattgaaactgctaacgccgaagaacattctaatacactaaaaagaaaaatcgaacaggtgtaaaaaagaggaagttcgaaccatttttttttttggtcttgtgaagactacgctctcattttatctatttttttatgtgtatatatgatttaaaaaaaatcgatgtacttatgcatttaaatcgttcaatttttttgtgatagttcggtctcttctacgtatcgtccaatggatgaattaccatcaaggatgagttacctatataattacaggttgagtagtcagtgtccatatagaaattgtaactttgataaagaagatcttccgtagtaagatcattcggacaggaaaattgaaaatcgcttgggcaatttcgtactaatgtatagcacatgtcaatacaaggtagaatttcgtaatagtcatccaaaggtttaataaatttattcaaataatcattacggttgtgacttttatctctgtggatgtagtattgggaagacgtcgtggtgcatctcggaattgatactgcacatacccaatcacgataagcttcggcacaatcgtcacaagtcatgaccggagaatatcttgcgtctttgtctgcgtcacaggatattaactgtagagctttgctaaaatttgcatatagtgcctctgcaatgtggtcatatgtctgcgccatgagagttttattacccacagaaaatgaggatgtaggaacagagtaagcgacgtcactgcagaagtccaaaccaaagatcaaagagcagacatcggtacttcttgtggtaaaataaacatgtgaaaataaaatgccgcccacacttgacaacccatcaccattactgattttctttgtcaggtacgctacataagttgttgaggcattcagtcctgtcacgtaaaacatttctgtcacgctaccaccatattctgtaatttttttttgaatcgccaagtcagtacgctctaaaggatttgtactatttgacgtaactgttgcatttgatgtattttgggaagacactaaatatggtccatttttcacagcacaaagagataaattatagttttggtttagttgaacagaatcttcgtacgagtaaacatacagatcgtacaaggatggatcatatattgaataattgtgataaactttggcgtctgcggtgacattccccgttgatagtaatgcagaattcatatcagtgtccaggacctctacccaaggccttacatcccactgaaaaaccaaatcgttctcagagatactcagtctatattcccaattttcagaggcgtcggaactggacagaggttgctccgtagtggaattcactagctcagcgaccacataaagatttgaatacgtggaggtagcgttcgagctagaagactgcactggactgatggctaatgcttggatgtagccatcctgaaaaactgcactttgacctatatttgggttctctaaaaccgtttcattaaaagagtagtatattgttaaatccacatctgatctattcatgggcatttggcatatattgccgctaataaacattaacacttcatacgtgggagcaaacccataaccggaggcttctgcgtcaatggtaaatacaaaactgtcttttttgcccgctgttatgttagataagatcggggtccattcataaatgctatccgaattgatgattgtttgttgaccagtagccataacgtttttctcccatctatttaggctgggaaactttaaggaaatattcttatttgcgaaaggattgaagtcttggaataaaccgtgaatagaagtggtaaataggcagtaaaccacgaatagtgcttgccacactatcatccttagaaataatactgccgctggacagaaattgtagtgttacgggttttactgcaattcagtatggcagttaagccagtcaagtatttgagaaatagccaaaacggtacgtcagccggtcgaaattattagggaaattttccgcaaccaatggctcagtttcagtaacctgttcttgagaaaacaacacgtttacttgtagagttactattgcggtccgatggcagcgaaactatatcattattatattatgtatggcttctcaattttgatcttttttttttttggtcagtacgcgattttgaaagaaatggaaagaagctataaagagcacaggataaatatcttttcaaagcttgaataattttataaaaggtgtaggaacaggcccgacatacaagaatgtcgacaagtacagagaagaggagcaaagaaaaccttccatgggttgaaaaatacagacccgaaacgttggacgaagtgtacggacaaaatgaggtgatcaccacagttcgtaaatttgtagatgaaggtaaattgccacatcttctattctatgggcctccaggtaccggtaaaacttctacaattgttgctttggcacgtgagatatatggtaagaattactcgaacatggttttggagctgaatgcatccgatgacagaggtattgatgtggtgaggaatcaaattaaagactttgcctctacaagacaaatcttctctaaagggttcaagttaattatactggatgaagcagatgccatgaccaatgccgcacaaaatgcgttgagaagagttatagaacggtacaccaagaatacgcggttctgtgtattggccaattatgcgcataaacttacacctgcgttattgagtaggtgcacgagattcagatttcagcccttgccccaagaggccattgagcgtcggatagccaacgtcttggtgcatgagaagctgaagttgtctcctaatgcggagaaggccttaatagaactttctaatggggatatgagacgtgtgttaaacgttttgcagtcttgcaaagctactttagacaatcccgacgaggatgagatcagtgacgacgttatctatgaatgctgtggggcacccagaccaagtgacttaaaggcagtattgaagtcgatactggaggacgattggggtaccgcccactacacacttaataaggtacgcagtgccaagggtctcgcgttgatcgacctaatcgagggcatagtgaagatactggaagactacgaacttcaaaatgaggaaacaagagtgcatttgcttaccaaactggccgatatagagtactcgatatccaagggtggcaacgaccagattcagggcagcgcggtcattggcgccatcaaggccagcttcgagaacgaaactgttaaagccaacgtataatcgacgcaaatatgtatagatacaatatgtacagaacaactgcattgtgcaatataacaacataacacaacgcccagaacgaaataaaaaaaataaaagaaatagatgaaagcattttcaatttgcataccggaaaccgtaaatcaattggcgtctagctaacaactgagaatgcgaatcgccaaattgttacagaaagtagcattccgttacgtgatctgtactttaacctcttggacgtaaagaatggcagaactctggctctagtgttctgcgaatgccagatcgggaaatatttcccaaaagggcaacagcggcacgaacaagaatttcgtgttaaaaatcgcgtccggcgcgaaatttttcgcggaggcatgcgacgcaaaagcgactcgaaatgtcgggagccaaatgaggctacaaggctgtgggcagattttggcgttattatggagaataaaaggaatggtagcttccatatagcgataggaaaacatatataaggtcaataggcctacatggtaatgggattgataagcttgtccttaactcttgtgtcttggaattactattgcgtacatcagcaatcatccattgtcaagaacaaaaacgataacaaaaacaatcaattatacaaataacagtaaagtaataaaatgtgtgaatacagcaaggctcttcatattctgctcaagtcgccagtaacggatgacataataaaattcttaacagacacaacattgagggttgttccttcaagcaactaccccacgcctcccggttctccaggagagaaacacctcacaaggctgccatcgctaatgacttttatcactagattggtcagatacaccaacgtctacacacccactctgctcaccgctgcgtgctatttgaacaaattaaagcgtattctgcccagggacgctactggtctcccctcgaccatccatcgcattttcttggcctgtttgatactgagtgctaagtttcacaatgactcttctcctttaaacaagcactgggctaggtacaccgatggtctctttacactagaggatatcaaccttatggaaaggcagttgttacagctgttgaactgggacctcagggtgaacacagaagatttgatcctagatctgcagcctctattagagcccatcaagcaagacttggcaagatccagcgaccaaaggaagagaattaacatgatgatgtccatgaacagaaggacttgtgctggcacgagtcctatcagatcaaacaacagattcaaactctacgaaaaacagagaaacgtgtcgatagcatccgatttaagttctgctactctagtcgacagttgtaatgatctaagaaggctaaaagatgtaaccaacatagcgaacaacacagtcgctaacacgaattacgtcaggacggtagagaaatggaacgacaatgtcaacaggcaaagttgggatctggaacagatcatgagtcaacatgggttttaatgtggtaaacaagatggcccttacggggctcttagtgggagaaagatttttaatagagcataattaacggatacataatatattataaatttaaataatcaaggatacctaataataataacaatcaactgaacacaacattaaaaatggtatttgttattgtatgttaagccctaagtgattgtgccgttataacttccattcgggtgatacctgcaatatgaggaagaaaaaagataaattttttcttcttaaagtataaaaggcggacatatttgatttaaatgcagaagttttctctcagtggtttatgttttacatatgatagaaaaaatgaagcaatagcaaagtatcgtagtgcgaaccggtctcgtaactttgataagtttatcaaaggcgttaacattttgtttcgtaatagtaccttaacacatgacgaagatgaaaattaaacatgaattcaaggaaaaatggtaaatgacgagaaaaaagctgtgcaccagtctgaacatggatgccacaagtactcaggtgtcctatgaagcattaagtatacccaaatttctgatccattttcctttattttcttttttttttttctctcacatctgtgactgtattatgagcaaactgtttacgttgaacggaatcgatatgtaaattaaatcttttgaaatatgtaggacagtgcttgtataggtctgttaagtagattatagaatgtacgccttttttctgggcgtgaaatagatcagaaatcctgttaggttgccactggtccatttcagtgttgctcatccaatcaatcatgtatttacatgcctggagtggcctattctatgtattaacagcctttgcaagacgcgacattgttctttccgatatggctcggagtagactaaatatgctacttatagtttttcttgcgtataccattgtcttatagtttttgcacacattaatgtttaaaattgaaactacgaagcaaaacaataaaaaaaacaaacaaaacttaaaaataaacaaaagacgctcgaaaccaagtgcatttattgaatgtttttgggaatgcaagtagcaatactattgtaaaagtactactatttccctgtatcatacgcttttactactattcctcacataaagcgagatgcttacagaatgcataagagagagaagaaaaccctattacgcccacttgtctatattagattactgtccctatttatatcatcattgcaaaacgtgagcacctcattagacgtagattcttgcataagtattactagcaggagaggaaaaactccacccacacacctcaacatgctgagaattttgctgcgagcagcaagaggcaaaatccaaatttaaagtaatttacgcatagaagacattgtaaagggattgcaaagacgtagagtacgcaagttagaaaccgttcatcttttaaaactcccaagttttgacaaatttgcgagtgtgtgtgtttctgctgatcttgacgagattaaactttgttcctgaagcaacaacgacagcaactgaacatcctctgaataagttaatatgttttccgctcaaaagccaatatatggcaatggagcaggcgtgaacatgggtggtggtggtccttcaactaataatccaggatctatgtccatgcctggggttccaacttcaatgggtccaggcatgaatcaacaaattccaagtggaggccccatgctaatgggcaatactccgaataataataatagcaatgaaaatggcgagaacaacggcaataacggcaataacggcggtaacgatgctaacgcaactcgaaacaatcccaacatggtcaataatagaggcgcagtgcatgctctagatgatcccaatgtataccactggatttgtcaattgacctacggccctcaaaaggaacaagcactgcttgaattaggtcgcaaaagagaacagtttgatgaccttgccgttgtgctttggtcttcctttggtgtaatgacctcattgctgaacgaaatcatttccgtatatcccatgctgcaacctcagatgctctctaacaatctatcaaatcgtgtatgcaacgctctagttcttctacagtgtgttgcatctcacccagagacaaaacatctctttttacaggcccatattcctctctttcttttccccttcctaaatactacctccaggcaaagaacttttgagtacttgagattgacttcattaggtgtgataggcgcattggtcaaaaatgactcacaagacgtaataacgtttttgctaagaaccgatatcgtgccgttatgcctaaggatcatggaatcttcttctgagctttccaagacagtcgccattttcattttacagaaaatcctactagatgacgttggattgcaatacatctgtgccaccttggaaaggttctacgccgtaactaatgtcttaaaagatatggttgagcacttgaccgtgagcacaccaccgggacgactactgaaacatatcattagatgctacttaagattaagcgacgatctcgaagcacgcaggctattgaaaatagtcttacctgccaaactgagagataacacttttacggaagtactaagagacgacgtcgggtccaagagatgtctggcacaattgctactgacattaaacgaagaaacctcatgatgcatccccatagatatattactgtttttctctttctattttcctgtattgttttaaccttgcctttttgttttagtttcacttcctcacctctcctaattttgtatagttatatttatatgcatgaaatgtataaagtccactcatatttcagaatggtttaagttaagtgccagaaggttcttctgtactattactattacccatttttcatcctatcacccggaatgtaccccttgtgtcattcactacgacgccacgaaccacgattctatttttttcgaaatctaaaggtttcgtcaagatcaatgaaatatacataggcgtttttttggatacgagttgcattgttgagaacacaattctttacaaataagtgcaagggaggaattgtgtgtgctcattaccaacgtacttcttcagttattctgctaaacccgtttttttgttcttagcttcatccaggtgagcccgcaaacattacagaacgacgtataatacaaaataactaaacaaatacggataggacaaaagccaagaagcgatactaaatcacagagcgaatcaacatgtctgcacatacttacaaaaagtttgaaaactcgacctcgggcgatttacctgataaaatgaccatttatcaggattgtatgaacacgtttaacgaatcacctgtcaattccaagagatgtcgtttattgatttctcgcttgctgagactcttggcccagggcgaaaccttcccacagaatgaagcaactgcattatttttctctatctccaaattatttcaacaccagaacgatcctttaaggcaggctgtttatttggcaatcaaggaattgagtggcatttcggaggatgtgttgatggcaacctcttcaatcatgaaggacgttcaaaacggttccgatttgattaagcctgacgctattagatcgctgacttatgtcttggatgaatctactgctttttccgctgaaaggttattaaaaagtgccgtggtaagtagacatccttcaatatcctcagcagcattatgtacttcttatcatttgctgcccatttcagaagtcactatcagaagattcaccaatgaaactcaagaagctgttttggatttgaaacaatttccaaatcaacacggtaatagcgaatattatccaaactccacttatatttctcaatatcatgctcttgggttgctttatcaactgaagaaaactgataaaatggcgttactaaaattggttagacatttctctgaaaacaattctatgaaaaatcaattggccaaggtagaattggtcaagattgtcaacgatttgatttatagggatcctcaattatttagtcaattcaggccacttttgtctgattggctatccaacaagttcgaatctgttcagttggaaacggcgaaattgattacttctttcgctactcgcaattcccgcttagtggctcccgagttatatgcggcagctatcagtgctttacagtccttactgaccgttcctcgtgtttcttctagattcgctgcattgagaatcttaaatagaatatccatggtttcaccagaaaagattgttgtttgtaatcctgaactagaatctttaattaatgattctaatagaaacatttctacttatgcaatcaccactttattgaagacaggaacttccaaaaatatttcatctctgatttcgactattactaattttatccatgatgtcagtgatgactttaagatcattattattgacgccgttcgtacgttgtctttgaacttcccacaggaatggaagtcaattttgaacttcttaatcgatgttttgaaaaatagtgaaggtggattcaaatttaaaaacagtattgtcgaagcattaatcgatattgtttcatttgttccacagtctaaagaactcgccttagaaaacttgtgtgatttcatcgaggattgtgaattcaacgaaatactagtgagaatactacatcttttgggtaaagaaggtccatctgccccaaatccatcattatatgttagacatatttataacagagtggtgttggaaaattctattattagatctgctgccgttgtagctttatctaagtttgctttgacgaagaacgatcctaccttatatgagtcaatcataagtttgttaaagagaatcgctaatgataaagacgatgaagtcagagacagagccaccattgcactagaattcattgattcggctaggaataaagatgatgttatagcacaaaatctaatcgaatccaaatatttttacgatattccatcattagagtcaaaattaagttcttacatttcctcaaatactgattcatttgcaactgcatttgatgtgaatcaagttcgtaagtttactgaggatgaaatgaaggcaataaatctgaagagaaagcaagaacaaattttcaatcaaaagtctgaaaccactttggatactacaccagaggcagagagtgttccagaaaaaagagctgacgctaattcatttgctggtccaaacttggacgaccaccaagaagatctactagctactaagtacgctgacgaattgctatccattgaacaaattaaaccatttggtcaattagtaaatagttctagggctatctcattaactgagccagaagcagaattcgttgtacgtggtgtcaaacatctcttcaaagacaatgttgttttacaatttaatattacgaatactctgacggatattgccctagacaatgtttctgtagtctgtacccctgaaatttctgatgaagctgaattagaagagctattcaccctacaagtggacagattattaccatccgaggaagcagcttgttacgttgcattcaaaaaacttgatgaaattgtaatggaaggtttcttgaacaacttaacattcactacaaaagaaataaaccctgacactaatgagccatttgatggtgatgaaggtttccaagatgaatatgaaattgactcgattttcttgaatgctggtgattatgttaagagttctttcactggtaacttctccgctacatttgatgagttgccatgcgaagaagttgctgttttcaacattcaagaagatttatccatacaagaagtagtagataagattattttgaacagtagctgcttaccggtggaaagtacccaatttgctccaagtgattcaaactcccacaccttgaaattatttggtaagagtgctttaactggatctaaagtagccctacagattaagatgatcaagagttcgaaaggtcttgctttgaaagttcatggtaaaggtgaagacagcttattatgctctgatctggtgaatggtctaatgcagtaagctgtgaaattttatttcagttaatcccttcttttgttatcaatagtattaaaagaaatgcgtcagctttagcaagcgtgcatgcaaataagggaatgaacagcaagaacaataataaaccaaaaaaatcacggatagaatatgacggatcatcaccacacgaagaataaattatgtaatctttgtataaacaaaatttttaaagaaaaatactataatagtttgacaagagaaaacgaaatggaagaaacaggacaacagggcagaaaaaagttgacattatgcaattgatgaaagaagaagaagaaaaaaaacaaaaaaaaagcactagtctgaccaggcatattgtaaaaggctgcagacccttgaacgcactacacttttcactgtattccgttaccaacattactgtttgacagcgatggatgctgatgaattggaattgaaaggtcatttgaaaaaattgaaaaaagaagaattgcttagaaggaaacagttaaaagagagtaatcttcagaaaagagagcttgaatataataatgcctcaaaaaatacttcaatatatatttctggtcttcccacagacaaaacaacgaaagaaggactcactgagcagttttgcaagtatggaatgataagaaccaatcgagatggggaacccctttgcaagctatatgtgaatgataaaggcgctttcaaaggggatgccttgatcacttattccaaggaagaaagtgttacattagcaatcgaaatgatgaacgagtcgatcttcctgggaaaacagatcagggtcgaaagagcccaatttcaaaacaaggaaggtgacaatatgcacgggaaagaaaatgatttaaaggagttcaacggacctgagcctccaataaagaggctaaaaaaagcgaagtctgaaggggagggggaagtaatagattacaatgacgatgaaagcctagcaaaagctgatcgaacggtgatatttgccaacgtattcaatatttacaaatcatacacaaatgatgatataaatgatattcaggaagatcttttggaaggctgtgaagagataggtcaagtagacagtatatctgtatctcccaataagggggaagcgacggtcgtctttaagaacaataaagttgcattgcaatgttgcaaaatcatgaccggacgttattttgatgggcaaaagttgcttgctttcatttctggagatgagaacacttcaagcacaagtgacaagaatgaggacagcgaagtggaagatgaccttatatagaactgcagtaaaaaaatgtattacccccatatctttggtacttaagtaaaataagtgaacacaatgtaataaacagaatggattagggctttatgacttcccagtacaaaataaatgtcgatataatacttgaaaatgcaagcaatgccatcaaaaaatttgagcggtacgagaatcgaacccgtgtccccaccttggaagggtgggatgataaccactacactaaccgcccatgtgttggatggtgtaactgtaatgacgaggtaataagtgatggcgactatatcaccaccgaaacacagcgattacttaaaagggtaatcactactgcgattctaattgttggaataaaccaaacctcttccgataatgttggaacgagagtaattaatagtgacatgtgttgctatggtaacaatctaatgcttacatcgtatattaatgtacacctcgtatacgtttaagtgtgattgcacctattgcagaaggaatgttaaacgagaagctcagacaatactgaagctgtgtttgagaaatgggtgaatgttgagataattgttgggattccattgttgataaaggctataatattaggtatacagaatatactagaagttctcctcgaggatataggaatcctcaaaatggaatctatatttctacatactaatattacgattattcctcattccgttttatatgtttcattatcctattacattatcaatccttgcacttcagcttcctctaacctcgatgacagcttctcataacttatgtcatcatcttaacaccgtatatgataatatattgataatataactattagttgatagacgatagtggatttttattccaacataccacccataatgtaatagatctaatgaatccatttgtttgttaatagtttgaatgtttttatcggaagaggtttggtcattacgtctgcaatattctttttggtttcgatatagcatacgtgcagatgatttcctgatacttcatctctcaatctcattgctttagtaccaaaaaatctgttcctaaatttctcttcattattggatataattatactgattgtagatttactgtcggttagtaatcctttggtaattggtttcttgtcaagttcttgtatcaggtaacttagattatttaataatgggacagattcacttatcgcgtgtatttctgcttccgtagttgaagtacatgttaatgaagccttggtggactttcctccaattacctttccattaagtaaatatatgttgccaatttgtgatttataatacggttggttgccatacgaggcatcgcttataacaactaatttatttgttggcttaacaggtttgcttttgtgccatattaattgcttatctctcgtattccatatgaactgtatcaattcatatgtcatatctaacacttgcttggacggaaatagtatatgttgtgcaagtgtgttgatgtagtataataggtcaaatctaaatttatatccaacatatgatgctagacctatcagcttttgcatttcatgtaccttcattttgtaatcatcttcttctagctctagttcttgctggtctatatatagacctggttgacctggagcactaagtttccttccttttgggtttaaaggtacgtttagtttgggtattttttcagttaatgagttttccatacccaatttcatgtatttacctctttggtatttgatttccaagccaagaatgtcatattgaatttcctcatcactttcgcctagatttataatcttggtgtcgtattgcatcttaagcttctctataattcttttgtttgaatttagatttttgctaaacaataccatatcatctacgaataaacaaattgtcacttgactgtttttaaatacgcatgaccatccacgaacttcttccataccacattgttgtatcaggtatgatttgatagtttcgtaccagttcgcaccactttgtttcaatccataaagcgatttcttcaaacgtattaacttatcattcattcctaaatgtggtggaggtcttatgtataattcttctttgatgtctgcatacaaatatgccgaagatatgtctaattgtgtaatatagtagttattgtctaatgcaagtgacagggatgtcattaatgcatagtgatgtacggtattggattgcatgcctgagtcgtaagtgtcaggatgttgaatatcacctctcgcaacaaatctagctttatgagtaccgtcacgtttcctgttaaagataaacattgaatttattactcttttggggtctatttcttttctgtcataatatctgtcagtgtcccaagttttcatcttcaacagttggttgacttctttgtggtatgcttcgatatatttttctttttctttaatatctttattataggtgattgcctcatcgtatcgtaaggttgttcgtattggtttgattgattttactgcttttacagctgcaatcaggtgaattcgtttcttcgatctcggaggttctaaactacgcatattcttagtattccatgtgtctcgtgataccttaatttcagtttcattatcttctaatgatcttttcttactgttgatagtagtataggcattagagtcaccaataccacccaaactggaattagtttgacgagaattgatcggtggaagttctttaaaggagtctgataatttggtaggaggttctggaggcagatcgggaagtggaagatcagcaattatagattcctctgtattctccttaggacaggtatctgacgttttgataggaacgacgtggtgtagtgaattactttctgatgaggaagtatcgatcgaaggtgaacggtgtataatccttttctcagtctcctgttcgcttgtctgcggaacagttttattattggtaccacccgtactggatattggtacgtttgtatgattagtctcattgtcactgtacgagtctgagtgtctgaaatctttagatttactggtgtgcgacgattcatgtgtgttatattgggacatgggagcaagtaaaggaacatctaatctatgcataccacccgaaccagtactctcgatatcggaaatttggggggtgctagatctcttctttgatggaaggatattagatttagatatgttgggatcaacttctctgggtgcgcgaatattggttttagaaacacgtttcgaatcttcagtatgagttgacggaggtgtggaatcggttggactcacagcttttgaaaggacatttctcggttgctcaggatgtagttcgatgtcagattggaagtcatggtcagattctatgttaagatcatcggattgttggatctcatttgacgcaatgaacgattgatatgaagcagttaaacggtttaagtcttcatcgaaagtgagtgcgtcgtaattgaattgatctaatctggattccttgccctgaagaataacatagttagttgtatctactgtcttctttaaggatggaagatagatgatatatccataagagtttcgagacggatgtagagcgtagcctgggatgccacgaggatgtattttggagttagggttgtgatcattgacgataacaggttgaccgaaaggtaacaaagtactgatatcaagtcctgccaagccagcatgttgtcttgcagattttttgcttttaggtgaagctagtgaatttctcacaatagtagaaaattcgattgcagagaaccataaatggttcggtaaaccactacattgcagttgagtacggcagtcatctaataaggtacggttgagccgttcagcgactccatgtgctcgggaatccgctgtggttgtatagcatggagttataccatttttttcaaggaatttatggagagttctgttagtatactcagaaccacggtccatttgtataaccaagacactggcctgaaactggttcttaataaaagctagtatcgtagtaaaaacatcgaggatagagtcctcgcgacggtcgtgtaatggataaacccaacggaattttgttgtctcatcagtaaatgagatgaaataggatggtgcactttttggtaggttgtgaactggaccaaatatgtcagtatgtaggtattgaaagggttcgtatgaattttggtattttagtcgtgaacctttgatatgtctgtgtttggtgcttttgccgattaaacaatcaggacattgatagtcaatagcactagaccagtcgacatctgattcgttaaaatacgtgatggtgttatttttaagtgagtatcgaattgtctgtgcattggcatgtgcaagcattcgatgaatgaaaggataaggatatttgcgtgtactttcacttgtatggacattattgatggtgggtacggagatatttgatggaagcaagtactttttagatacccagtaaaagtctccatattttacgataggtgcaagtacagtgccgtcagatcgttctaagacgtttttggtaaagcatgctgtgatatctactgcagccaattcattcaaactgagtaagtcataggctatgttaggagtgtgcaatacctttattgatgttttggtgttgtcctggaagtgaaattgtaggtcaccaatagcgttaattggtatatttcttttttgagcatcaactacgtttatgccaggattagatgatgctgagtgtatgtggtgagcagatcttataagggttcgtgatgctcctgaatcgagaaggaggtgtccagggagttcatcatcagaatgattagtgtgatttaccgtagattcagtaagttcctggcctaaggtgaaggtcgtgtttattcttcaattgaatcggttcagtagttgatcctcttatgagatcgttatcagggccggaagagttattagatgtggatacgttatgagccctggctgttcttgattgtgaattatttggtttttgggaattccgagttatggatttgggtttggttgtattcgtgtaggtgcgagagtctttcttctcatcactcggatttctcctataagtagatttattacgttttgattcctgttgttcttcatacatagaatgtatgtctgaaaacagatcagcaactgtcatatgtatatatcgatgacgtgcgtagcgtaaaaatttgtactcgccagatagacctctcataatgaattggcatgctaccttgttattgataggaatgccattgttgtttagtctgtcaagaatgtttgtgacttctgcttcaaatgcatctgcaggtgtgcttccattataatgcaaagttgctagggtcgtaatgtcatttacctcttgagtatcagattgcattttgttaatgcttttggaaagaattttcatgatatctgtataatcagcagataagatgtctttaacccaggtgggtaagaattgagatggagcaaatagttgaaaggtgtgacataagaaggtgagttcgtcatcagtcatctgacgtacggcttttcttgttgctgtcggaataatatcaccgagattcgaattttgtaaaaatttgatgtatgttttaacccaatttagaaagtcattaggtgaggttaacattggtggtggtctgacatattttttagtggatgtcatatcagagtccgctgaggatgaatcagtaaatgtattacctgactcaggtgatggagtgctcagaggcgttccaactgatgatggatactgcggaaactgtgaatgtggcccaggtggaaagtacataggcgacatttgataaggtgtatacggaatcatagatgggcgtccgtaaaatgaccaaccagatggattggcttggttttgggtcatcatgcactgctgttggtacggcccattctgtggtgaatgtgactgagcagtttgaggagaggcatgatgggggttctctggaacagctgatgaagcaggtgttgttgtctgttgagagttagccttagtggaagccttatcatattcttgaattttggaagctgaaacgtctaacggatcttgatttgtgtggacttccttagaagtaaccgaagcacaggcgctaccatgagaaatgggtgaatgttgagataattgttgggattccattgttgataaaggctataatattaggtatacagaatatactagaagttctcctcgaggatataggaatcctcaaaatggaatctatatttctacatactaatattacgattattcctcattccgttttatatgtttcattatcctattacattatcaatccttgcacttcagcttcctctaacctcgatgacagcttctcataacttatgtcatcatcttaacaccgtatatgataatatattgataatataactattagttgatagacgatagtggatttttattccaacagtgttaaagatctattagttgatcatgttggaataaaaatccactatcgtctatccaaacaattctctcaaaattcgcccaattctcaaaattcacccatttcccacacatatgtgttttaggaacgtttaggataaggaatcgtcatactgacgtacctcattttgagatacaacaaatcatatattataagactccatggccaagttggttaaggcgtgcgactgttaatcgcaagatcgtgagttcaaccctcactggggtcgtttattttttttgtatttgtgcttatttactaaataaccatttcaccctgttataataatgcttaaaagaagaatgtagtttttctcttttcctttaactgctttacttctcccgaaaaagcaagatgcaatcttttaatatgtttgagtttgcttaaagtatattcacaaaaaagaaaataaaagttaaaaatttctgaaaatcaggaccttattcgatagttggtcataaattgactgaaaaatagaataatttcggacaccaaatgaatcattaacaagacaatatcttaaggtatgtacaagtgagaatattacttatatataaaacggttaacaattttttagtggtccaaagccttgatgttcatgactttagaattagacacaactggcacccaatccttctctggagacagttcttctagctctatttctaatgagctcttttttacattctgttttaaaaagtgtctagaacccttattttgagcttctttgatatcttgtaagagtttatctttttccattactaggtaacctcttttctcttctttactatagaaatcaatatcccttcttttcgtgggtctagcctgtagtggtactcttcccctcttctcaagaaaccactgggggttgagatgtgcccttagacccaacggtgtgtagtaacgagctgtaaacttacctcctgctttttcaatagccgcaatagccttagcggatgctctagaagcctccaaagcaatcggtagattgtagtggaactttccgctggctagaattttaactccgtactttatgggaccagttaccagaccaagctttctcatcttattcatgtctaaaacctcgcctggttgcaaatgaagcctatttttatcatgaaaccattgaatgcgtttcaagtttaattcctttaatggtttggcgccaacgttggtaaatccaattttaggaaatagcttgtaaattggagtttgaccaccttcaaaccacgattttactttaccacgcgccttttgacccttttgaccacgccctgatgtcttacctaaaccgctggaaggaccacgcccaagtcttttgaaagactttgtagaaccatctgacggtttcaattgtcccaaaatcgaaacataacgataactttgaaatgctaataccggcgatttgaataaacctcggaaaaaaatatcgttaccagctacgctagttaacatcatggacggaacaaaagtgtttattagtttgcgaccgattacggttgtaaaactatttcttaatcctgtttgcctttccgctttcatcaacttctaaaggtcatgagctttaattttacgcactgcgtttagtgcagttacctggagtttcagccgggtaagaaaactatacgattgccaaatagaaaaacggatataaagatagtagctgtgaatagtagctttgtatagtacataaaggtaccttatctaacattgcttgcgacgcagaatacgcaaaatatactgtttaattgcaatcaggagtttgctacggtatttggtataatcggaactcatattgtcctacgttcaccgagaccaatgaacgcacaataaaatggatacttggaatgccctacccaaaatatgagctgcgtttgttttgtgaaaaacgaaaagtaattaagttgttttgcagaagtgtgaataattgggggacgccatttggtttctctcttctgattgattaaagttaatttcggcacaataacccaatgactggctaggaaacttctcgatgcatccgtgatctcccaaggacgaaatggtttttatcacgtcctaacgacatcatatgtcctcgaggagaacttctagtatagtatttattaacaatggaatcccaacaatcatcaaattattcaccaaatatacacagattcttatactaactaaagtaagaagattaggatttccatactcattttgttaagtagcacttgtatatccggttttctcaagttctgagcttctatggccaagttggtaaggcgccacactagtaatgtggagatcatcggttcaaatccgattggaagcatattatttttattctacggtaaacatgcctgatggtgatttgagacagaccccattgcctcagatttgtgaagaatagaaaatgtgtacattcattttgataaactatacatatacttaactttttaacatgataaatcaatattgatatggtcggtactgttcactttatctatattttttttctttcgtgcaataatcgtcggctttaataatattatacatacaaagggaaaatgaaggaaagaaatatgaaaggatgaataagtctttgatatgaatatgtagtgttggtatctaaacctagtcagcgcaaagaactattattggaatcctttgcatcatcgtaatcatcatcaccatctgagacattactcccaatatttgaactcacattatcggggttgacaatgtgtagttgtctttcttccatcatatcgggcagcgaagtagcactgaacctttggttcccgttatagatcgaaggaggctcctcgtacactaccgagggaaagtgacttcttttgctgatattatgtgcatcaccagtaataatagaatctctgccgcccggcgcccttgtcggcagatcataagtggcaaaagtagacgctgtattcttggacaatgctgtattattcctagagggtatgtgccagttagtgctcgaagcagacggtggaataacagggttagcgtcagcatcacccagtgagtacggctggtactgctttgtctcttccaagtccacatgctgagaagattggcgacgttttttccatacgaaaaagaataacgccagagccaacaaggcaactgtaccacaaaccacacctactacgacacctgcgatggcgccaccactcaagcctttgctcttggacgagctcgatttcccgtttaagagagaactagtagaggaggacgtagacgatactgttgcataaacagaggtcctggtggtaaagatcgtgcttgcttgttggttagcttgagaaaccacggactgcgtcaccacacgggtagtgtaatgcgtggaagtacctattgaagtcgatgagggggtagaagtgaccgttgctgtcgaagttgaggatgaggtcgatgtggtggatgaagaagttgcctgcgtagaggacgtttctgaactggaagaggcagaagtgctagaggaagtggtggaaggagaagaagaagtagaagtagtactagaggtagtagaagtagtagaagtagtagacgtagaagaggaagaggatgaagaagaggaggaagtagttgtctctgaagaggaagtggtagtggaggttgtagacgaggaagaggatgagtgcgtagcagaagaactagttgaagttttcgtgtccaatttcgtggacgtttttgaactaacacttgtgcttgatgaagatgttgtcgatgttgaggtagcagtagatgaagttgagtccgcggtagaagcagcgttattgatataaacgttcatggcagaagaaccaccacaattttggtagggccagccagcacacgaaacatcacatttgctcgaatctacctgcgtcaaagactgtaactgagctacggaaccaccacagtagcaacctgtaccgttgaaaagagcaacgacagcctgaccagggcattcattttgacagtaggaaactgattgatactcgtaaacacccttgtaagtcaaccccaattttcgtatatcactagctgaatagcaagctttatatgtgaattggtcagccaacgcggctcgtatatatatgagccacactaagatgaaggacttgtgtatgagatctaggtgcatattccacttctataatgctgttggtcaaaaagaaattcaaagaagaaacaattagaaaccagaaagtctgtaaaaatacaaaaaagcgtgtcctataaccgaacagcaatgtttgttttcactagatttgttttcttttggcgaaaaacgaaggtagaaatgaaagtaaaaaaagagcaataatggtaaatcaaaggctagccacgctttgagctatagttggtcgtgctgagcaatagtaaagaattgaaaaagcgagtggatgatttgaaaactgcttatatgttttacgttgagggtttctcctctttatttcttcgaaggacggaggacaggtataaagcagtcgctggaactcttttccctgacaatcttaaaaagaaagaccgaaacagagtgttataaaacgaaacaaaaaacctgctgtaaatgcacttctgggagaagtgctagatcacaacatacaaacatatgcaaattcatagtaaaaggagatagggcccagatgaccaaatcaagaatggctcactgttgaaacattctgcttaatgtcgaaacagtccgtaaacaaacacattcccacaaaacaccgcaccgcgaaaaaaaaaaaaaacaggaaaaaacgcgaaatgtccgtaactttacccggtaatagtcacgtgataaaggtgcattggtctagctggctgttctggccaacgcgacagcagggttcatactttcagtagaacaaaaatcgggggaaatgcgatgcactctttaactgcaattatgcacatcctattgccagggcggatatttgatgttgttctcagatatgtattccctgatctataccgttctcatagttcaattttctctgattttctcgtgcgggcaataagtaaaaaatagcatttgcgtgcttaagtgaaatttttcagattatgagtgatatagagatgaggactgtaacaagaaggaaggtgaggaaatcaagacggtaagtagcatgtccgggtcgttaaaatctctagacaagaaaatagctaaaagaaggcaggtgtataagcccgtgctagacaatccgttcacaaacgaagcacatatgtggccgcgcgtgcatgatcagccattgatttggcagctgctgcaatcctctatcataaataagttgattcacattcaatcgaaggagaactacccttgggagctgtatacagatttcaatgaaattgtgcagtatttgagcggcgctcacggaaacagcgacccagtatgtctatttgtgtgcaataaggaccctgatgtaccgcttgtgctcttgcagcaaatcccgctattatgctatatggcgcccatgacggttaaactggtgcagttgcccaagagtgccatggataccttcaagtcggtttctaaatatggaatgctgctgctgcggtgcgacgatagggtcgacaagaaattcgtatcgcagatccagaagaacgttgatctgcttcagtttccctggttaaatgctatcaagtatcggcccacatctgtcaagctgttgaaaactacagtgccaattgtctcgaagaagaggcaaaagtagacaaaattacccgcgcaggcctatttttctagaagacagaagaaaaaagtgggcagagaaagcgaggaaaaaaagaaatacatatgaagaagaaaaaagctgaaatttaagcaaatactttttggacaaaatcatcaaactactactaaagtttgaaacgatcggaaagttacaacacatttacgataaaatatggttgtcttgaatccaaataactggcattgggtggataaaaacaccttaccttggtctaaggactacttgaacggtaaattaacgagtttgtccactgtttcctctgatgggaagagcaaaattgagttaacccaggtgagtagcatcaccggtgactccaacgtatctcaaaggaagggcaagccgatttgctactttgacttacagttgtcgatgaacgtcaaagtgacaaatttggatactaataaggacgacgaggatgatgacggcatacttgcggacgggaaactagaaattccagagtttatgcatgacgagtctgatattccgattttgtcgcaagggtttgatgcttttgatggattggttaggtctgaatttgtccctaaagtagtggaaacgctactaaaataccaagatgacttgattaaagaacactcaaaggatatacaagtttgatgtgttcatgtaacgaaaaggggagcgttgcatagatagaccaccgccccttttaatttttccagcgttttcaattgttattcttcttcttcctcatactcacccaatacataacatgtatacacacatacatagataatgaagaaaatagcagtggtagaaaaacttaataaacatatggaatgatcttgtaaggaacttttctttcgtattcttcccaattttcgccatatttcaggcggcacttgtgctcatcacgttgttgacggtgtaataacaacgtggcgaagtacaacgagtagtaatatgtcaagggagtttggaaccaggtggccaaacaccaacttaatgaaatcagccaatcgccaaagtaattgatatgctgtgatttagcccaccacccgtcacataataactttgtaccacgctttgtctgaatactttttagattttctaatttaccttgtctaaactcagatttttgcttatttgccgagtggaagatgtggaaacccaaaaacattatggctaatataccgacaactttcacccatcccaattccacaggggaaacactcaagtaacgcgcttgtaatgagtaggtgaatggaactaaacttaagtcaccaaacgctagcatgaaaccaaacccatctgtagtgatatccatcatggttaatacaccttcctcgtttagtactccatcgaaaatgtaaaatccttgcaagaaattaaccaagaccaatgcatcgttgattttaccagtcttcaggtaatggtgatgcagacaggaaagattgatcagtaaccataacaacatgccgggtctcaactctgaaaacatcttgatatctaatgggccgagacgagggttcagttctctaccaataaaccaatcgtaaatgatgtttcctgaatttccacctagtgctaagatcttttcccttttgccattaccatttttcttgaagatcaatggtatgaagctggcaacatagcagtacgtcgccaaaaagaacgaaaacaaaatagatattatgcataaactaacgtgattttcatacagatattgcaattcaggcaattgtccatcagtcaatttccatctgatagccaaaactaagaccaaagttgtagacatggcaattccattgatcttatacgaaagcttcgaaccatcccttaactgaacacccttcatgactctgcccggtaaaatgacgtccaaaactgccagtattccataccacaggcaatagacagtccataattcacgattgcccagatagtagcgcaatggcttgataccgttccaaagctcaactatatcgaaattctggaaaaatcccttaataaaataatcgggccttatcatttgattcaagatgatagtgaaaacaggcagccctatgctgatgcctaaggcaccaatcagcccaccaaattcaaactctgtagttctgggattcaaagctgataccatccttttattctctacaccgaatttgtctttactcctatgctgtttacaaggtctatctgataagcaattgcgcaagaaaatagtagaatgaaaactgattattaaaaacaaacgtaaactcaagcctcacttgatgctcagacggagtacgtgaaaaacgtccgttatgcaaaaccctttatatgcacaaccttcacacaatgcaaatttccgatgatgcctacatacaaaagagcgaaaggcgatataaatttttttcacgggattttcgtttaggtgaaaataaaatgaacgacagagcatgcagagtccgggtaatacatatgtttcaatactgtttcaatactgtttcagaagtgcgtcacatattaattttaacttataactggcctgttgctggcaagaggtatatatatatgacgaatgtgaccaacataagtccttaagataatcccgaaatatttggttaggatgattccctttcgaatttgtgaacgttgatgatatgagcggttttaaatgctatttgcaattgggtgacaggctctctcaaatatggctaaataagtatactttggttttgctgctagcaatgctgaagcttctgtttttctccaaatccatacaacatgcgatagaagtctcggaaacgtatattttgtccaattgttacagtattgattcactatactccaagatgacagacaacacgccgcactatttaggtatcatggggaattatcttatcgagaagggtatggaggagactgttaaagctacgctagagacgttatcacttatagtatatgcgagcgaggggctggtaaactttgccattgacctgtatttgggcacttatgcctgtttgattgttagtgccgttgatggtaccgtggacgttgctactaacattacagaaaaactgattagcttagtcaatgatacagtttcaagtgtggctaatgaattggatacgggcttgaatgacatctccaaaataatcaataaagtgatcaaggccgcatccaaagtagagaattttttcacaggtgatgacgatgacagtaacatgacgtcgtcaatcaaaagcgtcaacttaaccatatctgcgcttcacaatttatacattccttcctcaatcaacgataagcttgaagagttatcggcaaagacgccggactttgcccaggttaagaatacaaccaagaacctgatctcggttcccttcaatgaagttcggaagaatatcaaggccgtgaatgccagcaatataatcggagatacctccgttttgtacgtacctcccgtgtcccttgacaacagtactgggatttgctcatccaatcaatcagaaattttggccttttattccatcttgggacatgtcctgaaaatagccaccgtagtgtgcattaccgtattgatatgcttcgctgttggtgcgatggcgcccgttgcatggaatgaaatcaagctctggaggcgcctttgcggaatgagagaccattacatgctgagcaggcaagattcgtatacgtccttttccagtgaaaacacgcacgaattgaaagatccatttagagatcctcctatacaaaatggccaatatgatgtcattgcaagctatcagcagtgctttcaaacatggaacacaagaatagcaggctggatgacaaatcttgttacctttggaaaatcaccagagaacattgacccaaagactaaacaaaaaatagaatgggtagtggcttatatgacctccgaaagagcactgtgtgttcttggaattggacttttgggaattttagtgtgcatatgccaatttgtcatgatagcactgttaaaacacaagataagccattcattgacttctaatgatggtgacggcgttcaaaatttgctgaagtctagcactgccgtcgatatagagaaccaaatgagcctttggagcgttcagactaataaatatataaatactacggagaccaatatcaatcaggaagtattcgggtggataaacacgacaacactttctgtgaacaatacagtggccaccatgatctctgatatagacacaactttagcagatgtattcaatggaacactgctatataacccaatgaaaaccgtggtcggatgtgccattgaaaataagctctacacaatagagaaggcaatgacgtggattcacgacaaggctcagctgcatatcccgagaattaatgggacacaaatcaagcaagctctggcaaagcaaaccgacaacagcactatacccactgcaagctccacttctgccgccacagaaaacttactggagaaccttgtgaatgatatgagagaaggacttttaaaaattctccgagcttaccaccgtataactctgggagaactcacggtagccttggtcattcttgcggtgtggctcgtacaattgcccatagctctggtaattctccgattacgtcttcgcaaagccacctttgactgattaattagttgatagactttttccgtcataactctatttaataatgatgaccaaaaagaggctcgttcgaatcatttcgcgttgaatttgaaattcgcggaggaaaaacacgcaaagagaatcggaaaccttatcgtcaaatcattgcaccttgcaatggtgggtaatgatacatcatcgcagtaacagtattcatatattcgtatagttaataagatcacttttcagttagcttatacaataaaagatattaccttttgtattgttagttgcaacatcctttttttataaactttgacaggcgatattacgtttgtcacttcggtttccccacacaaagaacacgttacttggcaaattcagctcttatgcgaattttttcaggtgacaacaaggtagttgattccctcgcctctaaccctggattaatgagtccatcgaattttggcggtgacttcggttcacgactaaaagtaaatgtaacatcaaaaaagaaacttaacgactcatcaccaacttctcccatggaaagttcaccagtttcacctgagttggtgcctattctaacactgctaaatgcacatacacatagaagatatcatgaaggcgtgtttttgattttacaagaccttaacaacaatggcactcatgcagcaaggaaatggaaggacgtatatggggtactgttgggtactcaactagccctttgggacgccaaggaactagcagaattcactgatccgtcttgtccggtctctgaaaagaaactgaaggaagttgcttccaaacccacttatatcaatttgacagatgctacactaagaactttggataactccgataatatcgtaatggagtgtggaaaaaacctcactaatgcattggtggtttctactacgctgaaaaaccgatatttcttacaattcggtaacaaagagtctttcaacgcatggaattctgctatacgattatgtttatacgaatgttcttcgttacaagaggcttacacaggcgcatttatttcaagtagaggcgcaaaattaggtgatatcagaattctccttacgaatagaaaatatgattacaaggattgggtcagcgtcagattcggagcaggtatgccgtggaagcgctgctatgcggtaatctctcaatctagcagtaagaaaaagggtcattttggtgaaataaatctttatgaaaatgacaagaaagtgaagaaaaaccatgcaatggctactattgtagaggcaaaggcgctttatgctgtttacccgtcctcccctaaactaatagattcctctacaatcattaaagtcgtaggttctgtgaaatttgaaaaaaaggagtctgctcaggaaaaggatgtctttattatgcccgagaagcatcaagctgtaccaagttatgacactataataaggtttttaataccggctatggatacttttaaactatatggaagaccagagaaattattgtcaagcaagaacgacccacattcacttttgtttggtttgccagttttgccacatatatactacttggaagtggaggatttacttccattgactaattctgtatcaagcttacactggtcgaataacgaatggaaggaacatatcagtgatattttacaaaggaaaatagcacaaggctactgtgggtgtaattctacttccaatattacttctcctctaccttctcctttccttggttcagcagacttatttgaaagggccgatggtgttttatcaccgaaactttcttacgggtctaaatcttcttcgaataacagctcgaagaacagtttgccaaagagagagcgtgtaaaattgtcatcttcttctgaacaggaccttaataactctgatagtccatctattaaacgtaaaagtcctccactagtgatatctgaaagtccacacaaagtccacacacctactgatgcatccttcagaacaagagtgacagaaggttcaccttatgcgaagcaaagacatcccaagccgtttgcgtcatctgtaaacgattcaccatcagacagagccaagtcgaggacagttccttacaataataacgacaggaaagcgaccactcctgagaaatttgaaagaggagaaacctcttgtggtaagaacgtggacgaaagtttggaaaaggtccggaatatgaagttagaaattcccgagtccaattttgacaagttcatgacagacaaaaatctgttgtctgtggattctaaatgctctaatgagaagaagctctctgtggaatcagatttgtctgcaatctacgaaaaatactccaatggtccctttggtcacactgagggtcttaacggatcttctgatgaaacttaccttcgttttcaacgggcgtcagttcattcagagagcaactacaattcaagaaaatcctttacaccaagtgacttttctaatggcaatgaggaagaacatgccgttttacaagaattaaatagtttaacccaaagaattaatgaactaggcatggaaagtataaattcaaactccgattcggacagaataaacgggtcatattcacaagtggattttggtaacaataacgacgaggacgatatgaacctgttcgacccagattttatggcacaagaccaattgcgtgctgaagaaagagactacaacaaggatgatagaacacccttagctaaggtccctgcggcctttcaatcaactggattgggcataacccccgatgacgatatcgagagacaatacataacggaacacagatcacgacatgaagtgccaaagcggtctcccgagaaaccctccaacccgctggaaataggtaacccatacgcgaaacctggcacaaggttgaataccactcacacccacagcaaaactgatcgtagcattacccctcagaggggccagccagtcccatcaggccagcagatttcctcctacgtgcagccagcaaacattaatagtcctaacaaaatgtatggtgcaaacaactcggcaatgggttcgcccaggaatccaaagacgagagcgccaccaggtccatacaatcagggatggaataaccgcccctcgccttcaaatatttaccaacgtcctcatccctcagatacacaaccacaagcatatcatctccccggaaacccatactcaacggggaacaggccaaacatgcaagcgcaatatcacccgcagcaggtgcccatgcctatcctgcagcagcccaatcgcccgtaccaaccttatgcgatgaatacgcacatgggctctcctggcggatatgctggggcagcaccaccatttcagccagctaacgtcaactacaatactaggcctcagcagccatggcctacacctaactcaccatccgcacactaccgtccgccccctaacctgaaccagcctcaaaacggtagtgctggttactatcgtccgccggcaccacaattgcaaaactcccaagcccgtccacaaaagaaggacggattctcacagttcatgccatctgcaactacgaagaacccatatgcccagtaactcgaccgactggttgtaattttacaaaaagagagacaattaagaaaagaaacaagcgccaggcttccgtatcccagtttttcatctcactttctgggcacgattgtaataatacttcatgataataactaaactatataagtagtgtctcatccgtaaatatacatttagacagattcttgtattttctccgggcaatttttaactttttttctgttagggcacatgacacttgcctattatggacagccagtaaagatgtgccatatattgccccctttacgctctctgccagtattagtgggaaaaaaaaaactgaaaaaaaaaaaatcgcagactactaataatcacgtgatatttcttttcactctcttcataaagttgctaaaaacacacaatcgaatgagcctctgagcagtataaattgtacttcaaagcactagtcatgaaaaacgcttacattagttcagtttgtcaaggttatgctattacttgtacttatttcttgctattgttagtggctccccacattgacgtattttcacgtgatgcgcctcactgcggaaggcgccacacattgcctgcaaaaaattgtggatgcactcatttgatagtaaactaagtcatgttaatcgtttggatttggcacacacccacaaatatacacattacatatatatatatattcaaaatacagctgcgtccaatagatgagcttccgcttcgttgtacaacctacctgctatcttgttcacggatatttcttgcttttaataaacaaaagtaactctagaacagtcaagtcttcgataatttttttagtcacagggtccgtctaaagtttctctttatttggaataatagaaaagaaagaaaaaaacgtagtataaaaggaatgtcgcatactttaaaatcgaaaacgctccaagagctggacattgaggagattaaggaaactaacccattgctcaaactagttcaagggcagaggattgttcaagttccggaactagtgcttgagtctggcgtggtcataaataatttccctattgcttataagacgtggggtacactgaatgaagctggtgataatgttctggtaatttgtcatgccttgactgggtccgcagatgttgctgactggtggggccctcttctgggtaacgacttagcattcgacccatcaaggttttttatcatatgtttaaactctatgggctctccatatgggtctttttcgccattaacgataaatgaggagacgggcgttagatatggacccgaattcccattatgtactgtgcgcgatgacgttagagctcacagaattgttctggattctctgggagtaaagtcaatagcctgtgttattggtggctctatgggggggatgctgagtttggaatgggctgccatgtatggtaaggaatatgtgaagaatatggttgctctggcgacatcagcaagacattctgcctggtgcatatcgtggtctgaggctcaaagacaatcgatttactcagatcccaactacttggacgggtactatccggtagaggagcaacctgtggccggactatcggctgcacgtatgtctgcattgttgacgtacaggacaagaaacagtttcgagaacaaattctccagaagatctccttcaatagcacaacaacaaaaagctcaaagggaggagacacgcaaaccatctactgtcagcgaacactccctacaaatccacaatgatgggtataaaacaaaagccagcactgccatcgctggcatttctgggcaaaaaggtcaaagcgtggtgtccaccgcatcttcttcggattcattgaattcttcaacatcgatgacttcggtaagttctgtaacgggtgaagtgaaggacataaagcctgcgcagacgtatttttctgcacaaagttacttgaggtaccagggcacaaagttcatcaataggttcgacgccaattgttacattgccatcacacgtaaactggatacgcacgatttggcaagagacagagtagatgacatcactgaggtcctttctaccatccaacaaccatccctgatcatcggtatccaatctgatggactgttcacatattcagaacaagaatttttggctgagcacataccgaagtcgcaattagaaaaaattgaatctcccgaaggccacgatgccttcctattggagtttaagctgataaacaaactgatagtacaatttttaaaaaccaactgcaaggccattaccgatgccgctccaagagcttggggaggtgacgttggtaacgatgaaacgaagacgtctgtctttggtgaggccgaagaagttaccaactggtagggatagataccacacatacctcaggcataacatagataaaccagtacatgtatatctatatctatatttatatatagacaaacagcattaattaactataacaaagtttctagtaacactaacggtagtagtagatttctcttttttgtcctcgttgttaaaaaacgaaagaagaatgaaaaaaaaaaaaaaaaacagaagagtaatagctagtgctttagagctttccacattttgaccgcacttgtagacagccactcttgcgttgccactcgacattacatgaacaactgttcttctccctgtagccttagcttacttcaaacttttttcgtttagcggggaaaatacatcactgaagtaatttttagatcactcgtggcgtaaaagtaagcatatcgcaataatcatactcatatcctttatcatccaaaaagtagtaatagcgctggcaaggcatgtcgaatgagagcacacgagttaccgttagtcgcggttgtacagcctccgacgagtgtgcgcaagcattggaacggacaaacgatgagctagacagagaatcatcggtatcagaaagtagaagtgatgaagagagccacgagaagttatcccgacgtcgattcccgacgctaggtataggcatatggctcgatttgaaggacagaataccgtattacaagtcagattgggtagatgcgtttaattacagagttattccctctattgttgacacctactttaataacctgctacctgcaatagcctttgcgcaagatatgtttgataggactgataattcctatggtgtgaacgaagtacttctatccagtgcaatggctggaattgtttttggagttcttggtggacagcccttatgtatagtgggtgttactggccccatctctatttttaattatacggtctacgaaattataaagcctttgaataccagctattttggcttcatgttttggatttgtatgtggtctatgatttttcatttagttttagcatttacgaacgccgtttgcctcttgcaatacgtgactacgttcccatgtgacatatttggattatttattaatgtggtctacattcaaaaaggaatacaaattttaacaagacagttcagtgctaaatcaggggagaaatcagtacaagacggatttgctagtgtcgtggtggcgctggttatgactgcgtttggtcttttctttaaattatttcattattaccccctcttttctcataggatcagaacattcatatctgattattcaactgcgctttcagtgctattctggtcatcatttacacattttggtggctacttgcatgatgtcaaatttaaaaaattgcctattacgaaagctttttttcctacttccaaagtcaataggcctcaaaatacttggctggcatatgaaccgattcctgttaaagacgtctttattgccctaccatttggtatatttttaacaatcttgttttactttgatcataacgtatcgtcgctaatggcacaaaggcatcagtataagctgaaaaaaccatcctcttttcattacgatttcgcactattgggacttaccacttgcatcagcggggttctaggaatcccggcgcccaatggtttgattcctcaagcaccattgcacacagagacactgctagttagggattcaaaccaaaaggttatcagttgcgtagagcaaagatttacaaatacgtttcagggcctgatgattctagggacaatgacaagaccgttattggtatgcttaggagaaatccctcaggcagtactttccggattgtttttcattatgggcatcaatggcctaatgacaaatagtattatacaacggttggttttcctgttttcagaccctaacagaagagataatacttcacctttaatgaaagtatccaagaagtcaatgctgatatttctttcctttagcctgacggggtttgctggtgaatttgctatcacaaatactatagcggccatcggctttcccttagtattgcttttaagtgtgttagtttctttctcgtttgcttatattttcccgactgaagaattaaagattctcgatactaatgtggcacaaaaatttaccattaaaaatttgttattggaaaatattcgtgatgcaaagttctgtgataagcatgaagactaaacgcagttaggatgtacaaaagtcaaccacttgtaatatatagaaattaattgcatatataagaagtataataatattatcgcatttcgaaaggaagaataaaactatggatcttgtagtcaaactaatggcttagattcattgggccagtcttcattttgtaattccggaacaatagtcaagactttcccggtcaatatcacattctttgcattttcaacgaccagttcttccattttctttcttgtttctacactatgtgtgcccatatgaggcagtcctaagacttgggacatcgataataactctttggatatttttggctcatattcgaaaacgtccaaaccagcacttctaatctttccagaacgcaaagcatcagtcatggcttgttcgtctatcacggcaccacgcgctgtgttaacaataactacaccatctttcattttttcaatagtctctgcattgattagatggtgagtattgtggttcagtgggacgtttacagatactatatcagaacgcttcaaaaactcctcgaatcctacatattcacaaccatgctcttcttcggaaggaagctggtgtctgttatgatatatgaaattctcgaacccaaacggcttcaatctctctaaaatacaacgaccaatcctacctagacccagtataccaactgttttcccttcagggtcgtatccaaagggagaaccacatgcgggtcctgcctccggccagtttccctcgatcaaccttctgttaccaataccgaagtttcttagggcacccaatagcaaaaatacatgcgtatcagcggtagcattgctaactaaatcaggaacattggcaacctggatgtgccttttcttgaatggctcaacatcaatttggtcataaccagcaccagtatgacatacagccactacggaggagggcaaagcaagagcaagctcttcatcaaatctaccggtgtttttcacactccttgctgttctagtaatgacttgtacttgggagagcttattttgtgggtcttttacctcccgcaaaaactgttctctagtggtggattcagggatggtaattacatccgcaatcttttccaattccccccaggcttggtcaccaaaggcatcctttcctaatttcaaaacaattggtttcttactcatattctcttctcctcttcttgctcgtttatgtattgttaatacttcggtattgtagagcaataatcatgtagaaggatttccctaacgtaacaacaaggccaatagaatttactttttatatgctcgagattagtgaaaaatgggataagattgccttgttatccccgccccctgccaagacttttgcagattttaagtccgctctcggtcctacgtaataaatgcctggagaagctctagagctaattgcgtcgtccttcaggaattctgaagaccacagcaacgcaatcagatggcggaaccacattatgaagccaagtgaggtgtatacagagttatacgtacttttcatccatccccgctcggtttcaccgttcataacgctggttttcactgccacttctcatatcaagtcagcgaaataaccagtagttgtcctgtatataggcatccctaccgtttgctttaggaagctgttctgtgttactatcacaactgggtagtgccctgtatgaattgcttccctgtggaaatggcccttccattatgctactttgacgcgtttactgccgcattacgcgtttacgatgaaaaattaaaatgagtattaaggatttttcaaatgagatatggttcgtaagtcgcctcacatatgataataccatctagcttgtggggtttagtgtatctttaatataggagggcgcacactatgtctgctgatttgcaacaaggcactacaaatgcggctgatttctctctgacggtacttagagcaagaattgctttattggcaactgccatcggtgggccggattatacttcccagatagacccacccccttataagcttggcgatgactgtttggcgtgcttaaaagatctgaaaagatggtttaaactagtggatgaccagcagaaaagatgggatgtggcaatggcagtagctgaatatcgcatcttgacggatgatctgttacctattctgatagattgggaaaacaaatgttctcttgcagcaaagcttgcaaagaacaacccagaccatgaagagtttagaaacaaagcttattacgataaaattgcgctaaattgtctacaactattggtccttatgacttggcctttaattgtaactgaacagtcttcatcaaatcaaattactctctatggtgagctaaagaagcatcaattggtatacaagaaaacgattctgtctatggaaagtggtaaagtgttaagagctgccattagattggctctggatgttatcaaaatcgaccgattatcaagaactcctagggacaatatggttctcaaattggttttgaattttttcagaaatgtcattgctatagaacccggtgaatttactatcaatactaagaaaagcatgcctaagaaaggtatcacatctatcgatactttgccaccaaacgtctctatggatgacatctctttaaatacggttatttcctcattccataaaaacaaggtattcggtttcctcttaacgctgaccagctccttatcaaaagagtttgaccaggactttatcaatatcccactgttggagattatgttctacttcactaaagatgttaaccaagaactgctattccctcgacagttcgaaaccgggacacattcaaaggtggtaaataaaaatgagagctcctctgctaataacattgttacaagtgcaggttttgaactatcgaagttattacaaaaggaacaccaaatgagaaaaaacgttatcaagcatacatctgcaagacactccagatttggtggtcttttatctatacaaacaccagataaaactaggttaactgtttctggtagccaagctctcgtagatgaaaaaatagcgctccaaaaactagatgacagcaaaaaatggaataaaagaataattaaaaagcatcaatctgtcgcagctgagggcttaccgaatagtctcttgaattcacaaaccggtaaagctatttttttcaccgaatcaaatggtaaacatttcaaagaattcatcaacaactttatagattccggctttaacatcttgttgcatagtgtgacgaactacttcacaactgagcaggataggatggtaactttggagcaagtcgaatatttacttttctttgcatggtttgttaaataccagttgttgaggtccaaaatcgacaattccgcagatataaagcaagtttcagaagccttgaaagaggtgactttcattctagtgtcttctcttttaagaagcgcatatgacctgaaaaattggacagtgacacatgctggtatgattgcatttaatgaactgttgaacctcgtttcccgtacaaaggccgctcaagaagaggattcgaccgatatagaattcattgtaagtaggcttttcagtgacgagagaatacaattactgtcaaatctgccgaagattggttccaaatactccctccaattcatgaaaagttgcattgaactaacacactcggtattgaaagtattagagcaatactctgacgataaaacattagttattgaaggcaaatcaagacggcaaaaaaagtttaatatttcagaaggtgatattactaaattgatagaagaagaaaatgtagatagagatgaagcgcttgatattctaacctcttctttaagaagtatagaagtcaattttcaaaaggtgcaagccaactatatgacagaaccggtaatagaaacgtacattaatttccttgaaagatttcgtgagcttgaggacgattccattaaaaaagtattttcctttttccatagagtatttgttcaggcaaaagaacaggcattgttatttagatttgatttgataatattattaagagaaatgctttcacctgacggattagatagaatgtctcgttcaaggaaatatgtgagtcaattttcagactacttcctcgccaggttgaagaaaaggttaaagaaatcacctgcttggtttgttggattacttttcccgccattacacaatagtgaagtaggattttaccaaagatatggtgaatataatgtacttaataatgaatcaatgtatgccgctcctgcatcacagttcaaaccaattcccgatgaagaagccttaccaccttcgattttgttggatatgaaatatggtgttttagtttccacattacttgatgatggaaaaactgaactattggaccaactgctcaagcatataacccacacactagatatttttaagtcgtggctaaccgtaaatgttaatgctgggaaagaaacagttaatccacccaatgaatatttcacattgacaggtgtactcaacaacgaccctatttttaaagataaggactacagggctttattgttgctgataggatactccattccacgtaaaatcaatgaaccttgttttttaccggggactgttgaagtttctgacctgactgtttcttgtgaactagtgaaaaaatacttatcaacaccatttgaaactccaaacggactgccttcttcttcctatcttctacgagttcgttcagaaaaggatagtttttctcacaatgaacaagatggatgggaaggagacgatgattatgattacaacgatccctacattgttccagatgatcaaattttatcgaaaagcgacgcagcatacttcaaggatttagataacaatgcatcagataaacttaaaggtaccaaattcagtaaagggattgcgagatccaaaaaaaaagataagaggaagcgtaggaaaggagaagccaagactaatttgccaatgtttggcgaccaggatgatgaacgacctcagaccgttagagaacgccatggcgtattcagtaaagagtttattagtgattcagaagatgacgaggatttgatgaaccctatattttttgaaaacgaaacatatatgagatggttactagataaaaacaatggtcagttgaccgaggatagatatatccagtttgccaaatttgccgcggaaaggatgaataatgggggtgttgtgacaggagattatacgagcttgtttggtggatccataccaagtattgaaagcataagagctacagaaagtagttcctttgcgccagataaaagcctcatttctttagcaagccacgtggcatctgaaatgtctattttcgatgtaaataataacaataataatcaactctctgatgacgatgtcaactcggaatcaagaaatagtttgggctcatcacagccatcaaattcgcaaaatatgttccaatctgaggtgtatagcagaaaagaatctacaaagcgttctttggaagcgagtgcagccgatgaaagcgatgaagatgaagaggccatccgcctttttggcaaaaagtctagagttgttttgagccaaggtgatagtgatgattgagaatgaatatgtagtaattaatccctttaatacgtgtaattttagaaccacttctttactctgtttttaagttcaaagtattgacataatattaaaacaatacatgcgattcattctttatcattacctatatttttctaagttgttgaacatcttaaggaactcaaatgtccattaggacacataaaattaaatattatataatttattgctgttcctgggcatcatcgaaattgtcatcattgcttgaagacgcatgcaatccgctactaggactattttcccctatttgttcttgggttttgtcgcctatcgtcaagtttgtctttaaagttttttcattattatccttcttagagttctcgtctccagaagatgccctcttcgaggatatattttgttttacattagactcagcgttttcaaattcagtctgatcaattgcgctttcttctctaaattgctcttctaaatcatccaaatcttggagtaacttcttcttttgtatcttgcgttgaggagcctttttctttattatagaacgaccttttttatctccgcaatcgctgttttcttcattattatttgccgacttaatgctacttttgtcatctttcgttaccgtgtcatcaccttcaccgttgtctatactctctggtgaactagaatctgcgctacttgtagtagaatctgctagagaagattcatcttctgatgaactatctgcggttgaattatctgtggaagacccatctgaagaggattcatcacttgaagattcacccgtaatttcattttccatatctccactttcaaagtcaaaagcgtcgctcttttgactttcttctgcgctagatgaagaaaaaggtctttttgcgtcctgcttccaaagagctttgtcctgcaagcgaaccgatatagcatcgttttgatcctcatcgctgtcatcctcaactaacggtccaatttttgaagaaattgaatcatccactgcccatatgccaatatgagtccaatgaagtatacaacgcaatttacacaattgcagccatgctctttgaatattagtggtaggttgtcctggctttgcatttgtttcagaagaaaaaatctccatctttggcttattttttgttgaagaattgataccaagtcctgccataaaacttaaacgtttggtttttttgtcttgagaagaaaccctgccgtctcttttggtatgcttcgttacttcagagaatttttccaaatcttccttggtaatgttctgcgtcgttagcttttctaaatgccatgcgcctaccttcaatgatctcaggaaagcaaagatttcacatgtctgccgcaactttagcaaacaccaatgacacaagggatacgtattcgtaacttgttctttaccgtcgtcagtcttgtgcaacgttttcaatatatacatccttgcgtgttcgataatgtcatctctagattctccacaaaaggaacatgcggcgtgcactgcaactggaggtgaatctaagggaaacttgaacatttttggcatattcgaagtggcttgctttgcagggctacttgagttgtagccaatttggtaggttgcattaacgccgcttaggggttccacgaccaccaaaccatctataatcaaggaaagtagggtttttttaaccaaccagccgatgcctgaagcattatcaatcttaagtataggctggatttcatcatttaccaatcttcgtattaactttgattcggttgaagttgcctttatgttttcacaacggggtagtgcagcgacaaattttagaaattcattgtaaaggcttatatcataacgaatagatgaaatgcttggcgagtacacaattccgctataaatatcttgggaagcaagagaatatgaagttggaactttattcaaagaagtgctagaagaagttgctgaatcactcaatattgtggaatatctgttcgaattatttgtgactgtgctttcattatctaaactatgcatcacttttttcagattcttgagctgtagggtcaaagtatccagtaatgtgtccttttcacgcagttgttcagtgagtctcttatttaagatttcgatagcatatttctcctttctagcatcagcaaccatattattagcctcatcaaagagggaagcagtcagatcctcaacttctttatttagtttatccgcttcctcttcagctttagttcgaagctcattttctttggctatatcttcacgcaatcttttcacttcgtcatctctgtctgacaattctctttttaaagtgttgtaatcttctttcaactgattatagttttcaattgctgccttctggctggctattgtttttaaggatttattaagctgttcttctaagtgtgactgtttatccacgctctcgatcaattgcgtagacagggatgtaacctgtattgatactctttttgcttcctcagaagcatccatattgaaacctttatcaaacacagctagtaaaggaaaatatatcccagtgaactaaaggtcaaaattttctacaacttttggatggaaatcaacgttgctacagctgcaagtgacaaatgatattattgcacgaatcactgtgcttgtcacttaggtaaacgagagccatgttttaaaggtgcttcagcgaacgcagaaatacaagttccgggtagtcacatggaaacaatggcacataataaaaggaattatttcaaaaatgcaatagtagagatcatttgagtaaagatgaatgtaaagtgtatcataagtgatctataaacattaaaattatatatatatatgtgatttaatgattcgtgactatttctttgtactagtgcttgtttggatgtttgttttggtattactgttgtcataattttttggtttaatattttatttgaaacttagcctgttacctgtgctagcctcacctatggatctttccttgcgggccctcaatttttctagatgttcatcgagtatggaattttgctttactggtgtgtcagagcctcttagctcctttaataacattctagctctgtcactaatttcctcttgatcttccagcgcagatgtcttggatggcgatggtaaatcttcagaggtattcataacaccccttgtggcaagcggagtgggtgattcagcgtgaatcactgtatcggcagtagggtccatagcttctggagaataaagaatagacccttcttcagtatccaaatcgttgagtaattgtggagcgttgtctttttcagaaagatattttttcctcactagggctctctttctggcggaagatgggtcacttttagcaggacctgcatttttcaactgttctaatagtttatccataacagcgcgcctatcttctgcttcatcctcttcatttccttcagatgaaggcgaattgctgttctctttttgtttttccttttcttgtgcccttttttgctgttcttccactattttcttatgctttatataaagtctttcttcttcttccgcggctagattttgcgcttgagcttttttgtattcatttataaaatctgcaaatttcttaaagaatgagatttttgcaaacttatcaccagaatcttcaccgtacgtatgcatcagactttcaaattccatgatagtcagcttaacttcgtcttctaacaagtcccccttttttctggcttccggtaacacgggcaatgtttttatcaaaactttatctaatggatgaaactttgaggaatcgcttaaattaccaatttcaactgaacgctctacgtttacaatcgattggctaaagtccttacagtcgttaactaactgctcaatggaaactttcacgacatccaatacaggttctaattcacttagaaagtcattgaagcttggataatttaacctgacaattttttcgacgtaatttagaaaggtcatgctattggtagtatccttgataaacgtcaacctctgcaaggttgaaagtttgaaaccttgtgcctgcttagaagtgtcgttcatgaaattaccaactgctaagataacattaaagacattgcgcaagttatctgattcttgaagcgcgctaacagctttgtcgacttttcttaactttgccaataactcattatattctctttcatacgaagtaaccactgtgagagctctcatacgtgaaccccagtatgattctagattaaccatcaattgcaaataaatttggtcagccctctgtaaatcgtttggatctttttcagggggcttggcatcttcgagattcctcacgccctcccagtctgtcgaatacggggcgtaattcctagctaaattaacagaaacttcaattatttcagattttgacaaaaactcaacaacactcggtgtttgcaaaaaatccctatcgcagtttagaatctttttcaccagatcggcaaccgaaagtgatgaatacatatgcaaattgataccaaactgttgagaaatatccctggataaaaatgtaattttctgcagatcttccttgcgcttgcttgctaatgatttaatttccctagcggcaaaggccttttctaaatcagcaagaacacccttttcgtataagtcatctgcgaacttctcagctttacctgtaccccaaatagaattatcagtacaatctaatttttcccaatgcagttgctttaatttcttgtgtggacgaggatacttttcaaataatgagggcgattgaggaagtaatggtgatgttacagctgatttgatttgcgatgccggcatcataggtggagctggcggaatgacgccatcagtagatgaagataatacagatggtagcggcggcggtggtggtgtttctcccttgggtttgccgaacaatgccatgggtggaggaggaggtggtggtggtggagggggaggagcaggagaatccccagtagtttcttgcttgacagtgtcgtcttccgactttttctctttctccaacgattcaccgaacaatttggcgggaactggaggaggaggaggaggaggcggtggcggctgtgaggagagtacagatgattgagtagagagatcttctgcgccatctgtattattcagtttactcacagcgctgaaatccgctgttttatcttcttcatgatttaccacacgcccttgctttccgttttccacatgttgtctcatgtctttctcagctttgtcaaaggcggaagctgcacttgccgtgctgttttccggtaaagattttttatctagaccttcatcttcattttgttcatatggttcaactttatttaccttctgtgttaactcctctaaatatggagcagaagacacggtggattttctgagtctgttcataaaggtcttttcaactttactatgtagaggtccaatacccgaaccgttattgttctctccaaaagcagccgatgcagtaacattttgaccagtaccatatttttgagataaggcatcgagaaaagacccaggacctgatcctgaagatagctctgagtgttcgctccttagttcttgagttggagatgcgtcttggtatatttcctcactttcatcatcagaacttgaagaggaaagatcgctttccccatcttcttctacttgtatttcgtgttcggtttgagtctgaatatctaacaactggtccgttattctattaatctcgtctaactttttctgatatgtcttagggtcaagactggcatagttagcgtcttcttccgtttccacgtccccagtatttttctttggactgtccataatctcgtcgacattaaagtcaataccaaatcctttgtattttgtttctagttctttcagtctctttaaagccagagatttcttttcattaaatagctcattaacacgttcttcgacgttaaatttggaaatatcattactttccatttggatttcagtcaaagcccgccttaggtcatttagtttatttacgtccgcctcttgaggcttgactaaaggtttcctatccttatttttcatcttcttcactttgggcttcttaatatgtattggaggttcaagacgatctttctcaaattcagcaaaatttgtcatctctagttgcctggcttcattttcaatattttccatttgcattcttaacatttttaatctcttattaggttgaagtgtcatgccgaatttttttgaatcatccttgtaatccttttttgctcttgataatccgtcctgtaacaccttttggatattcgctttctctgaagaatttaggctcgagttcatacctctggtgccttcattcttattgaagctttcttcaggcctcgaattcaatatagtcaacatttttctcaattctacctcttgctgatgcttttccaaaagatgcttctttttcaactcttctaactcagcttccagctgctgcataactctctgattcttagctaaaatacgatctctctcatgcaactcatcttctaactgtccaacgagtccgtgctccgccttgcttaacttttcacttaaagaatccctttctgcctgaatttcttccaatttcttcgttagagctctactttctaatatagctcgacgtgcaacttcatcagtctgcatggcatcgtaaagccgctggatagccatattcatattagtttcttcatcagaagttgaggcaacactaacattagtcaccaaagaatccataagtttcaattgcttagtaagtttagaggaattttggttttcttctattaactttgaactagaaaggaaaagatgttgaactaaagatactaaaagcttttcattctcggtacctttacatatatcccaaaggttttttaataatgatagtggatcgtgtaaatctacattaaaagccttattgttggcctctaatttaacgttaaaatcgtcaagtttattattgtcatataactcaatttggtcaattaccttgtcgtaatctagcagttttattttgttcataattcgtaaaattccacaattttctagtttcgtccttaatagcattctttgatttatgttatcagagcaagagcataaatgattgataaaaaccattgtccattggcagtattctagaatcgcattttcacccccaccatttttaaattcatccgacgcgcctactaaggaacccatttttcctcttccatctaaagtttgttcaacggcaaataaccaggcttgaataattttcaaatgactttccaaggttaaatgagagaaatactggggcatttttttgaagttttgaatcatatgaagattttgccctatcctaaactttttatctagtgaggtaagaactgcttcgaatctgcttttattttttttttctagcatacaaacaaaaatttcagtggccattttccttgtggccagtttcgtagagaataaaccttctgcaacagtatcagtcattaacctatgtgtactgaactcatacaaaccttgtgagagcattgataagactctgaagcatttaaaaaatgaattttctttctctaataattctttagtcaagttttctcggggtgcagtcttataaatagagttcattagtacattagccatagcaatgtgaccctgatggtctataaaagcgtctacccagtctaactgttcagttcttaaagttacccataaatctttcatctcatcgctagtaagtttgtctgccaggattcgttgcacataatgtatcggtggtctgtttgttctgtctcctggaagagtagatgcactcgtattgttctcagccccacctctataaatattgtttagagatggctgctttttcaaactcccgctcactaattttttccccttcgaggttgacgtacctaccgatgaaagagtagtagaatgatttaaactgttgctgtatacagttgaggtgggagaagaggcgcttgtcatcaaaacagatttgggagacgaaagagatgaattagccgtaaggataggatgatggtccgacgccatcgaagttctggaggcagtggaagaagatgtagtgtttgctcgcattttttttagctcattttgtaaatcctgcttaacaatcagccatttcttctcaatgctgtagcccatcagagcttcttgtttgtcctctgataaagactgaaaaatatttcttttatacataatatcttcaaacaaaacttccacctcgtatgggtccgacggcatttctaaataaattttaccatcgggtgtagtgaatttgctcaagttagttagcgaaccttgagagagaagacttgatgcggagtgactttgcccggtatgctgccttgttagcttattggacgcctgtgaagaattcctcttggaatacgaatatttcgattgcattgaatgcgaccttgcgtgctgtgaggatacgggaacatctccacttaatttaccattcatatattgagacaagttttgtgtgtttaatgtcgattttttattcaacggcctcgcctcagtagatgtagacctagaaggtgcattcagttttctaaaagatgacgaagatgcaggtgaagtggacacttcgtttcccactggagagtgctgttgttgggatgcataggtcggagaacccgtattgctattcgttgcatttgagttagccaaacgcttcaaattttggaatataccagaactcgaattcgaatgactttcctttgagttcgaatgtttggagcctgaattcttcaacatttcctttccttctcttcctttcttgcttctcgtttgttgaaaaggttcaggtgccttctttatgtggcgtgtatttagaatttaactaggcttgagttaaaatgtttctcctcaatacagaagatagatacaaatggcaaaaaaaaaagtaaaaaatggcccaactgtatgagacgtataaaaaacgtgaagggtgaagaaaagaatgccactgtccaattttatgcttaatacgaaaataattaacacacagccgtcagtgtcctcttatctgtaggaagggtccgtgctattgttcttaaaagggattctagttttccacatctgttttttctttctttccctcttccacgtcaaaaacttcctctaaccgatgtcgggtaagccatggaaattacgggcgatgactttcggcggctaacaacgaaacaactagggagtaatcatataatcacaggaaaagagttgagcaaggatttggcaaatatacatatacatacatacatacatacatacatatatatgtgtgtgtgtggtatggagtattattctaaaattatgaaaggacatcccaaactcgttgccaccttgttttacattctggctctatccataccaactcctctatttgccggcggtcagaatcgatatcgatatcctgcagcttccagagtaagcggcacttaaaccaaacttggaatgataaccatatggccaaaaataggaatattgatatatatgcagcgacaaagtctataggctgaaaagtaggtgcgaaagcggtgaagccctggatcagaacaattagagcgatgaaaaaagatgcataatatgccaaaaaaggcatcatttgagctttataaggtaagtcatccctcgatataccacgtttccttatggcttgcatgaaacggatatgagaaaatgaaatcaaaagccaggcaaagaaaccggccacaccagttatgttcaataaccagttaaaggccttgccgctgcctgcagaaacctctaagaaagccaaaaatccgaacacggatgtagatagaacagaaaagtatggaacaccacctctggtcacgttagacaagaaccttggcgccaagctatttttagacagactatacagtactcttgagccaatgtacacattagagttacctgcggaaagaatggtgattagcacgaccgcgttaaatatatctgggagaacttttgtgcctgaattctcaatgcttatcataaagggcgatgaagagacaaatataccgtcactatccaactttgggtcattatatgggaccaaaaggccaatgaaaaatagtgaaagaatgtaaaagactagaatcctcactacaactttctttattgccctcgggagagcttttcttgggttagccgcttcaccagcggttatcccaaccagttcagtaccttggtacgtaaatgcagcattaatcaaagaggaaacccatccgagaaaacggccctcatttttatcactggagataatgccaggcccccaggctcctggatttctccagtacctgaaaccgatgggtccatcagattgtcccgcaccacacacaacacagaatgagaaaatgataaaaccgagcaacgcgatgacctttatggaggcaatacaaaactcaaattctccgtaatactttacgggaaacatgttcattgaagttaacaggcaccaaaagatcacgatccaagccgctagaggcactgcttctgtccagtactgaataactttccccaaaacggatagttccagtgcgaaggtgaaacaccacgacagccagtacatatatccgttagtcgctcccagcgctggcgacagaaatctttgggcgaagacagaaaatgaagatgtaaccgggataaaagtgaccatctctcctaacgattgtgtaacggagtaaatcactgtccccataaataaatacgatatcaaggcaccaacagggccggcgtgtgccaatggcggaccaataccaattatgaggcccgtcccaatggtgccgccgagagcaatcatccctatatgccgctgctttaacttccgcttcacctctcttctttcttgtggtgagctctctgtttccttagcagcatcatcctcgacttttctctctgtggtgatggccttcgtaacgttctccccagaatattgttcatctacaaactcctcctcttttattatagagctagaattgatttcatactgaccttccttggacatttgtatgttcacagtttcatccatggcaataatcgcaacactacaattttgccgctaatatatgtctattgtgctacggaagagtaacaaaaaaaacaaaaactgcataacaagcaagttttatacaatacacattataaaaatttctactccggtgttccgagctcccattgccattggagaaagcccttatgtggagtggagctgcctacaggttgttttcaggaaagacatggttacaaaaaagacgacattcgcccaacttatcactcgcttgaaccactttttatgccaagcccttaaacgccgcgactcaaaaacatacatactgtgccgcacggcagtttttggcgctatgacacccttttccccaagaaaatcgcatattaacaacaaattacccatgcaacccaggaaaaaaaaaatagtcattatatacgtagtgcgctttcattgacaactacatttttgtgcaacttttggtacaccgctacacgtattgaaagcgcaaaagactatagctcctccagcagggaaaactcacatcggtgggcaacaacatagaatatgtcaaagttgtaaaaacacccacgagtgcataccacttttcaacattaccggggaaaaaaaagtttgcacctcgttcccagaaacatacgcaggagtgactgcgctagtgacagattgctctttccgttggaaaaagaaacgactttttttcgcaaaagtacccgaaatcctcggaattttgcaaatagtcgatgatcacaattgttaggtgactatttaacaaggacggcgaggagaactgaaaaaaaagcaacctatccggcctcctctagttacacaaacaagacaaagaaattgcattgtctataacgataacaaaagacatcgtatatatatatatatatgggcaggtttagtaacataataacgtccaataaatgggacgagaaacaaaacaacattggcgaacagagcatgcaggaattaccagaagaccagatagaacatgagatggaagcaatagatccaagtaataagacgaccccatactctattgatgagaaacagtacaacacaaaaaagaagcatgggtcattgcaaggtggcgcaattgctgatgtaaattcgataactaattcgttaacaagattgcaagttgtctctcatgaaacagatattaacgaggatgaagaagaagcccactatgaggataaacacgtgaagagagccttgaagcaaagacacattggtatgattgcactaggtggtacaatcggtactggtcttttcgttggtatctccactcccttgagtaatgctggccctgtggggtccctgattgcttacattttcatgggcaccattgtctacttcgttacccagtcacttggtgagatggctacgtttatccccgtgacatcatctatcactgtcttttcgaagaggttcttatcacctgcattcggtgtttctaacggctacatgtactggttcaattgggctattacttatgctgtggaggtttctgtcattggccaagttattgaatactggacagataaagttccattagcggcctggattgcgatattctgggtaattattactttgatgaattttttccctgtcaaagtttatggtgaatttgagttctgggtggcctctgttaaagttttagccattatgggttacttgatatatgctttgattattgtctgcggtggatcccaccagggccctatcggtttcaggtactggagaaatccaggagcctgggggccaggcatcatctccagtgataaaagtgaaggccgttttctcggatgggtctcctccttgattaatgctgcatttacgtaccaaggtactgaactggttgggatcaccgctggtgaagcggctaacccaagaaagaccgttccaagagctatcaataaagtcgtctttagaatcgtactattctatattatgtctttgttctttattggtctactggttccatacaacgattcccgtttatctgctagttctgctgttattgcatcatcacccttcgttatttccattcaaaacgctggtacttatgctcttccagatattttcaacgccgtggtgttgattactgttgtatctgccgctaattcgaatgtttacgttggttcccgtgttctttactctttagctaggactggtaacgcaccaaagcaatttggatacgtcaccagacagggtgttccatatctcggtgttgtttgcactgctgcattgggtcttttggcattcctggttgtcaataacaatgcaaacactgcatttaactggttgatcaacatttccactttggctgggttatgcgcctggttattcatctctttggcacatattaggttcatgcaagctttaaagcaccgtggtatttctcgtgatgatctgcccttcaaggccaaattgatgccttatggtgcctactacgcagccttttttgtcaccgtcatcatattcatccaagggttccaagcgttctgtccgttcaaagtttctgagtttttcacatcttacatctccttgattcttttagccgttgtgttcattggttgccagatatactacaaatgcagatttatttggaagctagaagatattgacatcgattccgacagaagagaaatcgaagcaattatttgggaagacgacgagcctaagaatttatgggagaaattctgggctgctgttgcatagtcacagaacctcttgcatgccttcaaaatagaaaaaaataaaaaaatagacgtttcattaatcaaaatagcctgtagagattttgagggattgccccaaactttatgtataatatcaccacttattattcactattcatagtatgttacatcataaggccattgtcaccttcggccagcgatagtactcaaatctataataaattttccatattatcctttacgtacttgatagcgtgtataacagggtcattattcacgatatgttcaactgttgtcattttcgtgttattgcactgaaacaaaagaaccctaccaaaaaattcgttagagaaaaactaaaagtacaagatcttatactgaagacccttcattttttaggcccaacttctatattaagaagatccctggaccctgctagaaattttcaattagcttatcatttttcttcattgcgagcgttcgttttcattaagcattcgttctcttcactatgcataaagcatccagttcaaagaaaagctttgatgatactattgaactaaaaaaaaatgaacaattactgaaactgatcaactctagtgaattcacccttcacaattgtgtggagttactgtgcaaacactccgaaaatattggtatacattactatttatgtcagaaattggccacatttcctcacagcgaactacagttctatattccccaactagtacaggtcctcgtcaccatggagacagaatcaatggctttagaagatttactattaaggttgagggcggaaaaccctcattttgcactactgacgttttggcagttacaagcgttactaacggatttatctactgaccccgcttcttatggcttccaagtggctagaagagtcttaaacaacttacaaaccaatctctttaacacaagttcaggtagcgataaaaatgttaaaatacatgaaaacgttgcaccggccttagttctttcctctatgataatgtcggctatagcattcccccaattaagcgaagtgaccaaaccattagtggaatctcaaggtagaagacaaaaagctttcgtttttaagttggctagaagtgcaatgaaagattttaccaagaacatgaccttgaaaaataccctactaaacaagaaaacttccagatccaaaagagttagctcaaatcgcagttcaactccgacttctccaatagatttaatagatccaataaaaactaaagaagatgcatccttcaggaaatccagacatagtgaggtaaaattggatttcgacattgtggatgatataggtaaccaggtctttgaagaaagaatctcatcttcaatcaaactcccaaaacgtaaacctaagtatttggataattcatacgttcataggacatatgatggcaaaaatataaacagggacggaagcatttcaaataccgcaaaggctctcgatggaaataaaggtgattatatttctccaaagggacgtaatgatgaaaataatgagattggtaacaatgaagatgaaactggtggtgaaacggaggaggacgcggacgctttaaactctgatcacttcaccagttctatgccagatctgcataatattcaaccaaggacttcttctgcttcatctgcttctttagaagggacacctaagttaaacaggaccaattcccaacccctttcgcgccaggcattcaaaaacagtaaaaaagcgaattcttctttgagtcaagaaattgacttgtcgcaattatcgaccacttcaaaaataaaaatgttaaaagcaaattattttcgttgcgagacacaatttgccattgcgctagaaacaatatctcaaaggctagctcgagtaccgacagaagctagattgagtgccttacgagccgagttgtttctattaaacagggacctaccagcggaagtagatatccccactttattgcctccaaataaaaaaggaaagttacataaattagtgaccattactgctaatgaggcacaagttttgaactctgcagaaaaagttccatatttactcctgatagaatacttgagagacgaatttgattttgacccaacaagtgaaaccaatgaaagattattaaagaagatcagtggtaatcagggaggcttgatatttgatttaaattacatgaatagaaaagaaaacaacgaaaatagaaatgaaagtactcttactagcaacaacactcgatcttcggtatatgatagtaactcgttcaacaacggggcctcccgcaatgaaggtctatccagtacctcaagaagtgattcagcgtccacagctcatgttaggactgaagtcaataaagaggaagatttaggtgatatgtcaatggtaaaagtcaggaacagaacggatgacgaagcgtatagaaatgctttagtaatacagagtgccgcaaatgttccaattttacctgatgatagtcaagacagaagcccagagttgaactttggctcaaacttggacgaagtactcatcgagaatggaattaatagcaaaaatatacatagccaaactgacgctttagcagaccagatgagagtttcagctgttatgttagcacaattggataagtcgccacaacagttatcagaaagtaccaaacaaatccgcgctcaaattatttcatcaatgaaggaggtgcaggataaatttggttaccatgatttggaagcccttcatggaatggcaggtgagagaaaattggaaaacgatttaatgacgggtggtattgacacttcatatctaggtgaagattgggctaccaagaaagagaggatacgtaaaacttcggaatatggccatttcgaaaactgggatttatgttctgtaatcgccaagacgggtgatgatttgagacaggaggcgtttgcataccagatgattcaagcgatggccaatatttgggttaaagaaaaagttgacgtttgggttaaaagaatgaaaattttaattactagtgcgaatacgggacttgtggagaccatcacaaatgctatgtctgtgcatagtattaaaaaggctttaaccaaaaaaatgattgaagatgcagaactagatgacaagggtggtattgcctctttgaatgatcacttccttagagcttttggtaatcctaatggatttaagtatagaagagcacaagacaactttgcttcttcgttagccgcatattctgtcatttgctatctcttgcaggttaaagatagacacaacggtaacattatgatcgataacgaaggccatgtaagtcacatcgattttggatttatgctatcaaattcacccggctcagtgggctttgaggccgcaccattcaaattaacttacgaatatattgaactgctaggcggagtagagggagaagcgtttaaaaagtttgttgaactaactaaaagttcgttcaaggctctgagaaagtatgctgatcaaatcgtatcaatgtgtgagattatgcaaaaggacaatatgcagccttgtttcgatgctggcgaacaaacaagtgtacaactacgacaaaggttccaattggacttatcagaaaaagaagttgatgacttcgtagaaaatttcttgataggtaaatctttgggtagtatttacaccagaatatacgaccaatttcaacttattacacagggtatatatagctgagaaggaaaatagctgtgacagaactggaaaaacaatttgcaaatgtccggagaacaaaaaaattggaattttagtaaaaggaatatacatatatttatttattgccgagaataatagagcagctgactcagaaaaagcaaggtaaaagaatgagagtaaaataaatatgtggttaattaaccatacatataaattattatcttattttctgcgtaaagcgtcaaaccgtttcttcaactcatctagttcatcattttcttgctccttcttagtctttctttttgtagttttcttttctgattgtttcttttcgatcacttcctttttgatatctttcggaatcttgagctcgttcttgatattttcactattctgcctaggctttttaacagtgatagggtgtttagcatctgcattgtcattatcgtcattatctaaggctaaaataggcttttcttcgtcattatcctcgatatctcccgaggggtcactaaagtctgaagaaatgttagaagacgacgaagataaggaattctccagcttactatatggcacatcgtatgttttcgcgatttccttcaaataaagatcaactagttcttcttttggaactgagggagagcatttttttataatcttttcagggacatcgatatgatctgctattactccattaacaaactcaacgtttattttccaggccatcaaatctttcaattggctaagttctttgacttcatcaacgaaaagaatcgcatagattagggatctgatagcttcgttaataccatcatccatatgctctttgacaagctgttcctcggtggagatatcgtttattacctgcactctagccagtagtaattcacaatatagttccaatatctctagtagctcaatatgaatatcgtcatgaattagcgtctccacacgataatgcgccttctgttctttatttgtcagtaacagttgtgcaacctgtcttcgagactgctttgcaatcgcctgttgcttttcttgagcatatcttaacctttgaatacacattttcaggcatgttttaagcttgatctataacaataatttggatgatagttttacccttcttcagttagtacatcctagatcttttgcatactaaagctttttaaaaattactataaaatataaacatacagtgaacggaatcattgacggagccatttttagttgtcgtattctcttatctatcttctatgttgactagttctgattgattagctggaactaatagtatatataattttcacaccctttggaattcagaaggcgttttttttttcatgaaacaaaacaatagagtgcggatagccgattcagttgattctaaaagtatataaaatgcgataagcgcataagcagccattataaacgtacatctgagtctagatatatacgtttgtgtagcgggaaacgttaaaaaaaaaaatcttaattatagtttatcaaatgaccatatcaacaggatattttaattcgtcatgttggcccttggtgtcatattcacttaatccgacaatgcctccaaactttaaaaatctatcaaaacgtttcaatcgtaaatcgtcaactttcttaaccatatctggccaatagacttcatgtttatacttgaagtctaacagaccattgtatagagcatctagttgagatggctctatgtggttttcaaatggttcgtcaaagatagccttcgccttagtggcagggtcaaggaacggatacatcatcttcaaaaaagcccacgcaaaccatgggatattgatcaggacacacttagctaacctttcagggtaatgatcttgcatgacgttcaaacacatcctagcaatagagatgggtggagctttatcagtgataataccaggttctttataacttttgaaatctaccaagactgtgatcttttctacaccttggggagctacagttgtcgcagtttccatcatgtagactaattcttggacttgtctaaaggaagattctgtgttttgacgaccatttttcatgtagtatagaggtcttttagcgttgtcaaagcccaaaataacctgtttaccagtttcgttctcaacggcaactttgtcagctgttaaagggtctttgtcctccttaccatgtgtaagtccaatttctctcctccataccaaggttttggtgagaccttttatggcgttcgcggtgttccatttattggctcttaggtatcttagaaaacactccctagaaagccaaaacttctcccaatcactcaagggtctgtcattggcatgtgtcccattgtcaaggtcattgagattttctggtaatttcagatcatcatcttgaaaatgtcgtaagacagctctatatttttcgttttgatcttcggagatgggttccagtagaggtgcgttaccatacttggcaggagggtccaagaatatcttatcacatggaataagtttctctttaggcacagcaggcgtatggtcccgttttcttgaaaaaagacccatttttgttcttcttcttgtgctttctttgtgtgatttttcagggtctttttttttaaacaatgatgtaaattaaatctatctaaaaagcgtgatttttcccacgaattttaatccctctattgttctctttccactccatattgagtgaaaggaaaaataagaaaagtaaatagaaaatttatgacgtaggaataaaagtatataagtatttaacaaattgaccgtagataataataatgcgcatgaaattaaatcctctctttgatctcttcaatcaagatcaacccattaaccacattagaacattttgccaaatgaagccatagacgaataggaagtaattgcacttcttgacggtcgatttgctgatggaaacgtgtatatcatcgtcttcagcaccggagcggcttagtaaattgaacttgacggatcttagtaggaatacgccaaaggcaataaataagtaaaattttatcaaaatattcaggttaaatggcatggtcacgttggtcaaaagctgggcgagaatcaatggaacaaatttgtagccgacatagcacaacagttcgaccaaactgaagcttggaatcttagaatcgatcaaaagatacaagccaagcttcaaaatcaacaaatctaaacacacaaacgccagagtagaagacagtttgtagtacaagtcttcggggttgaatgaacccttcagaccttgctgcgtattccagatgagaatataggtaactagtcccataataggcatgtacatgtctggggagttcacgtcatcccttggtggcaaaaagttgccagagtccataattcgttgccagttcttggttccgttaagaaaaggaactaggatgagtttcaatttattgatgacataacgggtgctgacttgaaaatacgttgaaatttgttgagagccggcagcgtttgcagtggctttattgaccgtttcttgaaactggttaaagttatcctgaccaataaaattagaaaatgcgctctgccctagttggaatgccatcgaaccacgaggatcttggaatggaaaaccaccgccactgccatttacgtttgcattcatattcgcattaccttggccattcacgggcgtgttcctcggaatttgcattggtcgttgctgttgtggagtgtgggaaaagcgatcgttaacgccattctgctcacttgttgcatatgcgtacggattataagacatcttggtatgggcctttggttttcgttttctgctattgatactcagtagcgaggtcttacaatcgaaaagtcaaaaagatgagttgtagtataaaacaacagctctggtgtgcaatatggatcttgatacagagtctcggatatgctgttttagcactgagaaaaagtaatagtaacactgtcagtgttcgtcaaaggcccaagtttattgtcatttgaattgtcagaatggtttattttcaggtagggtaaccagaacgcgtaagtttcttgcatcttttaccattttaactggaagaggacctatcaaaaagagcatatgatgatgaaagagcacattctatcaagataacactctcaggggacaagtatatgatgtttggcaagaaaaaaaacaacggaggatcttccactgcaagatattcagctggcaacaagtacaacacactctcaaataattatgcgcttagcgcgcaacagctcttaaatgctagtaagatcgatgacatcgattcgatgatgggatttgaaagatacgtaccgccgcaatacaatggcaggtttgatgcgaaggatatagatcagattccaggccgcgtagggtggctgacgaacatgcacgcaacgctggtctctcaggaaaccttatccagtggtagtaatggcggcggcaattcgaatgacggagaacgtgtaacgaccaaccaaggtatttccggagttgacttctactttttagatgaagagggtgggagcttcaagtcgacagttgtctatgacccatacttctttattgcgtgtaacgatgaatcaagagtaaatgatgtggaggaactagtgaaaaaatatctggaatcttgtctcaaaagcttacaaatcattagaaaggaagatcttaccatggacaatcaccttttagggctgcagaagacacttattaagttatcatttgtaaattccaatcagttattcgaggccaggaaactcctgaggccaatcttgcaggataatgccaataataatgtgcaaagaaatatatataacgttgctgcaaatggctcggaaaaagttgacgccaaacatctgatcgaagatatcagggaatatgatgtgccgtatcatgtccgagtatctatagacaaggacattagagtcggtaaatggtataaggtaactcaacagggattcattgaagatactaggaaaattgcatttgccgaccctgtggtaatggcatttgatatagaaaccacgaagccgcctttaaaattcccggattccgccgtagatcaaataatgatgatttcgtatatgatcgatggggaaggttttttgataacaaatagggagataatctctgaggatattgaagactttgagtatacaccgaaaccggagtatcctggttttttcaccatatttaacgaaaacgatgaagtggcgcttctacaaaggttttttgaacatataagagatgtacgacccactgttatatccaccttcaatggtgactttttcgattggccttttatacataacagaagtaagattcacggcttggacatgttcgatgaaattggtttcgctccagatgctgaaggtgagtacaagtcctcatactgctctcacatggattgtttccgttgggtgaagcgtgattcttatttaccacaaggttcccagggtttaaaagctgttactcaatctaagctaggttataacccaattgaactggatcccgaattaatgacgccgtatgcatttgaaaagccacagcacctttccgaatattctgtttccgatgcagtcgctacgtattacctttacatgaaatatgttcatccttttatcttttccctttgtactattattcctttgaacccggatgaaacattgagaaagggtaccggtactttgtgtgaaatgttgttgatggttcaagcttatcaacataatattcttctaccaaataagcatacagatcccattgagaggttctatgatggacatcttctagaatccgagacttacgtgggtggacatgtggagtcattagaagctggtgtttttaggagtgatttgaagaatgaattcaagatagatccttctgccattgatgaattattacaagaattaccagaagctttgaaatttagtgtggaagttgaaaataagtccagtgtagataaagtaacgaattttgaggaaataaaaaaccagataacgcagaaattattagagttgaaggaaaacaatataagaaacgaactacctttgatctatcatgtagatgtcgcctctatgtacccaaacatcatgactacaaatagactacaaccagatagtatcaaagcagagcgcgattgtgctagttgcgattttaatagacccggaaaaacctgtgcaagaaagttaaaatgggcttggagaggagaattctttcccagtaagatggatgagtataacatgatcaagcgtgcattacaaaatgagacttttcccaacaaaaacaagttttctaaaaagaaagttttgacatttgatgaactaagttacgcagaccaagttatccacataaaaaaacgtttaactgaatattcaaggaaagtttatcatagggttaaagtatcagaaattgtcgaacgagaagccattgtctgccaaagagaaaatccattctacgtcgataccgtgaaatcctttcgtgataggcgttacgaattcaaaggtttagccaagacttggaagggaaatctgtccaaaattgacccatctgataagcatgcgagagacgaggccaaaaagatgattgtgctttatgactcattacaattagctcacaaagttattttgaattcgttttatgggtatgttatgaggaaaggctctcgttggtattccatggaaatggcggggattacgtgtttaacaggtgccacgatcattcaaatggcgagagctttagtagaaagggtaggaagaccattagaattagatactgatggtatttggtgtatcttaccaaaatctttccctgaaacttacttttttacattagaaaatggtaaaaagctttatctctcctacccatgttccatgctgaattacagagttcaccaaaagtttacgaatcaccaataccaagaattaaaagacccattgaactatatatatgagacgcacagtgaaaacacgatttttttcgaagttgacggaccatataaggccatgattttgcctagttccaaggaagaaggaaaaggtataaagaaaagatatgctgtcttcaatgaagacggctcacttgctgaactgaaaggttttgaattgaagaggcgtggtgaattacaactaataaaaaattttcaaagtgatattttcaaggtctttttggaaggtgatacattagaaggatgttacagtgctgtagcaagcgtatgtaaccgttggttagatgttcttgattcacatggtcttatgttagaagatgaagacttggtcagtttgatttgtgaaaatagaagtatgtcaaaaactttaaaggaatatgaagggcaaaaatctacttctattacgacggcaaggagattgggggattttttgggtgaagatatggtaaaagataaaggtctacaatgtaaatatattattagttcaaaacctttcaatgcacctgttactgaacgagccattccagtcgcaatattttcagcggacattcccatcaaaaggtcttttctgaggcgatggacattagatccatctttggaagatctggatatcagaaccataatcgattggggttattatagagaaagacttggatctgctatacaaaagataattactattccagcagcattacaaggggtttccaatcctgttccaagggttgaacatccagattggctaaaaagaaaaatcgctacaaaggaggataagtttaagcagacttcactaaccaaatttttttcgaagacaaagaatgtaccaacaatgggcaagataaaagatatcgaggatttgtttgaaccaactgtagaagaagataacgccaaaattaaaattgcaagaactactaaaaagaaagccgtatccaagaggaaaagaaatcagcttacaaatgaagaagatccactagtattgccctcggagattccttccatggacgaggactatgttgggtggctaaattatcaaaaaattaaatggaaaatccaagcaagagatagaaagcgtcgagaccaattatttggtaatacaaacagctcccgtgaaagaagtgcactaggaagtatgattaggaagcaagctgaatcatatgcgaactccacttgggaggtcttacaatacaaggattccggtgagccaggggttttggaagtatttgtaacaattaatggcaaagtccagaacatcaccttccatataccaaaaactatttatatgaaattcaaatctcaaacaatgccgctacaaaagattaagaattgccttattgaaaaatcttctgcatcgttaccaaataatcccaaaacgtctaatccagcaggcggtcagctattcaaaattactctaccggaatctgtctttctggaagaaaaggaaaactgcactagtatcttcaacgatgaaaatgtacttggtgtatttgagggcactatcactcctcatcaaagagcgatcatggatttgggagcttcggtaacgttccgctcaaaagcaatgggtgcgttaggcaagggaatacagcagggttttgaaatgaaggatctttcaatggcggaaaatgaaaggtatctgagtggattttcaatggacattggctatttactacatttcccaacatcaattgggtatgaatttttttcattattcaagtcatggggagatactattactatattagttttgaaaccatccaaccaggctcaggaaataaatgcctcatcattaggacaaatatacaaacaaatgtttgaaaaaaagaaaggtaaaatagaaacatattcttacttggttgatattaaagaagatatcaattttgagtttgtatattttacagatatctcaaaattgtacagaagactatcacaggaaactactaaattaaaagaagaaagaggtctgcagtttttactcttgttacaatctccgtttatcactaagctcttaggcacaatccggcttctaaaccagatgcccattgttaagctttccttgaatgaagttcttctaccccaattgaactggcaaccgacattattgaagaaacttgttaaccacgttttatccagtggttcgtggatttctcacttgatcaagttatcccagtatagtaacattccaatctgtaatttgaggctggatagtatggattatattattgatgttctttatgcaagaaaactaaaaaaagagaacatcgtgctttggtggaatgagaaagctccacttccagatcatggaggcattcaaaatgattttgatttaaatacatcatggataatgaatgattcagaatttcccaaaattaataactcaggtgtgtatgacaatgtagttctcgatgttggtgttgataatttaacagtgaacacaattttgacatcagcattaatcaatgatgctgaaggcagtgatctagttaacaataatatgggtatagatgacaaagatgccgttattaactcgccatctgaattcgtgcacgacgccttttctaatgacgctttgaatgttttaagaggtatgttaaaggagtggtgggatgaggccctaaaagaaaattcaaccgcagatttgttggtaaattccctggcaagttgggttcaaaacccgaatgcgaaactattcgacggattactaagatatcacgttcataacttaacaaaaaaagccttacttcaattagtaaatgaatttagtgcacttggctcaactattgtatatgcagacaggaatcaaattctaataaagacaaacaagtactcacctgaaaactgttacgcctacagccaatatatgatgaaggcagttagaacaaatccaatgtttagttatctggacttaaatatcaaacgttattgggatctgctaatatggatggataagtttaattttagtggattagcatgtattgaaatagaggaaaaggaaaatcaggattataccgctgtttcgcaatggcaactaaagaagtttctgtcaccaatatatcagcccgaatttgaggattggatgatgatcatattggatagtatgctaaagacaaagcagagctatctaaaattgaattcagggacgcaaagacctacccaaatagttaatgtaaaaaaacaagataaggaagatagtgttgaaaactcgttgaacggattttctcaccttttttccaaaccactaatgaaaagagtcaaaaagctttttaaaaaccagcaagagttcattttagatcctcagtatgaggcagactatgttattcctgttcttcctggttcccatctgaatgtgaaaaatccccttctagaacttgtcaaatcactctgccatgtcatgttactttcaaagagtacaattttagaaatcaggaccctgagaaaagaactgctgaagatatttgaattgcgtgagtttgctaaagtagcggaattcaaagatccaagtttgagtctcgtggtgccggattttttatgtgaatactgttttttcatttctgatattgacttttgtaaggcagctcctgaatctattttttcatgcgtcagatgtcacaaagcctttaatcaagtattgttgcaagaacacctgattcaaaaactacgttctgatatcgaatcctatttaattcaagatttgagatgctccagatgtcataaagtgaaacgtgactatatgagtgcccactgtccatgtgccggcgcgtgggaaggaactctccccagagaaagcattgttcaaaagttaaatgtgtttaagcaagtagccaagtattacggttttgatatattattgagttgtattgctgatttgaccatatgagtaagcagtatataacgcgaggttcaatggcctctttaccatgaaaaaaaaaaaaaaaaaaaaaaaaaggtaaggaaaaagagtattttcaattcgtttctgaacatataaatataaataaccgaaaaattagcccttgaacataattaacactcttctttgatatttaaatcacaagtacttttcttttattttcttcttaatacttttggaaataaaatgaatgtgaccactccggaagttgcttttagggaatatcaaaccaactgtctcgcatcgtatatttctgctgatccagacataactccttcaaatttaatcttgcaaggttatagtggaacaggaaaaacctacactttgaagaagtattttaatgcgaatccaaatttgcatgcagtatggctggaacctgttgagttggtttcttggaagcccttactgcaggcgatagcacgtactgtacaatataaattgaaaaccctatatccaaacattcccaccacagattacgatcctttacaggttgaagagccatttcttttggtaaagacgttgcacaatatttttgtccaatatgaatctttgcaagaaaagacttgcttgttcttgatattggatggtttcgatagtttacaagatttagacgccgcactgtttaacaaatatatcaaactaaatgaattacttccaaaagattctaaaattaatataaaattcatttacacgatgttagagacatcatttttgcaaagatattctacacattgcattccaactgttatgtttccgaggtataatgtggacgaagtttctactatattagtgatgtctagatgtggcgaactcatggaagattcttgtctacgtaagcgtatcattgaagagcagataacggactgtacagacgatcaatttcaaaatgtagctgcgaacttcattcacttaattgtgcaggcttttcattcttatactggaaacgacatattcgcattgaatgacttgatagacttcaaatggcccaagtatgtatctcgcattactaaggaaaacatatttgaaccactggctctttacaaaagtgccatcaaactatttttaagcacagatgataatttaagtgaaaatggacaaggtgaaagcgcgataaccacaaatcgtgatgaccttgagaacagtcaaacttacgacttatcaataatttcgaagtatctgctcatagcctcatatatttgttcatatctggaacctagatacgatgcgagtattttctctaggaaaacacgtatcatacaaggtagagctgcttatggacgaagaaagaagaaagaagttaaccctagatatttacagccttctttatttgctattgaaagacttttggctattttccaagctatattccctattcaaggtaaggcggagagtggttccctatctgcacttcgtgaggaatccttaatgaaagcgaatatcgaggtttttcaaaatttatccgaattgcatacattgaaattaatagctacaaccatgaacaagaatatcgactatttgagtcctaaagtcaggtggaaagtaaacgttccctgggaaattattaaagaaatatcagaatctgttcatttcaatatcagcgattacttcagcgatattcacgaatgattatctccctggaaggtatccagagggcaggatacgttcgaaacaacaactacgttatataaatatttatacatagtgggatagaatgaacaattatcaagtaaaccttgtattttttgttcccacgctctacgctctgtttcttggatatggtaatcaaagattaatacgtataaccgttattaattcagtccactagaaactattaaaagcgccctactgtatggaaaaacaatgaatgaggagactgaacggcgcaaaattgttagtttagttgctctttttggcggccggcgataatgttcttcacttggtattcttaccaggattgagcctgattttgttttgtcttattctttgcgatgtcttcattttctacaaaacctctaatttctccggcaatggcccttgaaacgtcttcaaagacttcaaatgtcacggtgggggttcttttatctttaactaatcgatgaagagttattagaatggttctaaacttatttttcaattttattaacaccctctcaaattccatcacactttcatcatcgttattcattttcaaacctttcattaaagtacgaatggtatgtatattcttttctagtgttggactatgcaatccatacgattctataacatcacacaaaccttccatttgtcccaggagcgtaaatctttggaatcccacttgtaaaccatactgtttaccttctagaaagctctgctttatattctcattctggccctccagaaaaccttcttggtaatactgttcttctaggtttagtaaattatcaaaatccatttttatttgtccagtgatctttactttccatttactcttcaaatatgataagtgatttgatttaaacaagttttttttcatttttcttataaaacgatttctcaccatgattgagatttttatattagtaagattatactgaaaaggcaaatggctacatagccaacaaagaataaaacaataaaacaataaaaaaagacttttttcttcgtaagcatcctattgagaatattaatcatttacttaagtagctacaatacaaaatagagtaaaaaactatttctcttcactttcattcacaattgtttgccagatctaacttcctttccggttttcttaatcttttctaaaataaaatcgtaaggaagtgtagtatatacatctactaattgcttttcaagggatatatctattttggaaacgtctggttctaatttcgtcaaaactttattgactgcaccagaacatcccgagcaggtcatgacgacattgaattgataatgttttatctctgccatcttttgcgctagttctctcttgtgtcgttggaaatctcatcctgcaatgttttaagatgattcaagtcatttaagaagctcaaaaatgcactacaagatgtgccaactttgcacccccaaaaaaaactaccgcatcacgtgaaatttattagaaaactgaaaaaaagacaacttacgcatacgtaatacaagatgtacatctattgcaatgatcatgtaacctatcctacgattaattattttttaatcatctagagcagtgcctctaatttcgtaaatatcatcaatggcattccttcgcaggggagtgtcggcaaacaataactctatccattggattagttcgtctgtcgcaaaaagataaaaatccccattgtaaaacatctccataatctcctttaaatgtaatggtagaaacttgcccatagtggcgaatttttctctcatctttttgtaacttggttccttcgctaataattgtatatcggtgttgttcactaataaagatacgagctcacccaaattttcggaattgacctcagagataatctgccattttaatatttcctttgtcacgcaatcgttatataaaaagtttaagaaagacaacaagtaacgggaaccttcttcacctcttattttctgcagtggacgaacaatttccttcaagatataaggtagcagtttctcaatggtggcgtcccacgatggatttctctcgttctcacgaaattcggtcaattgatgcctgattagttgacagacaatacgatatttcatgttcagtttagtttccagcaggttccttgttaattcttttattctatacagcttttcatctcgttctattagatatctcatatccacatataattggcaccaattgtgagaaaaattagctgtgcacatggccatatacgatgtctgcaaaaggttgtatttgtacgcaaagtattgctcatcaacatggctatctgcaaagctactcttgaaattctgtgaaattgccaagaacaattttggtaactgtgtaacttcaatgtggtctttatcaagtgatcctacatcatgagcttttaaatgttcctttccattttctagggaagcatcatctatattttcgtcaattgcccaggcttcatcccaggcattttcttcttcttctggttctttttccttctcttgatttgttttttcttcctcgtcgtcaatatttacatcaatttcatcaccccatgcatcggcatcatcatcctctacttcccaattccaatcatcatctttggatacggcattatggagttctttttcgttctgtacatctgaatcattttttccaattttttcgctcatcgtattagtattgctagtagtgagctcaactacttccaaattttgccagctcttttttggatcttcaaatatacttcttatctcactaatatgcgattcaagaactttatctagtaataaattgtagtataattgtttgttcattaacaaatcctgaatctctttaccggaatgtgtccaattggtaacttctgatttggcaactagtctagttagtttgttatttatgacagaaactagattttttagcggtgaatcaagtgattctaaaattatcgatgcattatttttcacaaatttggtaaactccgtattgaacaagggacctagctcataacttaaggtctttctgtctctaaaggctaatccgtctaacatgaaatcgcatactgcttcaaaacttgttaatacagtagacacacaatgttggccatgcgaagaggatttagaaaagacaagtatgtttttttcgttttcatatgagatttctttaccagatataaaaatagaatttttgatcatgcttacaatcctggaaaggttcatatactccttcatgattgtattcaattttgctcttacctgctcttgagagtcggcactggtcatatctaaaatgaaccaagcttgattgtccaaactacccttaggaaaatactgttgggccacaaaatccataaatgtatcatactcaatatgaaccttgtctttaccccattccactgtgggcgtaaattggatgctattctcggtaatcttccaaaatccattagtaagaattttatacaacgtgctgacaagttctaaatgcagtgtgtcgacgtaggtagaaatggactgctggaaattaaagctttgcttaagataagcagcattattacgcatcttttttcgcaatgactgcaacgaatagtagcagttttctagttctagtatgttcaaattagttttaacttcttttatgagatttaaaaacgtcttcaaattatctaggatgttcagttcgttggctagaattgcctcgcgttgtagtaggtcactagaatcaagttctaactcactgccattggaccttttgctgtcattttttaatattaaaggatccttcagtaactcgcgtattatttcacctttgttaggaaaaagagactccatatccaatcgagagacttcgtgatttgtaaaagttatgcgaatcaaaccacttttttactgacaaatttaacgtaatcctttaagactatgaaccatgttatgaaacatctcttagttcaacatgtcgcctaattgtatatcgctattgacgaaagagaagtatctttcatgaggtcaataataacgttcaatggttaatgagcactataatcataaacaaataatgactttgataattatataatagttatattcgctcaagttattggtggtcttaacttctcgagttcttcgttacaaatagaacagtaattttgcaattgagtgtcattaaaccaaagatcagtcatctctatagacaccatcgagcatttatttacttcttccagcaagaatttttcgtagtcgtcatgcactaattgtttctccatgtcttggagtattctaagttcaattagcaattcatttctcctcatagccaactgttttctcgtttcgctatactgatagtccttattgaaattgtcctcgctgaacttctcaaaaatggggttatttgacggcactgacagttgactacttagcaagtccgaatcacttatgtaaatggctctttgcattgtgaacttatctgatccaagacggtcgtggaacagtttttcagctctctttattgaccagtagggcactgatgctttttctgataaaagtatgtttatcataatagatgctaataatccgaccaccatcattcgattaatccgtgagaacttttcagcacataataatagaataccgataagtattctgaagaatacaaacgtcaaattcgttactctgtaaaccattagtttgataaacactaggaaaaggatagtacaagaatacctgatgtcatattgcatactttcactctctttggagttgccatttttttcagtagcaggttcttcacttttgttgctgagaacacctaatataccacatagtttgatagctttgataacttttccgtgtttgccaatcttttccaagtagtaccgtaacacccttcttatcagtaggaattcactatgagcaaatttcaaggcccatgtttggcatattatttcagccaaagatagcttttctattgttttgccagttctactatcaatatattctagtttgtataggacatgaagcgatgaactgctcgccgtcatattcaactttatttcaagatggttatctacatcatatgactcagttatgacaaatttaattgaaagcttcaataaatgacaaaatggcactttaacgaaaaaaggatctaaatcgacttcataatatttgttatcaacaattttgactatcctctgtgtagcaaaaatcattttagattccttatctctatgatatttaccagtatttaaaaaattaccggtcatatccaatcgaaatggtatctttcgaactaattgtgatttcccgttgatgtctttgtttttataccaaaaacgtttcccgtgttcttccccatcttttcttgctaaaaacaggcattttggaaaagcattcgatttatctccaaatagtatgtgggctagtcctttactagatatttcatattcatgattgtaagtaatcgagtactctgtctgaagttttttgagtctgtttaataaagtagatgcatcatcggacatctcccaaaatgtcacacgtgatttgatgattttggatacgctggtggccttacgatcaaaggagttttcttgttctatcttatataattcttcttgttttttttcttgagattctttttccatctgttcaaactttactaaaatctcttcgttactatttgggttttttatagccttgttttctaacagatattgcaacttagatgcaataagcttatagtcagaaaataaaacgattgctttcatttgtagaccgctggcatcgtaaagttttaaggtcttctttgatgatctgtcggcttctacagaaacgatttcagacaagctgatctttgtaagacagataaattccatagaattcatgtagcaataaatgtagtcttttgtgcaaaagcaggtagctgagaacttctgctttttgttaggacaccacaatgcttcaaacttgaaaagtaaaagctcttccggtagcttctccaacctttggtccggagaaaatactaatgacttgaactgtagatcaagcactttcaactcattagaataatattgaggatatatagtggagtttcttattggaagccttttgccatcgatcgttaataaagaggagggtttctttccctttcctggcaatatagtatattcactccaatcggtcgtgccccatatattcgcaagaacagcattagggaaccagctaccttttgtgaggaaattagacagaatagccagttgtgtcatttttgtagatattggtgttgttggcatttggaactgaaacaccttctcctctcctaaagtcaaaatatcatattcagagattgagcagttcagcgtttcatacaaggactcggtttctttgtcaaatgttgtgattaattgatctatggaggtggttgtactagaggcaaattcaaaaaacttgggagaaaatcttttaaacgccagctcatattcaagactatcatgttgtatactcatgacatacttttttgtcgcttcaaaagctattaaccatgatttcaaatctagataatttgaagtttgaaagaccaacgtgatatcctttgacatgttatcatgtgcctctgttactttattaccaaatatttttacttcaaaacaaaattttcgatcttcctctgggtcatagcgcacattagtaaggaagacaccaaacttatcagtttcctccacgtaggtcttcgatggcgacaaaaggaacataccaaaaactgcatttttcagaaagcaccatcttctcacccatatttccctggtaggctttccaacctgtgttttcatataaagccacccagacttttcgggcgattttggaggcacttgcgtatcctttgatagcagcttcgaggaatgtattgatcttatattgtaatcacttgtgtcacttgacggcgtaattcgtttcaaggtatacctatatgcttgcttttttgcattactgatatcagaatccaatactttcgatccttcgatggaattttctacccatattgcgtaattgtctaaatactcattaatgcaaggagataaatctattttccttccagaatctttcgttataaaaatgcttcttgactttaatactttcattgactctagtatgaatttatctaagcttaattttactgctgatatggcacttatgaggtctagggaggccttaaggtagtttttttgcacttcaaataattgtaaggcatcacttttgatagaagatggctctaaactggtttttgaaattcttatagcctggtaggatgccagcatactgtcatatttaccttggtaaaaatcgaaattttttctcacgtttctgtagggttcaattgcagtagtcataagttctaatagcgcggttgagtggctagagtcatcaccctttacaatttgcagtaatttcatagaaaagtcataatagtccttgttaaaactatcaatcagcctgggagtaaacgattggttactgacaaaaccgttgctcagcaaggctggaggaggtaacaattgggataggagagtttcctttgctcttcgaaaatcttcaaatgacaccttatatttctgatcgaaaaagtcgacagtcttctctatccaatcctctaatgcatccacccttgtttggaagaaatttacggatgcacgaaaggaaggagagtcaattgatgcttctttgaatgcaaccgatattagccttaactgcctctttttgggatccctcccgtgaacggacatatttcaagtaatgatatatctctgcaatatgtcaattgatcaacaggtctactcatgcagctatgttttagttacacctagtagtttaaaatttcacgtgtactttccctgttttgaacgcattagcaatagcgctggtgtcgttgcgcaaattcataataaaaggaaaatttgaaaaacttatgataaattgcaaggtcatcgaaaacagaagaacaaggttttttcctttagtaaatgcaaaattagtaaaagtgatagcgtcttctttgattaacaagtttcaatctttgcctttggctatgtcaaagctattttctactgtcaattctgcaagacatagtgtaccactaggcggcatgagagattatgtgcacattaagaaactagagatgaatacagttcttgggcctgattcctggaatcaattaatgcctcagaaatgtctactaagcttagatatgggtacagattttagtaaatctgcggctacggatgatttgaaatattctctaaattatgcagttatttctcgtgatttgacgaatttcgtcagcaaaaaaaagaattggggttctgtttctaatttggctaaatctgtgtctcaatttgttatggacaaatattctggtgtcgagtgtctgaatttagaagtgcaggcggatacaacgcatattagaagtgaccacatatcttgtattattcaacaagaaagagggaatccagaatcacaggaatttgacgttgttaggatatctgagttaaaaatgttgactttgattggtgttttcacctttgagagacttaagaaacagtatgtaactttggatataaagttgccttggccaaagaaagccgaattgccaccgccagtgcaaagcataattgataacgttgtcaagtttgtggaggaatcaaatttcaagactgtggaagctcttgtagaatctgtgtcagctgttattgcccataacgagtattttcaaaagtttccagattcgcctttggtggtgaaggttttgaaattaaacgcaatcacagccacagaaggtgttggtgtaagctgtattagagagcccagggagattgcgatggtaaatattccatatctttcctccatacatgaatcgtctgatattaagttccaattgtcttcatcacaaaacactcctattgagggtaaaaatacatggaaaagagcgtttttagcgtttggttcaaacattggggaccgtttcaaacacattcaaatggcgttgcaattattatcaagggaaaaaacggttaaattacggaatatttcgtctatttttgaaagtgaaccaatgtatttcaaagatcaaacccctttcatgaatgggtgtgttgaggtggagacattactgaccccaagcgaattattaaaattgtgtaaaaaaattgaatatgaagagttgcaaagagtcaagcattttgataatggtccgagaacaatagatctggatattgttatgtttttgaatagcgccggagaagatattatagtaaatgaaccggatttgaatataccgcatcctagaatgctggagaggactttcgttcttgagccgttatgtgaattaatatcccccgttcaccttcatcctgtgacagcggaacccattgtagaccatttaaaacagttatacgacaaacagcatgatgaagataccttatggaaattagttccattgccttatcgtagtggtgtggagcctagatttttgaaattcaagaccgctacaaaacttgacgaatttactggagaaacaaacagaattactgtttcacctacatatatcatggctatcttcaacgctacaccagattcattttccgatggaggtgagcattttgcggacattgaaagtcaattgaatgatatcattaaattgtgtaaagacgcattatatttgcatgagagcgtcatcatcgacgttggagggtgttctaccaggcctaactctattcaggcgtctgaggaagaagaaatacgcaggtctatcccattaattaaggccattagagaaagcactgagttaccgcaagataaagtcatactatccattgatacttatcgttccaatgtcgctaaagaagcgattaaagttggagtggatattattaatgatatttcgggaggtttatttgacagcaacatgtttgccgtaattgcagagaacccagaaatttgttatattttatcacacacacgtggtgatatttcaacgatgaataggctggcgcattacgaaaattttgcattgggtgattctattcagcaagaatttgttcataataccgacattcagcagctagacgacttgaaagacaaaacagtgttaatcaggaatgttggtcaagaaattggcgaaaggtatatcaaagcgattgataatggagtaaagcgctggcaaattctaatcgaccctggacttggttttgctaagacctggaagcaaaacttacaaattattagacatatccccattttaaagaactactcattcaccatgaactcaaacaattcgcaagtgtatgttaacctcagaaatatgcccgttttattgggtccatcgcgcaaaaaattcattggacatatcacaaaagatgtggatgcgaagcaaagagactttgctactggagcggtggtagcgtcgtgtattggtttcggcagcgacatggttagggtccatgacgttaaaaattgttcgaagagcattaaattagcagatgctatttataaaggtttggaataaaggttagttatatagattaaatatgtaattctgttttgtaataattttttttcctgtttcataataaagaatcgttaaaaataaccaagggaggaaacaagtgaaatgaagtatagaaaagatatagaaaataaacttaaatattcagtttacttgtgcttcttttttcccctctatgaaatatagcatgataagtgattgttcctttgtttttttcagtggatgtttcacctaagcctttggacaatccttggaaatatggccagtttcgttacagttgtaacaaagcctgtcattttgacagtccctggacatgtggccagcttgaccacaagtgtaacatttcaatccactaattccgtcctctttcatacagtccttagccatatggtttggaccaccacatttataacatgaaactttggagaatctgctggtcttctttggttcagggcattctctggagatgtggccggtttggttacagttgaaacaacgttgcacagtacattcacttctaacgtgaccggtttcaccacaattgtaacattgcttgaattcaactgttcttggcatggtacaatccgtttgaacgtgaccgggtttgttacagttgtaacatagtctttcagaatcacagtcttctgccaaatggccaatcttaccgcaaacgtaacaagctttttgagacatctttttcgtattcttttcttttttcctgatttctgaagggaaagccttaaaataatacaatcctcaagtgcccccaaagcagaaagagcatttctaatccatcgatgaccttattacaactcttgccaaaagagaaaaggaacgaaaagaaaattttttcagcatttcgtctatcatgacaccacagcagttcttactataaagctcaaatccctaagccataaaggcaacaaacggcaatatactacctgtttaatcgtgcgtatccagtcgccatctcctgctggaatagttatgaacatcgagtttcagttcccgcagacggtcttcctctatggcagcttcccattgctcaattggatcagagtcggctactatgataccgtattcaactgtatcctcgagtaagtcataggctagcatccttaattcgggatcgtagtaatattccttctcgtttaattgttgctttggatgtttattcggtgtcttcgacgagcaagatttattcgagagatttaattggtaaatacaaaaagacgtaagggtttctggagccaaaacgtagttacagaaatctgttatcccccaccattttaaggttgcgggctgattgtgcgtgagtgcccttttatatctcttagcgatttcttcgccaaccctcaattgccttttcaggccgtaaaatccagcagtaaatttgtttaaattcaactttctaaactcatctacggacaagtaagccttttgtgagtttttgaatgcattttttgcttcaaaatagtatacagacgatatctttccctccaatatgtccattacaatgggcatgaagggttctacttcagtgagtagctcatccgaaaacaacatgggtggtagtttgaacttgctcatgtattcttcccttacttgaagttttttgattatctgctctttagaactcaaacaactttgtaacgatagctttttatcctcgggaaatgaagaggagaagatttggttatcttcaactgccgatagttctgcctccaagagtaattttttaccgtctaaaagattattgttcctgcatttgatagactcgatatcttcatttttcaaattctgtattagtgggatagaaacgaccttctcttcttctttttcttttcctctgagtgctgcattctttgcggcttgtacttctgaatttggaaatgacctcgaaagtttatcaaatgtggccacagtggaaagcttttttacttcaatctcatcttctgtgatactgtctattttgccgcgcttttttgagggggaaaaggcatcatggcctgataagtcgtcactttctctatcatgtatgtcatgttttccttgtcttttcattaacagtaagttatcaccacttcccttttttgtggaataaacaccttttctcctcactcgattaattcccagaccaggcccaaccatctctgtctacgcaggtcaaaaatttgtgctaaggtctcgagagcacatacagtacccttttaatgtgatctcatcgctacatttttcaaagcttcccattttagcgacgccatctatatataggaaaaaaaaaaagtttaggacgctatttaccacaacaattgagatgcagcacaaataggagtatcattgcctcccaattttcaagggagttttcagagaattactattccatacctattcaattactggagttgtcttcagtatcataaagggttttggattttcaatcgaattgccatttttttcctgcttacgttcgatagatagccaaatgcagtttatatatatgtatgtagacttgaaggtatattaacagtgcccatgtttctttggaaagtgtcaaatatcgcaaagcataaccttgaaggttaacattattttctagaaatacacctttcccactggatatgatgacggaagaaacaaaacgttaaattattgtaccgttgtataaaacagtaaccgagcatggacaattcatttttacaccccaacgacgccactaaccatgtataggtgtcttgcctaacttatcattattcatagtagaattaagaaaattaaaagccttgcaccacaggttacgtacataagatattatgttaaatatatatctcttcagtatttctacgtacaaagcttcactcattgaggtttgattggtgtacagctacatacataaaaaggatcaagtgaactattcggcatgtcgacaattggagctgttgatattcttaatcaaaagaccataacttctgaagtggctgcctcagtgacttcaaaatatctacaaagtacgttttctaaaggtaatacaagtcatatcgaagataaaaggttcattcatgtcagttcgcgttctcattcaagattcacctcgactcccataactccaaatgaaattctttccctaaaatttcacgtatcaggttcatcgatggcgtatagtagaatggatgggtcattgaccgtttggtttattaaagatgcaagttttgacaaatctgtagaagtttatattccagactgttgtggttccgataaattggctactgatttgtcctggaaccctacttctttaaatcaaatagctgtcgtgagcaattcatcagagatatccttactcttaatcaacgaaaaatcgctaacggcatccaaattaaggaccttgtcattgggaagcaagactaaggtcaacacatgtctttatgatccattaggaaactggttattagctgccaccaaatctgagaaaatctacttgtttgatgtgaaaaaggatcacagctctgtctgttctttgaacatcagcgatataagccaagaggataatgacgttgtgtattccttagcatggagcaatggtggaagtcatatatttattggctttaagagtggttatttggccattttaaaagcaaaacatggcatattggaggtttgtaccaaaattaaagcacatactggtcctataaccgagatcaaaatggacccatggggaagaaacttcattactgggagtatcgatgggaattgctacgtatggaatatgaagtcactatgttgtgaattaataattaacgatttgaactctgcggtaacaacactagacgtctgtcatttgggtaaaatactaggaatttgtacagaagatgaaatggtatatttctatgatcttaatagtggtaatttactccactctaaatctttagccaattacaaaaccgatcccgttttgaagttttatcctgataaatcatggtatatcatgtcaggcaagaatgacacactatcaaatcattttgttaaaaacgaaaaaaatctaataacttattggaaagacatgttcgataacacgatgattgaaaaacgtaggaaaaacaacggtggaggcaacaaccacaataaaaggacgagtaagaatactgataggattggcaaggataggccgagtagattcaactcaaaaaaataagttacctgatggaaggaatgcggtagaaaatgcacattctttttctttcatttaatgatatttacatgtgattgacgacaacctaatatataaatatatatgcacgcatatattttgtatatgtaacgttaaaaacgcatctgtttttgtgatttcaattatccgctaaaagaaattctgttttgttaaagtaatcttttggtacatattcactgatctcaccttttgtcagccaagcaaaatcctcgaatgcatcatttttcgacgccaccaaatcaaattttccagccaaaatgtgtgacttcacaataaactcagcagtcctatttctctcgtcctgcaaaacacctatgggcgtagcagaaacagaccaagtgtatatctgatcaccgctcaacaatttcaattcgttctctgcgtgtacgtgtaacggcttagattcatcagaaagatcgaagttagggaatttccaagtaccgcttttatccttaaccaaaagatataaggtcctgctcaattgtctttcaaggctcttcatatcatttgacctatctgcttccgttatcctgtcgttgggaatcacgggcctattaacatcgtctttgctttgctctttttgattgttgctaaatgctactgtactgtcatcagaaagtttaacttcttgcttagtacttctttctctgccatgtttaatgtccggtatgcctctaggaaaccaaatgccattttttttggagataggtcctttctgcagggatagaaatttgtgttctgctacagtaccctttttgaaataaaaatatgccggaaacgtccacattagtctcttttctagttctgattggtactcatagtattttttctctagttcatttaattctgatttaattatagggattcttgacagtagtactccgactttaatcttggggggagcggaactggcagttgcagttgcagtagcaagccctcttttcaacattaaatttaccttcatggtactggataagcgcttatgattacgtagaatataaagtttattgattgtttaactgttttctttccttttttttttttcattttcattttcatctaaaccttgaaaaaaaaccaggaatacggtaaaaaaagagaataaagaataggataatgctacatttgaaacacagtagttatgtgaatacataaggatgtccatttaacaaaaaaaaaaaaggaacataggaaaaaacagaaattatatatagaggtagattagttttatgtactatgagcaaataaagggtggagtaaagatcttagctttgttgttgttgctgctgctgttggttaagcatattcatcaaagaattcaattgagcagtggggtcaaattgttgctgaggtacagggggagccgctgcggcaggtccctgagaaggtaatggttggttgggggcataaccatacggttgctgcatcataggttgcacatattgctgtggtggaggagatgccaatggtgcattgccgtagggtactggagatatcgacgatatgctaccagatttgttaggtttaccagaacgtggcccatttctgccagaatcagtaggcatcttttgagatattgccttggaagaaacaccttcaccaacgataatatccggttcttcgaaaacaataccggtaacgagaggttgaccagaagtgccaccccattgcgcacttactgaccattttttatcagcgtccgtgagcctgtgcataggaataatactgtaaccgtgttgatagtcacaacaatctcttggaccaaaaccaactccccacctagttctcaatggcagggctccatctttattgaagttttgcaaaacattttcggcctcatgtcttgaataaactttcacaaaagcgtgttttctggagttattcagaatgacgctttgtacttcagcaaaaggttttaaaacgttagcaaggtcccattccttcatgtttagtggtaccccaccgatgaaaagagtacggctgtagactttaatatgatctggtggcaatgtagagtcgtaacttactggttttggtctataatgaggattattggaaacattaagctcatcggggtataagtggtgattgtttgtgccaaatgtcgtattgggggcgcctatgctgtattggtcctgggccacagatggatagcggtccttcctgcctgtcgatggctgagaaaatggtgccggaggagatcttgatctattccttcttgagttatatctttctctttcacgttcacgttcacgtctgctaccatattcggtaattgtatgggcttggggaggtgcgactgtacccacggatgtatgtgaaggcaaagttttaaaatgtttctgcagagccgctattacttggaaaagagctgcttgctgtttggctggatctgtggaagtcaaatcagttggaagacttatgttcaagtttaaaggaggacttttctttagatttgacaagatttgtttcgacctctgcttgggatccagtgatagttgttgtgaagcggtgttcgcggtgttattcgatatgtccatagcaaagcattttgacctgatggcgttcaagtaactcttttgaaacaagccggacctgtcccaaatgtctaaaagcatacgaattttttccttgtggtcttgattactttttgcaatagcatcggatagcagttcttgaattacttcgcccaacgtgtttatggcatgggcacaagtaccgggtttgttgctgctgctgtttgaatttgatcttgtttcatccaagtaagctctacctattgaatcgatgatatataaagaacctaatttatgagaatcgggacaaagtcttgagtagtctattatcaaagatatgattttcgattcaatatcaatgtgatcaagtgcgtaagtggttagtttcttaatacgagaacctgaaataccagatttcaaatctttgaatgattccaaggtagctacaaaattttgaaaatcgtcgtcctgctgcattatgggatgtttagtatgtttgttgctttccggttcctttcctgtaactcgtgcttggagaaaagtactagaaaaaatgtgtaatcagagaaaactacaatacaaaaaaatagacaatagtatatttttcttttgcttgaaattataggttgtagcaatggatacggtaacgtaactaattgtaagaagagccttgattggtgagttagttgtgtacaatacgataatacgatgcgatacgatacgaaaacgatacaataaggttgccgagtactgacttttgatatgttaaaagcatgaaactcgtaaagggaaggagcggggagtcatgctaacgaggaatggaacatggaggaaggacgaaacacttgcccttttatactttttctttttcacctcctccgctccgaccggtggcaaaaaaaaaaatcaaaaatgtaccgtatgtaatgaccaataaatcaccaaagacgaaacatttatttttgccgccgactttccaatgaatttgctcaatttcaggttagtggtcataaggatatctaacaagccatcaaaagcataatgtttttgagtactcgatagaattatgtattgcggactttagtagaataggaaacaatgcgctatacgtgcgcagtagctcatttcgaccataaactaattgtagattttttgcgtttctggtgctattcattgaaacaagaaaccgatagtacttccacttacaatactaatacttgcggtaatgttacaatccttcacttattattttcggagaataataaccatgcatcttgcaatactttcacggctttgccttgtctcgtgcgctagtaactgcagtagaacccacccatatgacaatgcaaatattaatctaacttagtcaaaaaaaaaaaatgccttcacctcgtttgtcttcatctgagataaggttccggttttcatcttgtccctgtttgttgcctttgttcttgcctcatcgcttctaaagcggctttcaagctttgatctttaaatggaaatctttaattctaagaagtggtagcaaccattgagaggcaaaaacaagggaacgacggaaagcaggcatgagcgctatctataaattatctattcagggcatacggtcttttgactccaatgatagggaaactattgaatttggcaagcctctgactttaatagtcggcatgaatggttcaggtaaaacgactatcatcgaatgtttaaagtacgctaccacaggtgatctaccgcccaacagcaagggaggagtattcattcatgacccgaagataactggtgaaaaggacattagagctcaggtcaaactggcgtttacgagtgccaatggactcaatatgattgtcaccagaaatattcagttgctaatgaaaaagactactactacatttaagactttagaaggccagttggtcgctataaataatagtggtgaccgcagtactttgtccacccggtctctggaattagacgcacaagtacccctgtatctgggagttccaaaagcgatcttggaatacgtgatattctgtcaccaagaagacagcctgtggccactgagtgaaccatccaatcttaaaaagaagtttgatgaaattttccaagcgatgaaatttacaaaggctctagacaatttaaaatccataaagaaagacatgtccgtggatatcaagttattaaagcaatcagtagaacacttaaagttggataaagacagatcgaaagcaatgaagctcaatatccaccaattgcaaactaagatagatcagtataatgaagaagtgtctgaaattgaatctcaattgaatgaaatcactgagaaatccgataaactgtttaaatctaatcaagatttccaaaaaatactatccaaagtagagaacttgaaaaatacaaaactctcaattagtgatcaagtgaaaagattgtcaaactcaattgatattctcgatttatcgaagccagatttgcaaaacttattggcaaacttctctaaagtcttgatggataagaataatcagttgagagatttggaaaccgatatttcaagtttgaaagaccgtcagtcatccttgcagagcctttctaattccctcatcaggcggcagggtgagttagaagctggtaaggagacatacgaaaagaacagaaatcacctttcatcgctaaaagaagccttccaacataagttccaaggcctttcaaatattgaaaacagtgatatggctcaagtaaatcacgaaatgtcacagttcaaggctttcatctctcaggatttaactgacactatagatcaatttgcaaaggatattcaactaaaggaaacaaatttatccgacttgataaaatcaataaccgtcgattcacagaatttggaatataataaaaaggacagatctaaattaatccatgactctgaagagcttgctgagaaattgaaatcatttaaaagtttgtctactcaagatagcctcaatcatgaactggaaaacttaaaaacatacaaagaaaagctgcaatcttgggaaagtgagaatattataccaaaattgaaccagaaaatagaagagaaaaataatgagatgattatcttagagaatcaaattgagaaatttcaagatcgcataatgaaaacgaatcaacaagcggacttatacgccaaactaggactaataaagaagtccattaatactaaattagacgagttacaaaagattacggaaaaattacagaatgattctagaataaggcaagtatttcccctcacccaggaatttcaaagagctgatttagaaatggattttcagaaattattcatcaatatgcaaaagaatatagcgatcaacaacaaaaagatgcacgaattggatagaagatatacaaacgctttgtacaatttgaacaccattgaaaaggatttacaggataatcagaagtcgaaagaaaaagtgatacaactactaagcgaaaacttaccagaggattgtactattgatgaatataatgatgtcctggaagaaacggagctctcctataagactgcgctggaaaacttgaaaatgcatcaaactactttagaatttaatagaaaagcattagagatcgctgaacgtgacagctgctgttatttgtgttctagaaagtttgaaaatgaatcgtttaaaagtaagttgttacaagaactaaaaacaaaaacagacgcaaattttgaaaaaactttgaaagacactgtccaaaacgaaaaggaatatcttcatagtttaaggctactggagaaacatattattacactaaattctataaatgaaaagattgataattcacagaagtgccttgaaaaagctaaggaggaaacaaaaacttccaaatcaaaactagatgaattggaagtagattccacaaaattgaaagatgagaaagagttagctgagtctgaaattcgtcctttgattgagaagtttacttacttagaaaaggaacttaaggatcttgaaaacagttctaaaacgatatctgaggagctatcgatttataataccagtgaagatggtattcaaactgttgatgaattaagggaccaacaaaggaagatgaatgattctttacgtgaactgaggaaaaccatttcagatttgcaaatggaaaaagatgaaaaggtgagagaaaattcaagaatgattaacttgattaaagaaaaggaattaacagtttctgaaattgaatcatctttaacacagaaacaaaatattgatgattctataaggtcaaaaagggaaaacatcaacgatatcgattctagagtaaaggagttagaagcacgtattatttcattaaaaaacaaaaaggatgaagcgcaaagtgttctagacaaagtaaaaaatgaacgtgatattcaagtacgcaacaaacaaaaaaccgttgcagatattaatcggttaatagatagatttcagaccatttataacgaagtggttgattttgaagctaagggcttcgatgaattgcaaacaacaataaaagaactagaattgaacaaagctcaaatgctggaactaaaggagcagcttgatctcaagtcaaatgaagttaacgaagaaaagagaaaacttgctgactcaaataatgaggagaaaaacttgaagcagaacttagaactaattgaattgaaatcacaacttcagcacattgaatctgagataagtagattagacgttcaaaatgcagaagctgaaagggacaaatatcaagaggaatcactaagactaagaacaagatttgaaaagctgagctctgaaaacgcaggtaaattaggtgaaatgaaacaattacagaatcaaatagattcattgactcatcaactgcggactgattacaaagatatcgagaaaaattaccataaagaatgggttgaattacagacaagatcctttgttactgacgacatagatgtctattcaaaagcattagatagtgctattatgaaatatcatggattgaaaatgcaagatataaacaggataattgatgaattatggaagcgtacgtatagtggtactgatatagacaccatcaaaattagatcagatgaagttagtagtacagttaagggaaaatcatacaactatcgtgttgtaatgtacaagcaggatgttgaattggatatgagaggacgatgttccgcgggtcaaaaagttcttgcatcgattattatcaggctagctctatctgaaacatttggcgcaaattgtggcgtaattgcactagacgaacctaccaccaatttagatgaagaaaacatcgaaagtttagcaaaatctttacacaatataattaatatgagaagacatcaaaagaatttccagctaatcgtgatcactcatgatgagaaatttttgggtcatatgaatgcagcggcatttactgatcacttcttcaaagtcaagagagatgataggcaaaaatcacaaattgagtgggtcgatattaacagagtcacttattgaaaagaccccataatatctacgaagggatagactttgattgattaattagaggtgctgaaatacttcgtcgacgagtttgtgataacgcttctgttgcttagccatatctaagtgtatatgatatttaacgcaaagcaattttcttagtaatatgctatcgtttccaagtcggtattcagcaagagattcgaatttttcgctatcattactaatatctctctctgttataacgtcagctagttgtttcttttcctttgcagacttagcaagcacgtaagcacctttgatacccatcatatcgacattctctttaggtttaattattgctacaccgttgttaaccaaggaaatcaatgataatagtctttcatttttcgcttgactaccagatatccttaactctttgatatgtatatttgaattttcattttgaaatgtatcaattatcaattttgtctgaaatgataaaaattccaagatacaaatatatttatatgtaagattcaacattgatgtatcggtggactcgccaatgaaagaaccctttatccgtggatctgcaaaaggagtcctatttccctcgtaatcaccgtagaaaaacatatctttcgtaagaatatgaattgagagaccattgttcttctcaatgtcacgaatggtttgttcgagtacttgatagatatcagcaccatctttcagaattttcctggcacatggatgactctcaaataaatgttcaattaatttaccagtacacgactggcccgcagcataaacagaaaaatcacccctgttgtcaagtatagtatcaaaaggtccccatactccaggaattctagtatcagagatggtagtaccatacatgtagcagctagaagtcccggctatcataaacaatgatgtttccaaatgaggagaagcaactgcgaaccaacttgcataactgtcaatacaactgcgaactacagttgtcgaaatgtgcttattggcaacaagactagtggttccaatgcttacattagatggtaaatttataatgtttttgtaaaatgaagatgaccagccagatacctctccatcattgcctataccattaagattttctcttcccaaaagtccttcaatgttccattcatacaagcggctcagttcataagcaatgtattgatgaagatcaaagatatgaaaatgtttgtctcgtaaatgagagtattcatctaaaaagtacttcaatttggggacgcccatttcgggtacaaattttcctcccaaataatccaaaagctgttgtggacattgcatatttagccattgacattcgtttacggcagaagagtccatccaaaatatgacattatcttcatttggatacggtatcagcatgttacttgtgcgatccctttcgaaaatagctaatgaacacgttgcagaaacaccacatgactttacctcatattctctaatgttcagtttctgaagacacttttgaagggctttaattatttcagttgatttttgccagaatttccatgacttctttgaagaatcctggtagtatgggactggttcctgcgccatttctaacagcgcatcattgtagtaattatatacacctattctagcacttgatgaacctacatcaattccgatgccaacttgcagactgctattcatgatttcacctatataacacgttggtttctcatttaaagttacctttattgaaaaaaataaactgatacatttttaaatttcagcttactaaggtgctagaaagccgaactacgctatgaattaatattgaatttattgcgaagtttaaaattattgtaaaatatctatttgtacatatgtatcttctcagaaaaaatagcgtatatctatgtagttatttttgtttttctcttcctctcatcaggaggaccgtcttatattttgctgctttatagaaccatctagcaaaaaaaaaaaccagagcaaaccaaatgctcagtatatacctctaggtaactctaacgtcttggacctcttcctcttcttgtcatttcaggtagcttaaatggaactttcatagtggcaattttataagaagctgcagtactttttggaatgccaaaagcctcagcttgagccactgtggcacctttgacaatagcaccaagtaccctgaacaaactgacaactttggaaggtttcaagttcaattcgtgtgctaagggtgtgatttcaacaatgaagttatccaaatgcattatgattgccaagatgtagcataagattttatcttcattttgtgggtcaatgaaataggagcgatcctttgatcttccaaactgtccaggctttatcacggtaaatctgcttaagataccatctaccaagatttcaggaggactgttcaacctttctaacaacttcgtcttgttattcacgcgtctattttcgtatacgcccagtaatagtgataagtagtatagtagctgtaatttggtcatttgtgaaggttgtgtcaaagagtccaatttctttgccacatacttggaattgttttggtatgggaacaattccaacttcttttccttatccgcttctttcagaattgatgaaacgcgaataaactgtaattccttctttggtattatactttcaattgggtaaatttgttctacatcagtggcatcgatattggctaatggagtaggtctatcgttggaagtaatttcatccaattgagcccgagttggtaaatccttagatgcagttctcacggaatccacaatgtcaatagcagaatcagtcaacttatcagagtcaatacggtttctttctagatctgcaatagcttttttagcctttttagtaccaaacgcttcacccaacgcatttctcaaagcagatggacgagtatcactcttactttttatttttggaccccttagattcttgcttgacttggatacaactttggaaacaagtacgggagccttgtagagttgaatacttttcttttctggattaaataggcccacaacatactggttcgaagcttgggaagaagaatcagtataaccttcgtattctagtctctcgttttcaccgtgtaatacgaattcgtccttttcagacttcttttttttgtataagtcgaacgtagtgtcactgggagcacggaagcccttgaagaaacttcccacggcaacagagggttgatcttgaacactttcaatttcgatttcagaaacagaccttttcacggacattactagataaagtgcaaaaggttgataacgactgcaatagtggtagcaacttaaaaagccctcctaatatcattagtgttcatgcaagaatacttactattaaaaatgagatggaaaatttcagctcatcgcaataaaaaattttcagcgcgggtgaccgcaaacatttttcatcgcgaagagtcaaaagacattatcaattgaaaagaacagtattgctaattggcgtcggtgattaggtgtccggtcaagttcttattctatgcatgaatatcttcataaaagccctgagaagatatactataatgtctacgccgaagattgtgcagcccaaatggaaggttccaacgccacaagctaaagaaactgtgttgaagttgtacaacagtttaacaagatctaaggttgaattcattccgcaatctggcaatagaggtgtcacttggtactcttgcggtcctactgtttacgatgcctcccatatgggtcatgccagaaactatgtctctattgatatcaatagaagaattattcaagattattttggttacgacgtgcaatttgtgcaaaatgttactgatatcgacgataaaattattttgagagctagacaaaactatttatttgacaattttgtcaaagaaaatgataccaaattcaacgccactgttgttgacaaggtcaaaaccgcacttttccaatatatcaacaaaaattttactattcaaggcagcgagatcaaaactatcgaagaatttgaaacttggttatcgaatgctgatactgaaactttaaaattggagaatcctaaattccctatgcatgtcaccgcagttcaaaatgctattgaatcaatcactaagggcgattccatggacgcagaagttgcctttgaaaaagtcaaggacgttacggttcctctattggataaagaattgggctctaccattagcaatccagagattttccgccaacttccagcttactgggaacagaaattcaatgatgacatgttatcattaaacgtgctacctcccaccgttacaactcgtgtttctgagtacgttccagaaattattgactttgttcaaaaaattattgataatggttacgcatatgccacttccgacggttccgtgtactttgatactttaaaatttgacaaatccccaaatcatgactatgctaaatgccagccatggaataagggccagttagacttaattaatgatggtgaagggtccttaagcaactttgctgataacggaaaaaagtcgaataatgattttgctttatggaaggcttccaaggcaggtgaacctgagtgggaatcaccatggggtaagggtagaccaggatggcatattgaatgttctgtgatggccagtgatatcctaggctctaacatcgatattcattcaggtggcatcgatttggcctttcctcaccatgataacgaattggctcaatccgaggctcgcttcgacaatcaacagtggatcaactatttcttacatacgggccatttacatattgagggtcaaaaaatgtctaaatccttaaagaatttcattaccattcaagaagctttgaaaaaattctcaccgcgccaattaagattggcttttgcctcagtacaatggaacaatcaattggatttcaaggaatctttgatccatgaagtaaagtcatttgaaaactccatgaacaatttttttaagactattagagcattgaagaacgatgcagcttctgcaggtcatatctctaaaaagtttagtcccttagagaaagaattattggctgattttgttgaaagtgaatcgaaagtccattcggcgttctgtgataatttatccacacctgttgctttgaagacactgagcgaattagtgaccaagtcaaacacatacattaccactgcaggtgctgctttaaaaattgagcccttgattgctatctgtagctacatcaccaaaatcttaagaataattggatttccatcccgtcctgacaatttgggttgggcagcccaagctggctccaacgatggatccctaggctcattggaagacactgttatgccatatgttaagtgtttatccacatttagagatgatgtacgttccttagctatcaagaaagccgaacccaaggaattcttgcaattaacggataaaattagaaacgaagatttgctaaacttgaatgttgccttggatgataggaatggacaatctgccttgatcaaatttttgactaacgatgaaaaattggaaattgtcaagctaaacgaggagaaacatgccaacgaactagcaaagaaacaaaagaaattggaacagcagaaattaagagagcagaaggaaaacgagaggaagcagaaagctcaaattaaaccacaagatatgttcaaggatgtcacattgtacagtgcttgggacgagcaaggccttccaacaaaggacaaagacggtaatgatatcaccaagagtatgaccaagaagttgaagaagcaatgggaacaacaaaagaagctacatgaagagtactttggtgaagacaaatagaatactcgtggcttcgttatgtgtgcaactattcaaaagtacgtatatatgtatataccatctttttttacgttaaaatagtgaaaaaggaaaggaggaaagaaaaaactaatataattaattgtattatatatgtacttttcattttggaatgtgaaaaaattccaggcggaaaaaattgaaaaaatcaaacactgcgcttgtgagaaaagggaagaaaagcatcctaatgattaggcgcttgatgttgacgacaaacatttcgaagcataacactgccaatgatgagtgaccaagaaaacgagaacgagcagtatgtaggattgagctctgcagggcatgaaatggaaaaataaagcaacccattatactaacaatatgcacttagcaagtgcggtagatggtcagtgcaaaagcattcttaggattggctaaatgcgaagaagaagtggacgctattgaacgtgaggtagaattatacagattgaacaaaatgaagcctgtttatgaaaagagggacgcgtatattgacgaaattgcagagttctggaaaattgtgctttcacaacacgttagttttgcgaattacataagggcttcagattttaaatacattgacactatagataagatcaaagtagaatggctggcattggagtctgaaatgtacgacactagagattttagtataacattccatttccatggaattgagggagacttcaaagagcagcaagtcaccaaggtgttccaaatcaaaaaaggcaaagatgaccaagaagacgggatactgactagtgagcccgttccaattgagtggccccagagttacgactcgataaacccggacttgatcaaagacaaacgcagtccagagggtaaaaaaaagtacagacagggaatgaaaaccatatttggctggttcagatggaccggcctaaaacccgggaaggagttcccgcacggcgactcattggcgtcattgttcagtgaagagatctaccctttttgtgtgaagtactatgctgaggcccagagggacttggaagacgaagaaggagaatccgggttaagcgcagatggcgacagcgaggatgacgatggcagtctcggtgaggtggacttgccactatccgacgaggaaccaagctctaagaaaaggaaagtttagtagtctaggtccggagcgggcttggacaacggtttccctcgttgcgacattgctcttttttttgttgagtctggagttcttctttgttgtttagttaccttaaacttactcattggatcatctttaagcaattttgacttcttcttctgcgaacttatggatgttgcggcaccagaagcggaaatagtagtggccgcccttacaggcggtgttgcaggttggtttagtatagatgaatctagttttttcttacctaataaatagtcttccttttcgtcactcagttttgcatcctgatacatccattccaagcccgacttcttcaaagccaagtcattcttgagagtctccggcttatccttgctcgattcgttcagcagttcatttagttctcgttctttttcaatttctttcaatcgcgtgttaagcttctgctgttcggtaattagatcctgttcggtctcccatactttttttctatttttcataagcttgggattccatgatttcaacagattcaaatcgcccgaccccatgataatgtactctcgatttggcctttcttccctgtactcaaaactgaacgctcatctcttttgagaagctgcatgctacgtaccacttgttcttatatctctgtatgtaagcccgcggcgggagaagaagaaaaagaaataaaaaaagatgagatgttatattatatattatagtgtaaatatgcacttggacttaaataactaaacagttacgttttatataggataacaacactaagaaagaaagcgagcagcgagtaagcgactcggcgtaagccttgaacttaaaacccatgaattttaatgttcttcttttgcaatcccagttgggagatcataaattcgcaaacctttgctctttggtcaccctgcaactgaataatctcccccatttctggatccttgacaatgttaccattacatgcaaagtccttctttaggaccttaagaattctctttaaatcatattcctctgggacaccttgcaccgtagttaaagtttttctaccatttctctgttggatacgaatatgaatatagtttgaagtggcggtttcgtcgtctcctgtgtcggcgaaaggatcaaatgatttcagattctcaatggacatacgatttgcttcagctatattaatatattccttgtcttttttgaaaaagaatagaaaggagaaaacccccagcacgaaacgaaaacaacaagtagctcttctcttgttttgtccttttgcagtttgcttttatccctgtgatgaaaaaaaaaaaaactaaaattttttgccggcgcatcgaaaaaatctgttacccgacccgttattggtgataatacccatttttaacgcgatcacatatcataaactgcagtgagagggtcgtttacagtagttatagtaccgaaccaaaagactggaaccatgtacacatgatccttttacgggtactttttattgtaatgtaggtcggtgcgttttgtacgacgacgcagcggctgctcgtataaaatgacgcggtcgcgcgccgtttgacgtcctataggagaatgccaaaaagggtgttttgctggaaaatatacatatataaatatatataaagaatagtgaaacaatagaaatattagtaatacagccatagcagtagtagtgatagtactagcagctagaacaggatgtccagaatagattcagatctgcagaaagcgcttaaaaaggcgtgttccgttgaggagaccgcacctaagagaaagcacgtacgcgcatgcatagtgtacacatgggaccatcagtcttccaaagctgtttttacaacccttaagacgctgcctctggccaatgacgaagtgcaactgttcaagatgcttattgtactgcataagatcatacaagagggacatccgtcagcgctagctgaggccatccgggatagggactggatcagatctctgggtagggtacattctggcggttcgtcgtacagcaaactgattcgggagtatgtgcggtacctggttttgaagctggactttcatgcgcaccatagagggtttaacaacgggacgtttgagtacgaggagtatgtgtcactggtttcagtttccgacccggacgaagggtacgagacgatcttagatttgatgtcgttacaggattctcttgacgagttctcgcagatcatctttgcgtcgattcagtccgagaggagaaatactgagtgcaaaatttcggcgctgatcccgttgattgcggagtcatatggtatttataaattcatcacctcgatgctgagagctatgcacaggcaattgaatgatgcggagggtgacgctgctctgcagcccttgaaagaacggtacgagttgcaacatgcaaggctgtttgagttttacgcggactgctcttctgtgaagtacttgaccacgttagtaaccattccaaaactacccgtggacgctccagacgtatttttaatcaacgatgtggacgagtcaaaagagattaagttcaaaaaaagagagccctctgtaactccagcgcggacgccggcacggactccaacaccaacaccacctgttgttgctgagccggctatttccccacgtccggtatctcaaaggactacttcgacgcctacgggttacttgcaaactatgccgacgggtgccaccactgggatgatgatccccactgccactggtgcacgtaacgccatttttccacaggcgacggcacaaatgcagccggacttctgggccaatcaacaagcccagtttgcgaacgagcaaaaccgtctcgagcaagagcgtgtgcaacagttgcaacaacagcaggcacagcaggaactgtttcaacagcagttacaaaaagcacaacaggatatgatgaatatgcagcttcaacaacaaaaccaacatcaaaacgatttaattgccctcaccaatcaatatgaaaaggaccaggctttattgcagcaatatgaccaaagagtgcagcagctggaaagtgaaatcacaacgatggattctacagcttccaaacaattggctaataaggacgagcaactaactgcattgcaggatcaattggatgtttgggaaagaaaatatgagtctttagccaagctatactcccagttgcgtcaagagcatctaaatcttttacctcgttttaaaaaactgcagttaaaggtgaatagtgcgcaggaatccattcagaaaaaggaacagttagaacacaaattgaagcaaaaggatttgcaaatggccgagttggttaaggaccgtgacagggcaaggttagaattagaaagatccattaataatgcagaggcggacagtgcagcggcgacagcagcagcagaaacaatgactcaggataaaatgaaccctattctggatgccatattggaaagcggtatcaacaccatccaggaatcggtctataatctcgattctcctttgagttggtcgggtccgctgactccacccactttccttttgtccttattggaaagtacttctgaaaacgccactgagtttgccaccagtttcaataatttgatagtagacggccttgcacacggcgaccaaacagaggtcatacactgcgttagtgatttcagtacttcgatggctacactggtgaccaattcaaaggcgtacgccgttactacattacctcaagaacagtctgatcaaattttgaccctggtgaagagatgtgccagagaggcccaatatttcttcgaggatttgatgtctgaaaatcttaaccaggtcggtgatgaggagaaaactgatatcgtcatcaatgccaacgtggacatgcaagagaagttgcaagagctatctttggctatcgaaccgttattgaacatacaatctgtcaaatcaaataaagaaacgaacccacattctgaattggttgccactgctgacaaaattgtcaaatcctcagaacacttacgtgttgacgttcctaaaccattgttgtcattggcattaatgattattgatgctgttgtggctttggtaaaggctgctattcagtgccaaaatgaaattgccaccacgacaagtattcctctgaaccaattctacttgaaaaacagcagatggacagaaggtttgatctccgcggcaaaggctgtggcaggtgcaaccaatgttttaatcactactgctagtaagttaatcacttctgaagacaatgaaaacacatcacctgaacaatttatcgtcgcctccaaagaagtggccgcatccacaatacaattggtagcagcatcgagagtgaaaacttccatccactcgaaggcccaagataaattggaacactgttccaaagatgttaccgatgcatgcagaagtttgggtaaccacgtcatgggtatgattgaagatgatcattcgacttcgcaacagcagcaaccattggacttcacatccgaacacacattgaagactgccgaaatggaacagcaagtggaaattttgaagttagaacaatccttgagcaatgccaggaagagattgggcgagataagaaggcatgcctactataaccaggatgatgattgatcatgaattgtactttttatatataaagataaacgttaatataaatatatttatttgaagacgtcttttacgtttttctgtatctgattggtatatgcgttctcgtccggggacattttttctttttttggtgcggcgaatggaaataatcgcgataatgaatatgcaaggaacaaagaacagacaccccacccttattatcatatcacatctctgtaggagtctaccattttgcttctattgtaatctttgcgactttatttcaactcaccattcatacaaaatttctactgccgtttaaaataaggaaagcataaagattaaagcaaattaagaggaaccctttttttttttgatttcgatacaatggcattttggttacctcaaaatatacaaaagcggctgcttctttacgtccttcagcaaatttcgctgttctccaatatagatttatctaacttggacgtttctatagggtctaagtcacatttctcgttccatgatgtgaatctgtcacttgatgatctcaacattccaaacgtgcaaataaacgaaggcatagttgacgagcttgtgttaaaattaacagtttctggcggtgtggaaatcgatgggtctggtttaagatttatcatgacacctttatattccagtggctcacaggaacttcactcagattttttggttaaaagcatccaagatcttacgaattcgatgttacaatttagtgatccattgaccacatataataggtacaaagaagatgacattagctcttcagacagtagtagtgatctcaactctaatatagaagcttcaaaaccagccgcaaatggttcttatactcttcaaaatatgcggaacaaggcccttaatgtagccttagcgaaattgaaaatagcattaaaggacgttaccatacgtttcatagtgaatgatagagatccttccgataacattgtggaggttcatctagaaagcatacaacttattactacagacgcaaatttacgacatataaacattgaaaatatcaccatttcctcaatacaaaaacaagctgtacccgactctcctgtgcatcctttcaataatgacgatctgtcacaaagcgtttatttatcaaaaatggaggctacttcactttatatgagcgccatggaagagcaatcaaatgaagaccccagtgaaccccaagttacacaagaagaacaagagaatgataagtgcaaggaatctttaatggaaataaataatttgaacatagcttttaagggtttatcatcggtcaatgatctcagaatgtctaatattgttattgatattcaggatgttcatttagcgatacacaaaattgtcgaaatcaaaaactccactttgaagaatattatagatatcattgttacacatttggatgccaatgaaagcttttcttgccaggattcccaaagtccttcacctgacaagcaggaaccatcagctctttcttctgttgatatcaaatgtatatacttaaacttaggccaagatatcacagtaattttgaagagctttaaattagagcaaaaggaaaataattcattggcattttctttaggctcattttattctaattcgagtccattgacaattagccataaaactaagccattgctcactggagaacaaacccctcaaagcatcgcattaaatatgggcgacgaactagatattattatcagtcatgatggcattgcgcatttctttaaaatctttcagtttgtttcaaaatgtatgtccttttatcagaataagtcaaaagggatgatgcctcaaatagcatcggatactaaaaggaccgtacaacttacctcaaaagcagtgaagttgtcgcttaagtttccatattttttattatgtttccaggtttcacccttcatttacgactctaaccgtgagttgtacattgagcttgtagacgtatttaaaaaactaccttctcggtgcacgaaaatattgacaatgtcgagcattacgatctcgaacttgcaatcccctctacaactgggttcatatgacgatactttgaaagaagcgctaatttatagttctgtccatgcaatcatcaaagaagtgatatttaacgaagaatattctggaatagtacaattagtcgaagatatttctgcgtttggaaaacttttcacggattcaaagaacagtgaatgtacaggaaagtctaaaagcaagagaggctcctttttgcagagaagtgtcagagtacttaattcttccaggttcgtttacaagcagagtttatccgctaatttttctctcaagatagattccatgaagttaaaagtatcagaaattatagggccgcaatttggttctgtggaagcattactatcaaataatttctttgcgattacggatgactctcaaattgtatattttacaaagaacttaaaggtagaaagaaagacaccgtcattattagagccacaagaaatcatgtcagtagttttgaataaagcagttaacgaacctgtactatatgttcatagaagggcgaatggaaagttaaaagtcatttttaacaacattcgcatacattactatgcaaggtggttagaaatactaaagaaaaacatcggcccggataatgccagttcaaaagatgaacctgtttcacaaaagcttagtaaaaaacaaccgacttcaggatttccctgggaactcaaatgtctggactgctctctaattctgcaccctttcagattaaaaagtgtaatggtcattgtacttgacaatctaacaactggtggaagttcatttattccgcaggcaaagcttctttcaaaggcgaatacactcttcctaatagatgactatcagaatttcaaaattcaaaaagataagaactggcctagtttgataaatttttatgctggtcaaggtttctctgcaatcggtaaaatagatactttgaattttttaataaacaaatccgatggtgcccttttattggattgtaaaatagaacaagttggtctttcattatgcgcggattcttttcaaactttttgtcagctttgtattgatttaaaatatcctcagacgtttcctgatgaggaaaaatttagaacgcagttgaaaaatcctatcgatgtattcaaagacatcgattgtgatcttttcaattctgccttcatccgggagaacaatcatcaaaatgattacgactcagtgcatttggtagacagttttctcgacaaaactcacgagttcaacaatggtgccagaagtaaactatcctctcaaggttcatatgaaatggacagttcctctggaactgccacaggtggtattttacttccccatgagagttatctagactctgctcagccaaaagaagaagatactccaccaatcgcctcaaaagagcaagaaagggatgtggatataaggggtagtatagatgtcgaaaaagttgttataaaactattcgatgggtatgattggaaatatacgcggaaatttatcgctaatactgttgaaaaactggataaagagctcagtaaagcggaagcaagcagttcgaaatcaaatgtaccccaatcagaggcaaatatttttgactctatttatatatctgctaacaaaaacaatgtcacagatttgagaagaaatcttgatggtgagatccagggggttcagaattccttctctgatgtctctaaagttaatttgcgaccttctaagcattacaaagccctgattcaattgaacaaagtacatgtcaatttgaagaattatcgagtagatgaacccgatgagtctaactctgataattccacagatgttttgaaccgatgtgtagtttccatttacgaatttgaaattatcgataatgttcccacgtccacctggaataaatttgtaactttgctaaagcacgaaccgtggccacacagttctccgatgtttcttctggacctggaatttatccggccgatcgactttttgcaagcagtggaattagtcatgcaattaaatgttgcgcctttacgccttcacgtggatcaagacactttagagtttctaataaggttcttagggttcaaagataaaagatttgaattaattgatgagtatccagatattgtatttattcaaaaatttagcactaattcaattaagttaagattagattataagccgaaaaaagttgattatgcgggtttaagatcgggccaaacttctgaattgatgaatttttttacccttgatggatccaagattattttgaaaagcgtagtcctgtatggattaaatggattcgatgaattaaataataaactgaaagccatttggacgccggatattaccaaaaagcagctgcctggcgttttggaaggactggctcctgtcagatcgtttatggcgattgggtcaggggtgaagaccctagtcacagtactaatgtcagaatacaggcaagaagggcatttgggaaggagtctgaaaaagggtggcaatgtcttcttgaaaacgacaacgggagattttgtgaaattgggagttaaattaacttcagggacacaggcgatattggagaacaccgaggaactattcggtggtgttggttccaatggcagggtgtacgatgcatcgaaatttggctccgctgatggtgcagacagtgatactgcagctgtattagacttggatactttattcgaggaggatcagttagttggtagtaaatattccaggataagagatcatgagcccacggcagtagtcatcgatatgtcttcaccgggagatcacaacgaacccacaatagtgagtctgtacgcagatcagcccctcgacctgcccacgggtttgaaggaggcgtatagttcattagaaaagcatatgcatattgcgtacgatgcggtatggagggcaaagggacagatgaaggatgataaacggggagggccgagcgccgcagcagtttatgttgctagagctgcacctgtggcaattattcggccgttaattggggccactgaggcagtgtctaagactttacagggaatagctaatcaagtggataagacgcataacgagcaaatcaatgataagtacaagtccaatcggactgattcgtaaaaatttttgcagacatttttgatatatattcaattcatattttatctcttttttttttttttttttcagacgtggaatggtgggaaagccaaaatgtcactgaccgcggctaaaagttaaaaaatacatgagacgacattcttttatgtatatatatttacacatgtatacaaacaaatacacacgcaagtagagaggagttggtggggggaagatgccattatagaggagaaaagaacaaagagagtgagcttgcaagataaaatcactcgaaaaaaaaaatttcagtgacttagccgataaatgaatgtgcttgcatttttctaattatccttcgtatcttctggcttagtcacgggccaagcgtaagggtgcttttcgggcataacatacttgtgtttttgcatatattccttcaatccctttggacctcttgatccgtaggggtaaatttccggtgttggaccgtccggacgctctatgtgcttcagtaatggggtgaatatgccccaactgatatccaattcgtcatctctgacaaagttggaatggtcacccagtagggcgtctcttatcaacacctcgtaagcctctggaatccaaaagtcttggtacctgcttgcgtaagttagattcagatctgtgacttgggtagcatttgacagaccaggggtcttagcattaaactttaggtacacagcggcatcgggctgcactctgatgaccagttcgttatttggaatgtctttgaagacacccgatgcgaccgctttgtactgcagtctgatctccaccttggactcattcaaagccttaccggcacgcatcatgatggggacgccctcccaacgctcgttttcgatgttgaaagtcattgctgcaaaagtgacacatttagagtccttgtctacagtgtcatcatccacgtaggcgggcttagacccgtcctcagatttaccgtactggcccaagaggacgtcgtccgtgtcgatgggggccacggcctttagaaccttaaccttttcgtcacgaatagattccgggtcaaaagacaccggtctttccatagtcaagagagtcatgatttgtaacagatggttctgcatcacgtctctgattatgcctatagagtcgaaatagccgccacggccttcggtgccgaacctctctttaaacgaaatctgaacgctttgaatgttgtctctattccacgaggcattcaaaaactggttaccgaacctcaagactaaaagattcttgaccaactctttacccaagtaatggtcaattctgtacaactcttcttctttaaagaggggccccaggtttttttgcagctccctggcagaggccaggtcgtggccgaaaggtttctctacgattacacgggtgatgccattctctgcgtacacacgactcttgatctgcttggccaccgtcaaaaaaacgcttggcggcaaggccagatagaagagacggtgtgggacatcgacgttggcacttttctcgaatttctcgatctgcgttcttaattcgtcgaagccttcatctgtgtcgtaatttcccgaaatgtagctgaccatcttgaagaactgttcgaccttagagtcatcggcttcaccgtgaggttttttcaagtggggtaggacacgggacttcaggtcctcctccatggacaatttggaccgggcataaccgaagatcttggtagatggatcaaggtaaccttctctgaaaagcccaaataaggcgggaaaagtcttcttctttgccagatcacctgacgcaccaaagacagatatgacggtatttttttcgaatttgacggggccttcactcatcttgccttatgtggttttctattctattggatttactctttctgtctatacagccaattggagagggggaagggggagaaggaggggtgagtggagaaaagggagagaggggcaggaggaagccactttaggtgttatgtgtcggtatatagatgaacccacagtttgcttatatatgggatagccttggcgagttttccgtacattgaagaattcgccacccttagaaaaggggccaccacaccttgagccaaaaatcccacattaataatattccattttttttttagtcatttttttttttttcgtctctcttcctcctccggccgagccgaaaccgggcttttagcaccgttggaagcttgtatctccgcgtaagaccgccggagtatgcatcttatagcggtttttccagttcttttccactattacgtggtgcttccagtagcgctactattattgttgttcttgctattatttaaatgtcactatgtacttgatacacacagtttgtggtgatttcacgcttatgtacacgggtgcaaaactacaccttacttaccaggtgctcccaacagagacgagatccttttcgacggcctgcttgacgggcgcgaagacgtactctagcgaaagcgggcgggctgccgcctcttctagcttgggtcccagggttagaggatctaccattgctagctcctctccgtgacgcttattcagtgtctgaaccaactgcttccgcttgagactgttttgctcgccattgagtaggccaccaccgttcatgcatgcacccggacacgcgtttacctcgatgtagtccgagtggtagggatcggccgtggcggccgtggcggccgccatctcgcgtgagttcgcctttggacctgttcgtctcttccgcagagcggtgatgttcctcttgcgctctgacccggagcccgaggtcagtttacgcaccagattttggatgtttctaaacccggaaagctcgctggcggcggctattatgcgatcatcgtgcagcaatcggtactcgacaatgtcgctgtttctaccctccagaactatcatctgacttcctgggtgtagtcgttggacagccgttacgtactggtaggcatagccaccacaagtgcctcccagattcgacgcccagtggactcgcgggtcccatcccggcggtgatagccgcccatataaacttgtgtcctcagtaagaaacgacttgaagtctaaattcaactcttgtaacattgtcactatttcacgtggcgtaatgacacagtcaatcccatcgtcaagcgattctggccttgacgcttctagtttcttgtcaaaacatggcatcagcgacagatggtaaaaggactcacgcgcgatagcgagactctcgaacgtagctctgatcaacgagcccgtaatttgctgaggcgacttgacattgagcagcataggcaccaactgcggtttggtcttttccgtgtatataagaaatcccggacacacagcagataatagaggcttgcggtccgcaccggtattttctttttgtttcttatgcgcaatgatcttctctacggttttgctaatcgatatgattctgcccatctccgttccaaccatatacttgcactggaaatgcttttggaaaaaattcatcaaacacaaatcggccgcctccaatgttaagccgtagtactgcgcaagagatagtctgcattgtggcgagacactcacaacgaggaatttgtcttgctgctgcgaaagcttcccccagtttttcaggaaaaccgagtgactttggctactcaacaagatttcttcactagacgttatacaaccagaacacgcgaggcagtctgatagggtaatagagaccttctccagttggtctggttccgtgctcacctcgtattctccgttcatgttaacgttatccttcttgcccccgctcacctgggtaggtttgacgcacgcaagggcgggactgataaaatcgtttaggtcagactcggacagtagagcactcatgctttcttgtacacttatcttgtcactcaggaaaaggaagctccctctcttatctttccagctgacaagacaagtttcttagtcatcaccataaaacgcttttatcatttttttcttcatgcgatgagcagggaaaactggtaaaaaaagaaaataggaagtggaaaagaaaaaactagcggaaaggcaggcaatatgctttacaaacaggcaaattttgtctcttaatcctgtgaagaggcatcgtatattcagtgctttttgaaatttagaaaatagtcgctttattgattatgctacatatgttattttgctttagtatgtgtcaaatagcatgcaatcgccgggtagtgagtgacacatccttttttcccctcccaccagaaagtcacctgctctcttaatcaatggggttgcatgtggtaatcaattgataacgccggctgacaagtcgccgacgggcacccataaataaacgataaatagcccttgctcttttgttacatgcttcctacttctgtttcccggtccttgtatctcaagacgtttagaagccaccttttacgagcaccacaaattgttttaaaaagaatgtcctcttccatcgatatcagtaagatcaactcttggaacaaagagtttcaatccgacttaacccatcaattggcaaccactgtccttaagaattataatgccgatgatgcactgttgaacaagactagactgcaaaagcaagataacagggttttcaacactgttgtctctactgattccactccagtcaccaaccaaaaaagctctggtagatgttggttgtttgccgctaccaatcaactgcgcttgaatgttctttctgaattgaacttaaaagaattcgaactgtcccaagcttacttgttcttttacgataagttggaaaaggccaactatttcttggaccaaatcgtctcctcggctgatcaagacatcgactcacgtctcgtgcaatacttgttagcagctccaacagaagacggtggccaatacagcatgtttttgaacctagtcaagaagtatggccttatccccaaagatttatacggggatctaccttattctactactgcgtccagaaaatggaattctctgttgactactaaactgagagaatttgccgagactctaagaacagctttgaaagagcgttctgccgatgattccataattgtcactctgagagagcaaatgcaaagagaaatcttcaggttgatgtcgttgttcatggacatacctccagtgcaaccaaacgagcaattcacttgggaatacgttgacaaagacaagaaaatccacactatcaaatcgactccgttagaatttgcctccaaatacgcaaaattggacccttccacgccagtctcattgatcaatgatccaagacacccatatggtaaattaattaagatcgatcgtttaggaaacgtccttggcggagatgccgtgatttacttaaatgttgacaatgaaacactatctaaattggttgttaagagattacaaaataacaaagctgtcttttttggatctcacactccaaagttcatggacaagaaaactggtgtcatggatattgaattgtggaactatcctgccatcggctataatttacctcagcaaaaggcatcgcgtattagataccatgaaagtttgatgactcatgctatgttgatcactggctgccacgtcgatgaaacgtctaaattaccacttcgctaccgcgttgaaaattcctggggtaaagactccggtaaagacggattatacgtgatgactcaaaagtacttcgaggagtactgctttcaaattgtggtcgatatcaatgaattgccaaaagagctggcttcaaaattcacctcaggtaaggaagagccgattgtcttgcccatctgggacccaatgggtgctttggccaaataaatagtttcagcagctctgatgtagatacacgtatctcgacatgttttatttttactatacatacataaaagaaataaaaaatgataacgtgtatattattattcatataatcaatgagggtcattttctgaaacgcaaaaaacggtaaatggaaaaaaaataaagatagaaaaagaaaacaaacaaaggaaaggttagcatattaaataactgagctgatacttcaacagcatcgctgaagagaacagtattgaaaccgaaacattttctaaaggcaaacaaggtactccatatttgctggacgtgttctttctctcgtttcatatgcataattctgtcataagcctgttctttttcctggcttaaacatcccgttttgtaaaagagaaatctattccacatatttcattcattcggctaccatactaaggataaactaatcccgttgttttttggcctcgtcacataattataaactactaacccattatcagatgaaagtgaggaaatatattactttatgcttttggtgggccttttcaacatccgctcttgtatcatcacaacaaattccattgaaggaccatacgtcacgacagtattttgctgtagaaagcaatgaaacattatcccgcttggaggaaatgcatccaaattggaaatatgaacatgatgttcgagggctaccaaaccattatgttttttcaaaagagttgctaaaattgggcaaaagatcatcattagaagagttacagggggataacaacgaccacatattatctgtccatgatttattcccgcgtaacgacctatttaagagactaccggtgcctgctccaccaatggactcaagcttgttaccggtaaaagaagctgaggataaactcagcataaatgatccgctttttgagaggcagtggcacttggtcaatccaagttttcctggcagtgatataaatgttcttgatctgtggtacaataatattacaggcgcaggggtcgtggctgccattgttgatgatggccttgactacgaaaatgaagacttgaaggataatttttgcgctgaaggttcttgggatttcaacgacaataccaatttacctaaaccaagattatctgatgactaccatggtacgagatgtgcaggtgaaatagctgccaaaaaaggtaacaatttttgcggtgtcggggtaggttacaacgctaaaatctcaggcataagaatcttatccggtgatatcactacggaagatgaagctgcgtccttgatttatggtctagacgtaaacgatatatattcatgctcatggggtcccgctgatgacggaagacatttacaaggccctagtgacctggtgaaaaaggctttagtaaaaggtgttactgagggaagagattccaaaggagcgatttacgtttttgccagtggaaatggtggaactcgtggtgataattgcaattacgacggctatactaattccatatattctattactattggggctattgatcacaaagatctacatcctccttattccgaaggttgttccgccgtcatggcagtcacgtattcttcaggttcaggcgaatatattcattcgagtgatatcaacggcagatgcagtaatagccacggtggaacgtctgcggctgctccattagctgccggtgtttacactttgttactagaagccaacccaaacctaacttggagagacgtacagtatttatcaatcttgtctgcggtagggttagaaaagaacgctgacggagattggagagatagcgccatggggaagaaatactctcatcgctatggctttggtaaaatcgatgcccataagttaattgaaatgtccaagacctgggagaatgttaacgcacaaacctggttttacctgccaacattgtatgtttcccagtccacaaactccacggaagagacattagaatccgtcataaccatatcagaaaaaagtcttcaagatgctaacttcaagagaattgagcacgtcacggtaactgtagatattgatacagaaattaggggaactacgactgtcgatttaatatcaccagcggggataatttcaaaccttggcgttgtaagaccaagagatgtttcatcagagggattcaaagactggacattcatgtctgtagcacattggggtgagaacggcgtaggtgattggaaaatcaaggttaagacaacagaaaatggacacaggattgacttccacagttggaggctgaagctctttggggaatccattgattcatctaaaacagaaactttcgtctttggaaacgataaagaggaggttgaaccagctgctacagaaagtaccgtatcacaatattctgccagttcaacttctatttccatcagcgctacttctacatcttctatctcaattggtgtggaaacgtcggccattccccaaacgactactgcgagtaccgatcctgattctgatccaaacactcctaaaaaactttcctctcctaggcaagccatgcattattttttaacaatatttttgattggcgccacatttttggtgttatacttcatgttttttatgaaatcaaggagaaggatcagaaggtcaagagcggaaacgtatgaattcgatatcattgatacagactctgagtacgattctactttggacaatggaacttccggaattactgagcccgaagaggttgaggacttcgattttgatttgtccgatgaagaccatcttgcaagtttgtcttcatcagaaaacggtgatgctgaacatacaattgatagtgtactaacaaacgaaaatccatttagtgaccctataaagcaaaagttcccaaatgacgccaacgcagaatctgcttccaataaattacaagaattacagcctgatgttcctccatcttccggacgatcgtgattcgatatgtacagaaagcttcaaattacaaaatagcatttttttcttatagattataatactctctcatacgtatacgtatatgtgtatatgatatataaacaaacattaatatcctattccttccgtttgaaatccctatgatgtactttgcattgtttgcacccgcgaataaaatgaaaactccgaaccgatatatcaagcacataaaaggggagggtccaattaatgcatatttaagaccacagctgaataactttaaaacggcagacaaaacaaaaaataggtcgaataaaccttacctgcctagaaggaatgacagcagctaataagaatattgtcttcggattttccagatccattagcgcaattctactaatatgctttttctttgaaaaagtctgcggtgatatggagcatgatatgggcatggatgatacttcgggatacacgaggccagaaattgtgcaggctgggtcgaaatctttccactggctctgcactttgggattcttgttgcttttaccatccgtggtgacgtgcctttcgttcgctggcaggatatattcagctaccctcttacaatgcacttgtgccgtttacgctttcttagaagctgccgtattaagatttcaagacaatgatggggtagaaaatagaacttcaaggggaaccgcatggtttttggtgggacttacttggataaccttattctttggtggattagctggaggaactggtttcttagtgaaaagcaagaggttgcaaacgttcatatcaaatgcaggtgagaaaaggttgtcatatatccatcgtggtttatcctttctaactgttctaacaggttgggttaaagtctgtttggcacctgttgcgctctttgggttttgtagagaggcacacacagggcaatgcatcgctcatggtatcatgggatccgcgtttgtgttgtacgggttcatttatgtactggttttggttataccatggattcgcagtgcccaaacctcatattcacaggattacgtcgacagttgggttatgtgcatatggggcgttgtaaatacttttactgaacacaggtggggacgtgaaggatggagtgttcacgattatcaacacacgtttatgggaattatctggtggactggtggaatactcgggattttcctttccagaaatggcagaagaacatttgtaccaagtttgattattattttcaccggatgggccatgtctgagcacgcccagcacttgataattagcacaaaagtccataatatgtttgggctagttttaatgtgtggaggcgctttaagaattatcgaaatatcttttttactacgtgataaaagaacgctggacaaaatacattcattccaataccttgctcccttttgtttagtatgttcaggtctcctatttatgggcgcaaacgaagaacaactcattttagtgttgcggttgggaggcgaccatagtgcgtacgttctaattatcgtatcaggcgcatttttggtctacttctggatgattgcatgtttggaattctacctatatctacttgaaaagggaaaacaaggattccttccgaaatcatacgaacttgaagaggaaaacaataacgtgagctttgagctagataacatatcgaacgaagatgtggatgaagataccactccctttaacgtttgaatagtgggcaactaatgtaatataagacatttgaaagtccgatcctacaccctctttgttagaagcattgtaactttatttttttttataatactctaaatgcggaactgtatacactttgcacagtttgtattcaaattgtttgcataaatatataaaaattgccacgaacacttttagattccttcgttagtctcctttgtatattgccgtttgcaggctcatgatgataaatctcgctatttcggtgaagaaaaaaaaagctagcttcgaacttttcaaaagaagtataatttcatttcaaaaataaggtccaaagaaaagaaactagcagacctgaccttctgttggtaaatattagtatgatgcttggagagcatttaatgagctggtctaagactggtattattgcatacagtgactcacagtcctcaaatgccaatatttgcctcacatttttagaatccataaatggaataaactggcgatttcatacgccgcaaaaatatgtattacacccgcaattgcacgaagttcaataccaagaaagtagtagtactctaagcactcactcgacaacaacttctgtcaatggatcaactacagccggggttggaagcactccaaacttcggaggcaacagcaacaagtctcctccacagttcttttataatatatcttccattcattggaacaactggtttagtttaccaggtgacatgttggctgtatgtgacgaattaggtaacatgaccatgttaattactggacaacgtcctgatcgggccactacatacgaaaagttaacgatggtatttcaagataatgtttacaaaatttataaccacgttatgcctttaaagcctgtagacaagctaaagcccatgaacattgaaaggaaacaaacaaggaaagaatacaatacatccatcttggaatttcgctggctcacctcttcaaaatccgtaatcgtttctcaattctgcgcatttgatagtagttctaatacatatagaagcagagcacagcaagtgcctccatatggtgtgtaccatccaccctttataaaatatgcgtgcttggcaataaggaaaaacggtcaaatagatttttggtaccaattttcaaactcaaaggatcataaaaaaataacgttacagctgctggacacttcaaatcaaagattcaaggatcttcaatggcttgaatttgctagaattacacctatgaatgatgatcagtgtatgttgataaccacatattcaaaattatctaaaaatatctctttttacaaactacacgttaattggaaccttaatgcgaccaaaccaaacgtcctaaatgacccatcgttgaaaatacaatttatattaagcactactttagatccaacggatgatgaagggcatgtgttgaagttagagaacctgcatgttgtgtctaaatcatcaattgagaaagatccctccccagaaattttagttttgtataatgtttgcgatacatcaaaatcattggtgaaaagatatagactagctccaacacaactttcagctgagtatttggtgatattgaaaccagatttaaatatcgatcgaaataattctacgaatcaaatattccaatcgcgccgttacaaccttcgtcgccacagtgatatcgttctcgacaaaaaagtcaccttgataacttctgagatgttcgatgcatttgtttcattttactttgaagatggtaccatcgaatcctacaatcaaaatgattggaagttggagactgaacgacttataagtcagagccaattaggaaaattcaaaaatattattgcatccccactaagcgcaggatttaattatgggaagctccctttacctccatcggttgagtggatgaaggtttcaccatctatgtgtggggttatcgttaaacagtataataaaaaatggccacagttttatgctgctgttcaaaaaaactacgcagatcctgagaaggattctataaatgctacagctttggcatttggatacgtgaaaagtttacataagcaaatatctgccgaagacttgaccatcgctgcgaagacgcacatactcagaatttcattcttggatagaaaaagggccaaagaatttattacgactttgttgaaaagcctatactcgtttttcaacatttctcctgatgcgcctaaagagattatggataaaataataacaagtaggccacttcaaaaaattatgctattgcagctggaacttggcagttgtttttcgcaagaaaatattgaagaaatggcgagagttatactctacttgaaaaatgttttgtttgcgttcaatggtgtggcgagaaattttcattttgcgattgaacaaataagtaataattctaaccaacaacaaaacccgaagttgttccagactatattttcaaaacaggatctcattcattcattgattcctgttgctaaatggtttgtcaaatttatcacttatttgacccaagaaattttaattttaataaatgatcccacaaacaaggaatacacactagttcacggaatatttggagccaaaatgtccaggactttgatattgtctattcttaacgaaatcaagaaagtcacccaaatagtggcgaaatttccagaaacatcatacccaattttaaacgagtcatcaacttttttgaaactagtcttatctgaatcaccagtggatttcgaaaaatttgaaacgtttttagttgatgtaaacaacaaatttatcgcgctatgcgaacaacagccatcacaggaacgtgagttttcgttgttggtgaaagctgaaatccccccagaatatgccaaagtgggagatttcctcctgcagtatgctaataatgcagtgatttcccatgcgaatgcggctgcagtatattttgcagatacaagtggcttgaaaatatctaattcagagtttttcaatcccgaaatatttcatttattgcaaccattagaagagggattaattattgatacagataaactacccataaaaaatagaacctccaaatcttttagcaaattactgtacgacgatgtaacctgtgacaaactgagtgtatcagaaatatccgatgggaaacttaagagatgcagtaggtgcggttccgtcacaagagcaggaaatataatatcgagtgataagacaattgtacccactagcatccaaaccaaaagatggccaaccatgtatacaagactgtgcatatgttcaggtatgctttttgagatggacggctgattattagtactatagcatagttttgtatagaattgttttaaacatttcacttctcgacttaataaaaagaaatgagagtgacagtgtctggaatttctttcttctagaataccaagggtacgcatttctctcctacggaattttctgtgcagatgtcccgatctacgtggcagatagtgaaaactccgtaggcaaaaggggcatcggaaaaacctcttcaaaaaaaaaggtttttaggctcgaacgagccggagcaataatgttcctttgaaaaatagcaatcgttatgcaaccattttatatgagtctgcccctcaagggactcgccaccggaccgctgcagttgtttgcattcatccacatataagctggttgtgtatgacaggagaaaaaatacttcattcgcagttgttaaccaacagcgacatgtctagcgggaatgtccaccatacgaaaccgatgatgtacaacgtaaccctgccttcctacaacagcagtagtataggtccagtcgataatttgaaaataaacgagagacctggctctcatgatcattccatgagaagtgaaatgtcatccaaaaactccggaagcgattttatgccacaatctatttcacgttccgaaggtagtgtctaccaggtcaagatagatcgtggtgactccccgaatacagaaggattcgactttaaagttaatgcaagagatctgctgttacttcgaatgtcctgggatatcctcctcagggagtatttaacacctaaagaattaaaagtttttcaagcacttctgtattccaataaacatattacttcaacagaaagaccctatttgaatactgctcctgacggtatgatttccaaaactattgaccctactgccaggccacgtaaaacaaaacaaagggacaatgataacaaggttgatactgcactattttgttcacagttttatgacaatttgattgcaatggatcccttgttagaagaatattttccatcattaaaacatcaagcagtttcgttctgtaaggtccttgattctgctattgacaaccttgaaaacgttcatgtcctagatgattatattgtgaaattaggaaaacgccattccagaattctcggcatcaaaaccgttggtttcgaagtaatgggaaaagcatttatgactacattgcaggacaggtttggatcttttctcacactggaactcaaaaatctatggggacaactttactcatatttggcaaattgtatgattactgcagggaaggacccaatggaaaagattcaaccagatttttcgtataatggtgactctgtggttttaaatttttccattcccaaacttgcgatgcatgatataagtacagttaacaagctacaaatggtgaaaactaaaaacgctactatacctcataatataacacaagtaccgacaaataaaattcctacagaaatactcttagacaattcttctactccaataaaaagcgaccgtgaatcgacgcctccaatctcaccaaagggctctggaagtacaaaaccaagcatcggtagcagtaccgtcgtggaaagtaataccaagaaaaataattatgatgaaaaaatccatttattgcaaaaaactgctcagcagaagaactgctcgattatgtaactacaaccgtaccattaagtgtataagtttcccaggttatattatatattctttagatcactgcctgttctttattacccgcgagctaatctttgtcttatataggcgcgtcagcggagacgcgtcaagtcaacttctctcttctatcgtcccgagtatgaaaaatcatttcagattcgaagaaatcagattggctttatatcttctttagaacaagacgtgtaatattctcacacttagagttgaccccctcaagttcgcttattagtacaggttttgactttgcaaataaacaacaggaaaagcgactcaaataaattgacaaagaaatctcaacaaccagagtgcaaaagccgtacgagcagcgtttttattaataacgatatatcactacgtattcaacagaatatgtcggatagtatttcagattcaaagtcctcagaacttttaaattctactttttattcgtcgacgtcgataaatacacttgatcatgctagaacctttcgaaattctctgatattgaaggagatatcagatcaaagtctaaattcatcaataaagccatgcgaatccgtccttgatagggatgttgaaagctcagttctgcagcggtcgtttggagaaagtaatgcccgagactcagaagtacaaacggtaaatatgacaacttccccctcattaagtgcattggctgatattctgaacgaaagatccaaatatgctgaccaaaaaactagaaaggcacaaaatattgagtcttccataatagaagaagaagaagaggccgaagagcaaaacaactcgatcaattatcacgaggatataactggatccaggctgtctgtacgagaggaagcaaatgaaaacttggcgatgacctctccaaaccttattgacattgacggatccaatagtattcaagttgcccctttgagtttaccgtctttcgaagaacctgactttttgtccactcctagagtaaaacctgattctcagggacctcggagcaaagttagtacacgacgtactattctcgaacgagacaacaatttaccagttaagcgggaggaaaatactatcattaattcagaaactgaaagcacaacacatagcgcaccatttttaaaagaggatccgaaaccctcgcctccttcgagtaaattatacaacccaaaagttcgtttaaacaaagcagaagcgcgaaagtatactgattcttctgcccaaaggactacttcagcaggctcggtacttgaagacacttctatgcataaaaagaaaaagagtatattttcatttctgaagaagaaagaaccgaaaccagttattggtaataatagtgtaacgaatgaaaaaaataagatgtcttcatcgagcactttctcaatgaatattcaaacctctttaaaaacgcctgaaaaactaaagaagaagtctcacagtagcagtagcattttcaattccttcctaaagggaaaaattgaaacatcagactcacctcgaaaggaaccaatgaggcaaaaaaaaagaaccccaaaatccaaggacaaaaagcaagatactgaacaaataattgacgccgcatcagtgttatccactgaatcacctctactacgaaaaaaccacgacgatactcccgtgaaaatagatcacgtaacgagatcaattgatcagagaaaacctactcctttaaacatggatctcatattgggaggtgataaacagataaataccccgctacaagaacacgtaagagaagatgatgatgccaaaaatgatcttcaattaccaaccaaggataattttttatcactggactacgaagcaccctcaccagcattttccaaacacgatacaggtgaggttcttttcccaaaatttttggataatcatgaagtcgactcgatcgtttctttagaaagaacaagatctacaaagtctaacaagagaagttcaatgaactcgcaaagaaggtcattgacagatacgctatcgatcaaagcgcaaagtgagggaatgttcatcactgaggcatcttctgttgtattatctactccagacttgacgaagtctcctgctagcagcattttaaagaatggaaggttcgaatactcagataatttctccagagaacactcttacgaaggtaccacgaatgaggactttttagatatcaaggacgatagtggtccactaaaaaaagatgacatatttttagagtctattgaacaaaaatttgaccagctagtgatggcctctgatgaagaaaaaactgaagttgaaagggatgtaccaaaaccaagagaagaacctctgaagaaggattctgaaaggcaaagcgtttttgcagatgatgataacgagttaatttctgatataatggagtttgcaagttttattaacttcggtgatgatgatctcaatctagacctagacttgggagatacaacggcctcatatgcaacagaaacccctgaacctgttggaaatgatgaagtaaatcgctctggtacttttgatacacgaaataacaaagaggatagttacaaagaaagagaaactcaatcttattccgctgctggagctactacatacggagatgagcgtcaaggtcaattacatacatttgaacaagacggaagtgaaataaatgacaacgaatttgagaatgaagatttcaacaaacacatagaacagcccatagaagttactccaagaaataatgcatatttaccagaattcgaacccaatagacctgtttcaatgtcctttaaaggactaaaagccccaagaatgaatacttcttttattgactccatgacgcctgattctcccgtaaaatcagacttaacaagtctaggtgaggtgtatgtaaacagtaataatgaccagggtgtccggttttcgtcccagataatactttacgacacttatggagaattcgaatatgatagacatccagaaatttccacttgtaaccagcttactccacaactggctcaaatgatcaaattggaattaaatgagttaaagagcgcaatggaagtacacgatgattcgcgatgttacacacatttttattagagcagaaaactgggagaaatggaaatgaatcaaatcatacatatcaagacattctagtttttataaacctataatttatcgcaagaatcttgggtgttatgtgttgtatttgcggcatcatttcaaaataccgtctgcattacccgtctccgtcacgtgaagtaaaaatttccaaaaaatattgaaaaaagaaagaaaaataagatccagaattcactgatgatgagcttatggtacggcatgattaactacgcatttgtatattaaagattctttgattttttccagagcattgaatacctcaatctataagtgtattataatggcatgcaattttcagtttccagaaatagcttatccaggtaaactaatatgcccacagtacggtacggaaaataaagatggcgaagatataattttcaattatgtgcccggtcccggaactaaactaattcaatatgaacacaacggacgaactttagaagctataactgctacactagttgggacagtgaggtgtgaggaagaaaaaaaaactgatcaggaagaagagcgtgaaggcactgatcaatctacagaggaagaaaaatcagtagatgcatcacctaatgatgtcacaagaagaactgtaaaaaatattctggtttcagtgcttcctgggacagaaaagggtcgtaaaaccaacaaatatgctaataatgattttgccaataacctaccgaaggaaggtgatattgtgctgaccagggtgacaaggctttcgttgcaacgagccaatgtcgaaattttagctgtggaagataaaccatctccaattgatagtggcatcggcagtaatggatcgggaatagtcgctgctggtggcggttctggagcagctacgttctctgtttctcaagcatcatcagatttaggtgagacattcagaggtataatcaggtctcaggatgtacggtctacagacagagatcgtgtgaaagtgatagaatgtttcaagccgggagatattgttagggcgcaagttttatcattaggtgacggaaccaactactatttgaccactgcaaggaatgaccttggggtcgtgttcgccagagctgctaatggtgctggtggattgatgtatgctacagactggcaaatgatgacttcaccggttacaggcgctacagaaaagcgcaaatgtgccaaacctttttgatatgtaacagcttatctacagtgcatatagacgcgtatatatttaaaagagggtattcgcttcttcttctttagattgcattctttgatggttaggaaaaagaagcgggaacgtgattaaactttttattctcttttatttattatatattatagtgcattatcattatctatctaaatttgcctttacacggtactgctttccgattttactgggtaaagaagtttttcatgagtacctcttaaatcaacctcacttaaacctacaataccaccgaagctttgaaacctcttaaaataatgatctcttttttcacgcgcggtttccaccagagctggccaataaacatcatgattgtacttgaatttcagatcaccaccatacaacgaatctagttcgttcttagggacatatttaacaaatggttcatcaaaaactagcttttcacgggtcagtgggtcaataaaagggtgaattaacttcaagaaagtccatgctaaccaaggaatattcgtcaaaagtgcttttcctagtctttctggataatgagtttgtagaatatgcagcacttctttccctacaccaataggtgggattttactattgccaggtactttaggaacatcagggtaatctttaaagtctattagcaaagctagagagtcttgaccagctggcataaaatcgataactctttccaacatgaagaccaagtgctgtacctgtctgtgagaagtctttgtattttgtctgcccggtttcaaatataagataggtctagcatcgttttcgtaacccaaaatcacctgcttacctgattcgttctcgacggccaccaagtcagcagttattttatcaccatgctcttcacctaaatgactaataccgaattctcttctccacgctagagtcatggtgattctatcgatacagtcttttagcacccatttagtagcccttaggtaacgtaaaaaacattctcttgtcaaccatgccttttcttcttcctctaagggtttaagatcatcctccgacttatttttttcacttgtataaaccttcaagtcagggttactgaaatgttttagcacttcgtcatacattttttgttgctcacctgtaagtggtttttcttttggaatagctatcgaagcaggaagttctttgataggcttatcaatattaatcaaattttttgggtcttctggagcctccttctttttgctaaatctcttgaacattttttgcttttgtaattttttttatataaagtggttttgtattatttgttggatggagagaagggaacagttagaaacaaaataaggattgaaatatttttctaacgaagaagtggtattagtctatctagaactgatatatatacatacatatatatatataaatatatatatattcagacaatgagcacaatattgtgcatgtacaagagtgggatgcgcatatagtgcatgaacctattgcgataaagatctggcaatatatagagagatatatcgcatgcttgcactcaaatagagtcgggtggaatgaaaaaaatcataaaaattactaagacggaagacaaaaagatgacgcgcaacgcgaaaatcgcttataagcagggatgccgttgcttccggttgctttctttctccgcggaatgactggacccgtgggaaatcgcaggggatgtgacggccttcggagttgggttactgctatttccgtggctcatagatatacggacgggtagtagggccggttgcggtcacgtgcggaaaactatctccgtcagatccggcatttcgtacgaaaattccggatttcttcttcttgtggccctttgttacgggatttgcggtgacacttgatattgaagttacaacatctttgtggggataaggatgagaagtagtacggtgatcgttggtgatcgctgttgtatggggtcgagaacctgcagcgtttgtcttcggagtaggcctgaatagcgcaggttttttacgattgagaaagattgacggtgattcggatcttctcttcttcaccggcgtgatgggctgcgtaacatctttcttctctgctgtgacattatccatttgacgatttaccttaacaggctccggtttgatggacaatgggcctttcttgggggaagacgattgtccgcccgcttggccaccaaaggccacacgttgcgcatgcctttttgcaatgttgaatccgccgtctttgaaatgctttagtctggactcgtgatctttcaacgatttcatgtataattgcgaatggggttcgttgtgcaaccttgtagtcttcttggtgtttctctttttgaagtaaacagtgtggtcaaccactatggtttgctttttttctctttcttgctgcaacttctgcatttccagccttaatctctctgcgctttcctcttgtttcttttccacttcttgttggtactttgagtataacattctgtatggtattcggtacttgttgtttcggatgtctttgacgactgattgacgcacgcaagacttcaataaatcctgattcgaatggtacagttctatatcgttttccttaacgaaatcaaagtaatatttgcaaataatgtctctcttagagacaaattgttcgtgtacattagtcgggaaatcttgccttaaaaattctaaccatagttcatcatcgtcaaatatcaatagtacgttgcttttctcaagttttaatagttgtggtatttttactttctgcagtatcctctttaataagtgataggggacattactcacagattgtatgtttgaatgatttctcatcaatgagatttcacatagtgtttgtaaacttttcatatctcgacatcaatcgatttatacattcactagaacgtatttccatgaacaaaaaccgtttgcatgtaagttacatatgtatctaatcgtcataactgaacaaatcccttcttcgcaaatattaaatatttgaaattttctattgtgatctttcttaagcccatcgtggcaaatgccgagaaaaatacgcaattgtaccagctttattgaaagcgccagatatacagtgacaacaccccgaatatagttgagaaatttatagtatttcaattattacataaaacaaaattttggaattctgtggttggggtaacaaagaataaatagaagcaacagaaatttcaaaactattatatacttctatgacatttttgtttatatttgcacttaattttcctttttgtctgcctatatacatacccttataaccttcttttcctccttcttctttctttcttgtttttaaagcagccttcattcaccacgcaatgccttgatgaccgcgggtcttctcatcatatgcttcgtccatttgtaaacttctggaaattcaattttgatattaatgccaattctatccacgacattattccatgggacaaaggccaaatctgctatagttaatttatctcctacaagccatacgggataatcaaagaaacgactttgtgacattggtgttgtaccagctgagtatgcagccgcattttccgtgtctaattccatcaccagcgcttctctacgttcagccaaggccatctccactacaccgtaaactcttctaacctcatccgtatatctttctacagcacttgctatcttttgtgaatggaagtatctgaaatgtaaagcttgtccaatcattggcgcatgccctgacgtttggaagaacaaccatgcgttgatttgtgattggtcagctaaatcatcggaccagagtaatggattaccagtctctttgtaatatttatttaccaaatgtaataaaatcgcccctgattcccaaatagacaagttgtccataccatgatcgattaaagctggaactcttgcattagggttcacagacacaaattcgggggccctatgttcgccaagattgaaatctaggaagattgtgttataatgaaatccaagttcacttagtactatagcaactttgaatccattaggcgcagacctgtgagagaaaagggtatatccctccagtggttgttcttgaaaaaattttgtaattctggaatactccacgtgactcatatccgaaaatgcctgttgttgttgtcgatgttgttctaaggtattcttgatattattctcgttatcattattttggctaccattgcggccgctgttattgttttgaacattattgttattactactgctattgttattattattattatttacacctgttgaaaattcaaaatttatattactttgatcggtggttgtattactgttcctgtttcctatgtttacttgacggagcgcattggagagattcgacacttggttgccgttgttattcatcatttggtgtacaacttaatttgcagcttaaaacaatatgactaataacaaaaaatgaaaaactaaaaataaagaagttcgtacgggggatctttattcctcttcgattcaattcagtgctataaacaattccaaatgagctgtttgaaaaggaaagatttttgctattcttttcaacctcgagtaaggaagctttcgtctttgtatagttgcttttctggcctagtagaaaggaaaactacatgctgaagccactcttcctcaaaaattcaatagtggcagctcatcaatcctcctattcggcgagaattgaaaaaaaaattccaggctgcgtcacccggattaatgttgttattccagacaacagtcggtattcattttccacattgactacagttaaattaaactctacacagctctactaataatttctgtttcggcgttctatggtttggtgtcactatattcttttggtcttgactttctttcttttcactacgtttttcactgccgcatgccctgctatcttcacgtggttgaatagcttatttcgactatcaaatgattctccgcatgtagtgcacacctcgatcgcggaggttggagacatagaggacggtagagtcgacaaggacggagtgctttttgtggatttagaattctttttaggttgtttgccctttttctttttcgctttagtagaccaatcttcatcgtcatccgtttgtaagcccttgtctcctagtgatgccaaaagatcatccaactcattactccgtttgtctttagtatcatcgaacgattcagattcctctgtttctgtgtcaacctttgctttttttttcttttttcttttctttttattcttcgtattcacatgtacattttcatccgaactgacgtcttctacctctatatccatttctatgttgagattgtcatcttcactttcgtcttcagaagacgattctgccagttttctttcaatttcagcgagttcagcttgcaatgcttgcagatcaatatcttctttttctttaacactttcatctgctgaatcaaatttctcgagatcggagagattatccaacccaagcgttatgttttcctcttccatttctttccgtatctcttccatatttttcttatgcagtttagtgtttatgtggtttttcaattgcttttccgacttaaatgtcttgttgcagataaaacactcgtaaatcaatacttcaccttccttatcattcttagaattttcgaattctccaaaattatcatataccttttccagttcatcccagttttcttcttttaccgtttgccagctttgtaaatgaaatttttcttcgtcattgttgtcgttcccaaactttcttctgttatttaactcatttttcctctgttgttcttttagtttacgctgttcttctgcaatttttgcaccttctttcattcttttatcgagcttttttatgaaaactacaaaccttttcacggttttgttgtattcatttcgagcttgttgcctagccttctcatttcttctattaacttccctcttggttcttctgtcatagtttttagagtacatgtactcgtctttccagctaaaacttttcaaggtattgaacgctgaccaagtcttatagaaatgtttcaaatattcataatccgttggcgaatatccaaataaaggatataaaagtttatccgtcttgttaataaagttatcgcaggctttcaaatagccaatactattaatatcctgttcgaatacatcatcttgatactcggaaaatttccccagtcgcttaccacttaaaatctcatctttagctaacttggcaaatatttttcctgcaatttgatatatcccagcagctgagttgtctattttagtataaagagcagagttaaaaaataagagtaattcatcagttgtgacacctgtgactgtagcgtctacctcataatcatagtaatcatcagtgcttggtggagtatcatttaaaatttgttccttatgtgagtcataccatgctctttcctgggggtcagacagtacttcataagcggctcgaatcacagcaaatttttgtgtggcttcttcaacattatctgggtttttatctgggtgatattgtagggcctttttacggtaagctttttttaactcaagatcagaagcatgcgtttcgacccctaaaagctcatagtagcaggtcttcatccgttatttttgaagtagtaggatatcactatactgatattaactcttggctggtcagacttttactatgtaaaaagagctactttgcgatgacttcaaatttttttcacgtatattttttttctattcttaaaacaagaaaaagtgtaaacataaaatgttggccgcttaagccctccaattttacaacaaatgaatattttatacatacttcctagaatataatttaatcttataccttaatttttagttacaattacaacaatttatctattgactccgttaataaaaattacttcaccatcttctccaggatatgatcatacagatggtccagacacctctccaaatggtgatctatggaatccatcctgcgcgttgacataaaatcatagtatgcttgatccgtaaatttctttagattcatttcttgactatatacttgtctatgcagacgttgagcaaaattggacagcatgatgttttcatatttcaatttgatagccagcaacggaatctttcgccttaactttggataaggaataccaacagccaaaacaatttctttgacagtattttgtaaagtcgtcaaatttgctgaatcaatttgttcaaccataaggaaattacattcttctgccgaaatatcgggccttgactgtaagatattttttattgtaatcctttcagaagtatttccctctaagtttccaaatcgcgacctcaaattatccagttcctttgatagagtgtttgttttcttttcagcatctgctagcattttttctttatccttcaatgatgtttcgtatttttctttgcttttttcccatgatcctagtctttcattcaacctttccagcttaatttttatttcctcattacatcctttcaaaatttccttctcatcgattgtcaacttgtcaaatttatcacatagtattttgttctgtttggaaagggttttatttgtaccaattaaagtattatttttttctctcatggtctggatttcaatttttttattctctaactcatttcggagatcctcagcttctgcttttgcatttttaaatcgctgagaaatgcggctcagctcttcttgctgtgatgcacataaaaaccctttaatattaggatatttttcttgtaatatgtgatctaattttgaagaattttcctccgagtcatacaaatcgaaaaacaatataccaatcggtatttcaaacagctcggcctttcttaaggagtcagtgagacttagtaatgcagtgtgttttgtctgaatagtatcattggctttttccaacatttctttattcagcgaaaggtcctttgttaggttttcaatcaatactgtctgttcttcaattttttttttgttatctaaggttttgtcgtttgacttcgtagctgcttcgagctccttttgtaaagagtttgctctttcctcttgtcttagattatctctacccaattcaataacttttttttgataccccagtatcacattttctaacattcgaaaatcctctttcgataaggagttttgtagaaaaattttggcaccgttacagtcttctatcgagatatctggcgatgtatgttcatcagttggttgagcagaagcctgttcatttgccctcgtaaaatgcttcgaagagttttctctaggagtagagtgtatgaaattgggtacatcctttttatgaacatcagtacctatgggagacttatctttttcgttttttggtcgttcttgtaatcctggagattcctgataactagtatttctagcataattcatttgatccatagatggtgatttgttctcttcatatgagtctctagcattggaaaagttgcaattgatgacatcttcagggttaacgaataaaggtaagatggattttccgacatgattttcatttagccagttttgtgggattggctctccgtctttaatttccccattctctgatacaggagaatccaaacgctcatgaaatggaaaattcattaaatcgaaatcagtcatgatgtacaaaagacctgtcactatttactagtgattattttttgtatgtgtagatttcttcccgaggaacgttaacgttattagttgttttattactataaacgttccacaaaaaattgcctaacgcctcacgtcgcgcaacgcgaattttcacaagaagatgttatttacagttacgataattgaattggatatgtaacgagaagttgtacctaaaactccgtatgtgtatattaccatagatttttcatggtctagtctagaaaataaaaaaatatgtatatacgcaattgttaagaaaatgaggattaaaagcttggaaaatattaactttcactgtgtcttaaacccgatctattctttttaattttggcaaaaattggttcacttatacctttattgccttgaataccaaggccctctccacttttccacccaagcttttccaacattcttctaccgatattttcgtttccaatctctggagcgttttgaccaacaatctcaccttctttaacatgaaatttccctctgattgttttagttctttcgaaagcagcttgttcctccctcggtcttcttatatctattctcatgaatactggcctctgcctcatcaattggtcaatgagactataattcggagaagaccatttcgttttctttattttttctacaacaaccgacgtatgatttgctttcccaatttttgaactcttcatattataatgcttcgcaattttcattacggtcttgtttccatgaggatctaatggagggaaagtcagtctatcattgttcctagacaaaaaggactcaaattcatctttaatattttgaatatggagtccatatgggtatttcttgagcatatcgttcgaatttctattctcctgatcaatgaaatcttctttggcttttcttttctttgctttggtttctatgcgtttactaaacttactttgtaacgtctccaacgtttctgtatccagcgctaaggcgtcatcgatgagtagcttcttcttcttacctttacccttagtttccaaggacttggtttcaaatgttttgaatctttctgtatcatgtttcaatgtgtatgcaattaggtcgtccagaccctcttcaatgtcgctatgcacaaccgaggaggccatatcttcatcatcttcatagctgtcgccttcatagctgtcaccttcatcactcgaatcagaaatcggaatatctgagtaggttggctcagctggttcaatttttggtataagagaatttttaataaaattcaaatatgcaggtaatctatcttcaggaagacctaactcgtctacaacgaagtctgtgagtaagtcctggtcaatccaatgaaagtcgtaatctcccagtaatctgtaacaccgtagataatatgaattgtctactccgcccattcttatattggagaccactatgtcattagtatttatgacaaaatcttcttctttgaatccaaattctaactcttcgctagcaggagatggcagattatcattattgccttcgaatgttttggtaccatttattgaaagacattttatatcttctgtcaactgcggactagggcttggtaaaagattgttgtcagctcgggaattgtgacgttggccaacataattaaacccttgatcaacctcagaacttgctgaggattcgtataaaggttcactattattctctgtttctatttcgtagtctagttcatcattgtccgagtcgctagtatgcataccatgtaatacgttggaaatgtaaccagcaaatggatgatatgtcttattacccttatttggaacgtcaacactaatttccttgctttcgttaccttcggaaacgctaagttcaacctttccaattgttaagataggatcgaactctatcgcaacttctcttggccttgcgatttcctcgatacatactctttttattttggttagatccggcgattgctgagcctcttcatctacaaaaaacaggtcaccatcttcaactttgctttcattcgaagacagcgagtggtccgtcgagggtgaattctgactatcatcatcctcgttttcactgtcttcattgttaatatattcaacatcagaagtcatctttcctggttcttcaaaaacgtctgcttccctttcgacaatttcttcactgttctttgtttcgttctttgctctcagtttttgaatcatattgtgggatggatcgtaaacttccttagcttttacaaattgcataggtcttttgcggaatgctgcccttcctgcttgtaggtcagttgaagaatcatatcgattacctggtcttaaaccacccattttcatagaacggctcttggcatcgcgaccaaaataatagtcttctatagtttttggtgatatgaatgctcttcctgggttgaagtcggcgcctacatcatcaagatcaccttctcctagtggtatagaagagttatgccaactgttagtgggagtaggttttttctttatctttctgccttgtatgcctttagcattccccctgccagctttcttggaattgctaccacgtgcatgcctacgtctgcttccttgataatgactatgcctttttgccattttttttgacggttacaacaatttatgcttatatttgactctgcgattaaatcacttcttccttctagaaactctgcgcaggcctaattgttgttgttttgttcagatcttatttaattgtaaaatgtcaaatttcacttttattctttaggcggtgaccgttgcagctgccaacaatagcgcctcaaaggaaaaaagtaaaaatatacacacaataacgttagtagatgaagaatggacgacttcttatcacgtataggagtgatatacatgcagaggtggctacaactgtggaaaatggatttggtacaaaaagtgtctcatggcgtttttgaaggctcgtccgaagaaccggctgctcttatgaatcatgattatatagtattaggggaagtatatcctgagcgagacgaagaatctggcgctgaacaatgtgaacaagactgtcgatatcgcggtgaagcggttagtgacgggtttttaagctctctttttggtagggaaatttcttcttacacaaaggaatttcttttggatgtacaatcaagggtcaactttacatatcggacaagatttgttcctatagcaagggcgccagatgggccttcacctttaagtctaaatttattagtacgtacaaatccgatcagtacaatagaggactatatagcaaatcctgattgctttaacactgatattgggtgggggtgtatgataaggacaggacaaagtttgttggggaatgccttacaaatccttcatttgggcagagatttcagggtaaatggtaacgaaagtctggaaagagaatcaaaatttgtaaattggtttaatgacacgcctgaggctccattttcgttacataactttgtttctgcaggtacagaactctctgataaaagaccaggtgaatggtttggtcccgcagctacggcaaggagtatacaatctttaatatatggcttccccgaatgtggcatcgatgattgtatagtatctgtttcatccggcgatatctatgaaaatgaagttgaaaaagtatttgctgagaatccaaatagtagaatattgttcttgttgggcgtgaagctcgggattaatgcggtaaatgagagctatagagaaagtatatgtggtatcttaagttcaacacagtcagtaggcattgccggcggtaggccgtcttcatcgttgtatttttttggttatcaaggaaatgaatttttacatttcgatcctcatattcctcaaccggcagtagaagattcatttgtagagtcgtgccataccagtaaatttggtaaattgcaactatcggaaatggatccctcgatgctcattggtattttgattaagggcgaaaaagactggcaacaatggaagctagaagttgcagaatctgctattatcaatgttcttgctaagagaatggatgactttgatgtgagttgtagtatggatgacgtggaaagtgtaagttctaactcaatgaagaaagatgcaagcaataatgaaaatctcggagtactagagggagactacgtagatattggtgcaatattcccacacacaacaaatacagaagatgtagacgaatatgattgttttcaagatattcattgcaagaaacagaagattgttgttatgggaaacacacacactgttaatgcgaatttaacagattatgaagtagaaggcgtccttgtagagaaggaaacggtaggtattcacagtcctattgatgaaaaatgctagtgtaaggaattcactagttcataagcatatatacttgttttaatatattccctaaaactgaggtatccagttcttttgttcttattcgtttgatcatcctttacgtatttttcgtctgcggcagtggaaagaacttaaaaaacgaaagataataaagaaaaaggccagtcggcacgaattaaagaccacctgtaagaagattaagacaacggtggtataaactagtgtcgaagtccaaaatgcctagtcatcgcaattcaaacttgaagttttgcacagtttgtgcatcaaacaacaatcgttcaatggaatcgcataaagtcctgcaagaagcaggctataatgttagctcttacggaacaggttcagctgtgagactgcctggtctatcgatagataagcctaatgtgtactcatttggtacaccctataatgatatatataatgatcttttatcacaatcagcagaccgttacaagtcgaacggtttattgcaaatgctggatcgtaatagaagactcaaaaaagcacctgaaaaatggcaagaaagtacaaaagtcttcgacttcgttttcacttgtgaagagagatgttttgatgccgtttgtgaagatttgatgaatagaggtgggaaattaaacaaaatagtgcatgtaattaatgttgacattaaagatgatgatgaaaatgctaaaattggtagcaaagctatattggaattagctgatatgctcaatgataaaatagaacaatgtgaaaaagatgacattccctttgaagattgtataatggacattttaactgagtggcaaagctcacattctcaactaccgtcattatacgctccttcatattactaaacaaaacggtcaattactgtagaaaagcataagcattaagcggccctcatgaatcctacattatccgtgaaatttcaatactttcacaagtcttcgatagcttcctagttatattcattatataatattacgtttcttgttgcggctctcttaagcacattatttgcttgttgtccacatagctatttttttatcaagaagcttgatatacaacacactgtatttttagtaagctggacaatgtcttgtctcaatgtagcgtataacaggtttcattccaaaacacatcaccagatataggactgaaatgaagaaaatagaagcatgaaactttaaaagtttcagtactttaagaaagaaataaatagaaaaatgttccatttatttctgaaaataaatcaaaaattataagatccacccgttcctaccaagaccttccaaaatttttcccataacgggaacgagcaaagttgagactgctcaaaagagcacatcttcaaactacaatcccgaccaaataatctcaacagccataccttcatcataaacttaagttcattcgaatctgccgtcaaaaactaaaatggcacgctagagaaaagtagtcaaaaagaatgcctctacaaagctctcttttgaaaggccccagctcccctaacaccaatttgaatttggtgtcaaacttctccaggcagaagaaacaaagggccccaaaaatcagtttaacccaaaaatccccaaaggaatcaagggattaaccaatgattgaaacaagggaatggaaacgtcagcaaacacgccttccgcgccgtatgtgtgtgtgaccaaggagtttgcatcaatgacttcaatgaacaattatagttcaatgataaatgcttaacgtccttctactattggaagcgcatgtttgatcagtaggacttcttgatctcctctgatatcttaaggtaagtatgaggattttaaaaaaattcaagaaaaaactatattttaacgctaaaagtatgtttgtaaaatagttctattaaatggaacttcttctctctatttatacgtcttgccaatggaaaactcgtcgccttagaaaaaaaaaaggtgcaaagacgggtaataatttcattgacattttcaagagctagggaatgaatcaatgagccctatgatggcagcgtagatcaccgtatttaaattaacatataataagatttgttgccactttcaatctctaaatgtgtacgtatagagttccaggaagcaaaaagaccattattgcgcgatatgattgctatttgccctctgtatacatagctttataggatatcggtcgtacatataattcagttcagttcattatacggatattttcgaccactcccccaacctataagtgttggtacctacatttctgatcagtacatacctagttggttgccggatggccgcatgatgatctataaatccgattcccataccatttccacaatttaagtggtaggtgccgctggtaataaaaccaatcaaatcatgtacctctggaagtggaattttcaaatcatgatcttttcttccgtttgggcggtaaaccccttttgccaattgtagccaatgctctaagtccttttctggaacttgatatattcttgcattgtcctttgggtgacctcgttcgagtagtgtgcaagatacagcaatgatacaacgtgggaagaatgtaagggagaatgaagaactattgacgctaatgctatcaggagtgcgaaattgacatttccgatttttacacaatgcaactggtatgttctcttcaatcgacaacgacatagccttggtcttggcttcataatctttgcaaaactccaaaacatcatttacacagttgatgtctcttacaccctgagcgttaaattgcccggtcttcttactgtccatcagttctaaggttttatcattccgctgtaaataatcaattccatttctcagtatttgtaaaaatctccagtctgaactgaaaaaatcgccgatttctccgctatatgccggtaatttagtgttatggatgtctttgatcttctcgaaattaatcctttttcccattggcttcctatcccacttcgtcttggaggcctcctttttataaaatgagttttctatataacccaattgagtgaatggataatcatccggaaaatataattgcttattctcgtactgaatttgctggaattgcctgaggccaatgtgatacatccttggtatccggttcagtagatgccataacggtagcagccagaaccatggtaacacaacaatccaatccctggtcttgagccttcttattatgactaatggaatagaaggatcgtcactttctttgaacgggactgtagttttattgatgctgttcggtgtggcagttagcaatttgtaacgtctcgcagaaatttcttttaatgtgttttggttgttgtatgattgagtacgtgattcagggtcacataattcgttaaaaacggcgtttatttcgtcttgaggatagttttcatgcagtgataaaatgtcgtcagaattaacagtcttcctctgtgaatcatttaatttctttggagcagctagatgacgcggatctatggcttcaaatgcaaacgtacacctctgtggtagggcattatgatcggtaatcattgaaaccattttaaattgttcaaacgatttagagtactctgtgctccttaaacacgatgctaatgactctagagctttagctcccttcaatgtcacgcttgctaatgaatatcgacaatcttgtactgttagtttttccttatgttgcaaaagaatgttaaaaacctgagtataaattgaagggtgtaaccttataattgcagtatccttttgtacccaaaatacgtcgcatggacccagtggcttagtagaatcctcaccgttttcttcattgaaactataaattaacccttggaataaaacctggccttcgcgatatttccttaagtttgctctttcagctgttaactttcctataatggattttaaaaagtccccctcactgtcattgcttttgtcttttacaattattgtaccaatataacttgaatccatgcataaggccccatcggagctgcaggtatcaccgcccaacctatgcgtcaatttaaagcatttttgagtaggtgcccataccatttgatatccccatcttttcatcatgtgcgaccttttagcattccaaatgtgggtgggtagccaagcaaagtgcttctgtctcttcgtatatttgaccctgcccttgggaataggtgctaattcattgacaccagtgcaatcatagctccccatacgattattaagtaactttatatttggatttgctgttgatgattctttaatcattcgctttaatgtcttgattttctgccttacgtggcagttagatgatgtaacctctggtggcatgctgagtttcatagaagtagatttgctagccaatcgtagcagctttatggacattctagctttataaagttgctttgcatttaggccatgagcttttctggaagaggctgaagaccccttcaacacatcctgctgatcacttttacgcatttccctcaaagctctattgcgcattctttttggaattctacgaacattatgcgaagccgttctacgacgcaattttcgaggcaatgcctgaaatattctcgttgagctggctgctttggaattatgcatggccaattgcaactgcttaacctcgaattgtcgagaactaatgaattggtccacgtttagcttacttcccgattcactcagatcactcggtgtcccagtttttgttgatgaagcggccacggcctctgctctaattgatctagcatttcttatgcgatttcgcttcagtaattgattcttattaagaactttctttccaccatttcctctagacaaactcccgctcatttgtaattataatgaggtcaattctcacctttcttgccaaatgttcaagtggcaggctgctcaataagtatccccgttcttcaaagacatgccaccgttccgagaatctcatcgaattcagatctgctttcttctaatgcgaatttcactgaaaagttttcccacagtgttaccctcttacccgggtgcaatgtcacgtgcacatcacatatgaaaaaatgaccagcaaagaagtcaatctaccttccttatggccggtagagtcaatagtaatttactttgcaaccaattaataaatctgtaaacttaaaggaatcagcaattaccgcaaccccagagaatcggatggtgagattagtcccattcaattcgctctcgtgaccaaatcgtcgggaaaacatgtcccacttacctgttcctgtgaatccagatacggaaaaaaattgtatttaaataatctcgattttacatttactgatcgcgatccttttcattgagtcacagattaacaaagtaaataataataagtaaacattatttctaaaaaagtaatttctttttcttactagtcttttcttttttgactttctctttatttcttaacttgccttataaaagaaacgattgtagaagcttacctcgaccgagtaaatattaagcttttcgttggataaggtaggggaaatcgtaacattactaaatttaaagcatatcagaatggttaacgttgtattgggctcccaatggggtgatgagggtaaaggtaaactagttgatttactggttggtaaatatgatattgtagcccgttgcgccggtggtaacaatgccgggcataccattgttgtagacggtgttaagtatgatttccatatgttaccatctggtttagtcaacccaaactgccaaaaccttttgggtaatggtgttgttattcatgttccatcttttttcaaagagttggaaaccttggaagctaaaggtttgaagaacgcaaggagtagattatttgtttcttccagagcacatttagtctttgactttcatcaggtgactgacaagctaagagaattggagttatcaggtcgttctaaagatggtaaaaatatcggtactaccggtaaaggtattggtccaacttattccacaaaggcttctagatctggtttgagagttcatcatttggtgaatgatcaacccggtgcctgggaggaatttgttgctagatataagagattattggaaacgagaagacaaagatacggtgatttcgaatacgactttgaagccaagcttgctgaatacaagaagttaagagagcaactaaagccattcgtcgtcgattctgtcgttttcatgcacaatgctattgaagcaaagaaaaagatattggttgagggtgctaatgctttgatgttggatattgattttggtacttatccatatgtgacttcttccaatactggtattggtggtgtcctcaccggtttaggtattcctccacgtactattgatgaaatttatggtgttgttaaagcctacacaactagagttggtgaaggtcctttcccaacggaacaattgaacgaaaatggagaaaaactgcagaccattggtgctgaatttggtgtcactactggtcgtaagcgtcgttgcggttggttagacttggtagtcttgaaatactcaactttgatcaatggatacacgagtttgaacattaccaagttagacgtcctcgatactttcaaagaaatcccagtgggtatttcatattctattcaaggtaagaagctagatttgttccctgaagacttgaatattcttggtaaagttgaagttgaatacaaagttttgccaggttgggatcaagatattaccaaaattacaaagtatgaagatttgccggaaaacgcaaagaagtacttaaaatatattgaagattttgttggcgttcctgttgaatgggttggtaccggccccgcaagagaaagcatgttgcataaagaaattaaatagggcgttggacatccatgacaaacttcaatttaatttcttttcacagttttatagttttatatatacgaaatgtaactaatcatgacattttttaaaagttttcaatgaaaaaatgaaagagtaatgaacaaacatattttttttataaaatgcataaaaacatatagatatatatatatttacgtggaaaaatgttaaaactattgataagaaaaaacgctcaaaacaagtagtaagcaggctttttttttttttgctgcttgttttagagaacctgtatatcaattagtagtctcagttggtttttcaaacaaacagtaatcaatgtaacgaacaccgtacacttgattccattgttttggtaaaactatttgcatgattcggttgattggctccggtacgtaaaatgctctacccaaaatcttagaattttcaccgtcgatgaatgcagcacatgccagcttattccagttatccatcagatgtagagggttgaaaacgtcttttgttaaatttattggggcgacgatgtcaataaaataatcacatctagtgatcggccactctttaccggtatcatatatattcttgttattcattcccttaggtaaagttctaatctttttgaaaatagaaccactctctggaaaatcacctggaagaagaccatcaaatccagatttaacaaattttagcctatgattatctggcagcaggaaagaacttgggaagtgataccattcacgtcccgtacatacattcactaccggtgccttcacaccaccttgatttagtgaagaaaattgctcgtagacggctataggagctgtgtaattgttcaccaaagccactatccgtgacattgcctggcctgcaacaattaataaaactgacaactttataccttttttaagaatcggctttctattgaatagattcaacactttgtaaaaggcgatacttgcactcaaagttattaacccgtaaattggatagagaaatctttcctctttgtgaggttgttgagtgaaaacggcaatccatgtgaataatgatgcccataatggccataatctcaaatggaaaattcccaaaatagctaaaactagcacaggcagtgggaaattcagtaacaaatttagtggatagtagtaccatggctcaaccccgaaaatatttgggccagattcctcacttgcattaatgacattgtaaaataagatgttccatgatacaggagcaagcttcccgtaaaatatactgtcagtgacaatcacagcaaatgcagtcaatgaaaatatcaaacagcagtcgaatgcggttctgatggtagaaataattctatggttgaaaaggtaatgtaaacataatggcaagcttaaaattaaaacaaatggccagcctagtatactagccaggaaattgtacgctaaacttttcgtaaagttagaagtagacccagtggacagatagcgtagagagtgtctggtggcacctacatacaacaacatggcaacggcagaaggcaataattccacagatgcatggaaccagcccggattaaacaattggaaaataatccaaatatttgcgatttgcaatgccaagctgcctgcaatttcacgatgtagtttaaattccatgataaaactaaaaaagcctaagcatgctcttgtgatgaaaaagttccaatgactttctaggtcagtaaatttgtttactggataaagaatacagtaaaaaggtaataagaaagcccatgatctaatagaatactcgggtgaatattcccaggtttgtttaccaaatccacgtaccaataaatttaatggttcccaataattaaaagtttcatcgcaatctgaaattaacgagaatgtcggctgaatatatactcttgttaaaaataacaacagtaataaactaatggttaccgccttgcaattcatcgttcccttataattgtgcttcagggtgaaaaaagagccaattcgatacagctaaagttttgaaatctcgttgagtagccgtaatggtacaataaaaacgaaaaagtattctctattgtgtcaaaaacacccctgtatatccagttgtccctttttcaagcttgtattgacagttctgaatatcgcagaacggttctcatcaaaattcaatattgcgtaacggacttattgttgcattttcaagtaaataagccgggtcaggatgcccgccgtagatagtaaaaagtaggtataacatgcgcaagagcaaaacggatttgacaacatatccaagtgataagtggtcgtttagatacatcatatactataacggtttgatattgagagcccagttaaaattaacatctgttttttgttttttaattgacattcaatcatcggttgctttccttgtgaaactgtacgcgttgtcttaaacgaaacgtgttttaaggtaggtcatcgacaggtaaaaaatagcttattagcagaagaacgctagcggtaagatctgaaacaggatcgcacagtctcaatgagtaacaagaggacatctgtagaacagctcatatcatgcccaatttgctctagaaaagtctttttttccttaatcaactctcatcttgacatatgtggcaaggaaaagtcaaagccttcgagtaggccacaaacggtgtcaagtcttttggcaggcccaaaaaagaggaaacaagctaactcagagaaattcattgatcttgaaaataaggaccatgaaattaagccaggtcttaagagcgagagtgatgatattgagattgttgaaaatgaaagcaaaagatttaaggcagcaccatccacggattttgcgaaatcaatagtggagcctgcttcgagcagagatcaacttcacaacgattacgaaagcagatggttgcagaaaataagccatttgccacttagtgaaaaattgaggccaaaagaattaagagattatgtaggtcagcagcacattctctctcaagataatggtacattgttcaaatacataaaacaagggactataccatctatgatactctggggccctccaggtgtaggaaagacttcactagctagactattaacgaaaactgcgacaaccagtagtaatgaatcaaatgttggttccaggtacttcatgatcgaaacaagtgcgacaaaggcaaatacgcaagaattgagaggtatatttgaaaaatcaaaaaaggaatatcaattgaccaaaagaagaactgtactttttattgatgaaattcacagattcaataaagttcaacaggatttgttattgccacacgtagaaaacggtgacattattttgattggtgcaacgacagaaaatccaagttttcagctgaacaatgctctcattagcagatgtctgatttttgtcctagaaaagctgaatgtcaacgaactgtgtattgttttatcaagaggaattgcattattgaataaatgcaggaaacaagtatggaatattgaaaatcctttgaaattgtctagaagcatactggagtacgtggtagatctgtcggtgggtgatacaaggagggcgttaaatatgttggaaatgatcgaagtttcaacaagagagcgcaaggccgacgaggaagaattatctatcgatgatgtacgagacataattaagaacaacagcagcaacgggttgaatacatactatgacccaaagggagataaccattatgatacaatctctgcgtttcataaatccattagaggtggggacgaaaacgcctcactgtactatttagcaagaatgttgcagggaggagaggacccattgtatgttgcccgaagaatgattcgaatagcttctgaagatatcggattacgggatagttcattattgcccttggctgtcgcggcacatgacgcagtaatgaaagttggtttgccagaggcagaccttgcactggcgcaatgttgtgttgctttggctagggcaccaaagtcagtagaactatatagagcttggaagaaattaagggcaatgatgagcgagaacatgtacagtttagcaagcagtgagataccgatgcatatcagaaatgcgccaaccaaattgatggaggagctgggttatcataaaggctacaagtacaatcccgattatattgaaggaaaagtccaacaagactactttcccaaagaagtgctcgagaaatgtccaaataaaactgacttaaagttcctggacggcaaacatttaggagacaaagaagatcctgacttgagacagtcatatcagggttagtcaagggtcttccatacttctctcaatgccgcgtctacaattcatatttttttctctgttggccaatgccgcttgtttttttacgcttgaggcgcattgcattgctggcacgtttttgtgcagcatgaacgatataaactataattttagataatcaaggatccacctttttttttcatgctagaaaagtctcgcgggcccatctgagatatattagaacatatacgcatcctataagaagagcacattattcttgaattagttcttccttttcctcgaccttccagcttgtaaaatgagccaggcttgaggagcatagatacgcaaaaatggaagataagcggaaaagacgagccgctacacttagtacagcattgatattatttgtggcatgctgcgtttatacactatatatattcaagtttgataaccctcggttgtctccaccagtttccttattgcctacaattagcaccttgaagaaaattgagcatgtaacagatttaaataaggagtacgtttttgttggtgacgttcatggtaactatgatgagttcatagaactcattgatgacaagattggaggactaggagaaaatataacaatgatattgctgggtgactttattcacaagggcccggactcagacaaggtcgtgtcgtatattctaaatcacaaggatcaagtcaagtgcgttttgggcaatcatgaaatattggtcatgatggcctatttaaacccagacttctcgaaatgggtaagacgccccaaattaatgacacctttaactttcagtacggagactaatttcataccacaagacatctctaaaatcagcaacgcacatggacggttagctcgcgaacttgggttttccaaattaagtcagctagcggaacattgttctatggccatagaactagatctggatattaccggtgatatactctttggtgcacatgcagggatggttccgggagacttcatgaagcccaaccaaattccgggcgtgagctctctgtcaaacatgaagtacgttgataagaagaactggtcaaaaacatcacgtgaaaaggaaaacaagaattatgtgagatggtacacactgtgggacaaatacggagaccactttagtaacgccaaagtattttacgggcacgatgcatccatgggactaaacctacggagacagaccaaaggtttggacacagcatgtataaagaacaatctgctttcatctatgaaagtgaagtacgatattaagaaggggcaatatgactatgaattaattcaagtacaatgctcttaaaacaaaaagtactacttaaaagcgcaacagattttatataatgtactatatgaaaaagatatgaatattattatgtaactcataatactgaatcttaaatttcaatgaaactttcgctggagctacaagtattcttgcccaatggccgctacccgcctcttcttcgttgttgaagttttaaaatttagcgagaaaagaaaacaaaaccgaaaacagacaaccgcaatcatttcttcaacacccaacatccagcacctaaacaccatcaatacacgttttaaacaaaacaaacccatagcccaaaaggtagtaaacacaaaccgttgtatacgcaaccgccctacataagacactatttgcgtacagattatctcaatatgtctagtccagatgattttgaaactgcaccagcagaatatgttgatgcattggatccgagtatggtcgttgttgacagtggttctgctgcagtcacagcgccatcggattcagccgctgaggtaaaagctaatcaaaacgaagaaaacactggtgctactgctgctgaaactagtgagaaagtggatcagacggaggtcgaaaagaaagatgatgatgataccactgaagtcggtgtaacaactaccacgccttccattgctgatactgctgctaccgctaacattgcttcgacatcaggtgcatctgttactgaacctactactgatgacaccgctgctgatgagaaaaaggaacaagtaagtggtcctcctctgtcaaatatgaaattctatcttaatcgcgacgcggatgcgcatgactctttaaatgatattgatcaattagcgcgtctgattagagcaaacggtggtgaagtgctagactccaagccaagagaatcaaaagagaatgttttcatcgtgtcaccctataatcataccaatttaccaacggtaactccgacttatattaaggcatgttgtcaaagcaactcgctactgaacatggaaaattatttagtaccatacgataactttagagaagttgtcgatagtaggttgcaggaggaatcgcattctaatggtgtagataatagcaatagcaatagcgataacaaggattctatcaggcccaaaacagaaataatctctacgaatactaatggcgctacggaagactcaaccagcgaaaaagttatggtagacgctgaacaacaagctagattacaagagcaagctcagctccttcgtcaacatgtaagcagcaccgcatcaatcacaagcggagggcacaatgacttggtccagatcgaacaacctcaaaaagatacctccaataataataatagcaacgtcaacgacgaagacaatgatcttttgacacaggacaacaaccctcaaacagcagatgaggggaatgcatcttttcaagcacaaaggtccatgatttcgagaggcgctttgccctcccacaataaagcttcttttacagatgaggaagatgagtttattttggatgttgtgagaaaaaatccaaccaggcgtacaacacatactctttacgatgaaatatcccattatgtgcctaaccacacgggtaattctattaggcaccgatttagagtctatctttccaaaagactagagtacgtttatgaggttgacaagtttggtaaattggttagagacgacgatggaaatctgataaagactaaagttttgccaccatcaattaaaaggaaattttcagcagatgaagattacactttggcaatcgcggtcaagaagcagttttatcgtgatttgtttcaaatcgaccctgatactggaagatcacttatcacagatgaggatacacccactgctatagcgaggaggaatatgacaatggatccaaatcatgtgccagggagtgaacccaactttgcagcttacagaacccaaagccgtaggggaccgattgcacgagaatttttcaagcattttgccgaagagcatgcagcacatactgagaatgcttggagagataggtttaggaagtttcttctcgcttacggcattgatgattatattagttattatgaagctgaaaaagctcagaatagagagccggaaccgatgaagaacctcaccaatagacccaagaggcctggcgttcccactcctggcaattataactctgccgccaagagggcaagaaattatagttctcaaagaaatgttcagcctactgccaatgcagcgtccgctaatgctgctgccgctgctgctgccgctgcttccaactcttacgctataccagaaaacgaattactggacgaagataccatgaatttcatttccagtttaaagaatgatctatccaatatttcaaatagtttgccctttgagtatccacacgagattgcggaagctataagaagcgatttttcgaatgaagatatatatgataatattgatcctgataccataagctttccaccaaaaattgcaacaacagatcttttcctgccattgttctttcattttggcagtacgagacaatttatggataaacttcatgaagttatttcaggagattatgagccatcacaggctgaaaaactggtacaggatctttgcgatgaaactggtatacgtaaaaatttcagtacgagcatattgacgtgtttatccggggatctgatggtctttcctcgctatttcttgaacatgtttaaggacaatgttaatcctcctcccaacgttcctggtatttggacacatgatgacgacgaatcgctaaaaagcaatgatcaagaacaaataaggaaactggttaaaaagcatggaactggtagaatggaaatgaggaaaagattttttgagaaggacctgttatgagtaattgaattaagtaacatcattgtttaacttattttactcctttatttcactgattcacgttttctactttgtttttcagttcaatgtataatttatgtaaacttttacgtattttaattttcaaaattcttacaatgattaaggcggaacagttttatagaatcccattagcaaaaaagagagaagaaaaggaggaaagtataacgcagaacgaagattctcatttttaacgtgtcttttcttcaaggataaaacgcctaactagcaaataactggcgattagcagactacaatggacagtgaagcaagtgacattgaggcagagttatccgacagcgtctcagctggtggggaagaatacattgacgatgatgattatacggaagatattgacgatcagatagtcacagccaaatcatctagaagaacagcacgtaggagtgtacctaagggtgtaagaacctcaaaacgcattagagataaagaactttctgtggaggttgatgaagattatgatgaggaggaagatgtattgagcccttctaagaagcgccatctacacaccagatcaatggacaaaaggcaagttgccgcaacagcttctgaaaaatctgatattggtgatagtaaaggtaatgatggcgaaatagaagacggtatattggaagaagaagagagcttagagaaggaactgaatagaggtggaggaaaggaggtagagaaaagtgaagaatcttactacgcccaaaacgatgttggacagaagggggaggaagaacaagacggggaatctggaggctatgaagataatgaacccagtataagtaaagagtcagacgaattggtctctgtggtaaacggtaacggtaacgaagaggatgatgaagtggaggcaacaaaagaaaatacaacagattctactagaagtactacgactcgaagcaagatgctgttagatttgctggaagatggtgggtctaaaaagaaattaacagatgaagaaatccagctgcgaagagccgaaaatgcacgtaaaaggaagaaccttagcgagaagagactggaagaggagaagcaggacacaatcaataagcttttgaagaaaagggccggtaagtctaggagccacttgccaaatgatgatgaaaagaatgatggctcttcaagtttcgtgaaaccacgcaggccttacaatagcgagggtatgacaagaattctgcggagatatgaagaagacttattttgtacattttaagtagaggacgcaatttaagtatttgatgtatatcgtttgttttatttctgttggtatcggttgggctcggtattattgttacacccgcgttgtcaagtaaatttataagggtccaagataaaatgaaagcattgaaatatttccatcattctgataagcagaaccacgtaaggcagactaaaaatcatgacatcgattaacagttttcccaggaatattgactggccttccaacataggcattaaaaaaatagagggaactaatccaacggtgaatgccatcaagggcttgttatataatggtggatcaatttatgcatttctatattttgttattgctatgtttgttgaaccaacgctacaaaagcagtaccagcagagaaatgatttttccttgtttgttttgttgcgtttgagaagaatcatagcgcaattgcaaaaacgactggtgatgaccccagtatcgtcgttggggttcaacgaacagaataactttgtggagaggtccactcaaacttcagacgacaatataatacgagaagataatagccattgggctgaaatgatttatcaactgcaaaatatgaaacaagaattacagtattttaacagatcctcaggccaaccatctgaaagtatagacgattttgtctttcaaattaagatggtgactgaccaggttgagttaacagataggtcccgagctttctcaaataaatcaagaaatattatacagggaatccgagaaatcaaaggttggtttgtgaatggccaagtgccaaggtaacaatcaaaaataatagcattgaatttaaaacgctctagtgcacgtaacgcatccgtctgatcagtggcgaacaataccgttatttttcatagtacctaagaagacacataccaatttttgcaagtgaaagtgcagaaacggttccactaacgatattactgcatgctctctattctaatgtacatatatatgttcctttatctacaagaagtttcgtaataatatataaatccctcaaaagtgttattgtttcgagcccaaatgcttcaaaatgtatagtttgttggtgtttttcttttcaggtgtactgttgttaggcttgaaaggtttaaaagtgcgaacattccttgctattaattcaggtgaatttgagttggacccaagtataatctttctgctagtaacaatttgattggatacaaaatcggcatcctcttttctttgatacatttcttttatccgttctcctcttcttttccatctctcgtaggtgttattgttttcctcatcagtacgcttccagttggacttcaaaattcttcgaacagcctcgggagaaattttgaaccggtctgcaagatcagatgctgtcagttcaggaaagttgaatttcaatagtcttagagcctccatttgttcctgtgatatcttttttggtgggttccacctctggccttgcaatttttttctaactgccattttctgcttcttccactcaggaatgtctttcgtaccatctcgtactttttctgtaaactctttattggacaaactcgatttattgactaatttaataatctttttggatgaccatcccctgttctcattgagtaatggaccgcagcgcaggcaatgaaaagaacgacatgctattcgcagaatgttcatgccaagtgctaaccaaatgattcagaaggaagtcgaagggaatacgtagtgccttgttaaatagcttaccgtgatatgaacagtatacgatcgactctccttggagactttctacaccattggtgattggtgttttagttctaccatcatttcatatttactagctttatgatcattttagacgactgtgggaatgttgttatttttactaatcacttttacttagtaatgtcccttaaggacagcactgaaagcaaagtagtcaagcacttcattcgaacttgattagtagaaacaaacttcattctttctttacgtatccagtccaataatatctgcagtagttatagtgactgatgaacattttgaagaagtttatggagtctggtaacaagccagagctcatcacgataccttctgggcagtttaatcttttgaggtctaagaattcccctaaagctgctttagaatgtatttacaacaatgcaactttaagcgtacgtaaaataggcaaatttgattatgagttggcggtttatagggtagaggacgatagtgaaggaggcacgggagatgaggctgagaattttgaagacgacaccatcagtgttttatccacacagtctaaaaagaaagaagaggagtggagcgttgaaatatcggataaaatcatgtttcacaaaacatgggataaacaaggaaacgtggcgcttgtgtgggagaacttaagaggtgatgaacaagatgaaaaggttcaatttgttgttgccgctgatgtgtcgttttctgatgttgaacagtttatccaaactgtttaccgatgccaattcgaagtaaggaataaaaaatcctctctcactgcctcagcagatgacttaaaggaaatagagcatagatcaaccaggctctttgttcaagatgatgatgacgagttagattcaagctcagatgactttcaagatgctaaagacacctcttttgagcacgagaaggaaagtgaaatattggaaagaactccttctccattgaaaaaagttccagaaggggaatattgttgtttagtgatgtctagcctatacatgtatgatccaattcaagaaaaatttattctgcaggagcccgtggtaaaggtagcaattattgatacaggcaagtacgaattttggctagcgatagaaggtaaagataatcgtcttgggactcaggtcgccccaaatatcaatcctacctttgaattagctaccgatgcctttcttttcaactatacgctacaaaacattacattgtcttatatgttaaaatttaaggacttagataagtgtattcaattcaggtttgcttgggttaaatgtttatggatgactttgaacaaagaaacgtggaccgacgttcctgaaaaggagaaagattatattttagattcatcatccgtgccattggaaaagcaatttgatgacattttacacatagatgacagatcaaatgaggaaagagataaagaatcaagcgaaagtgaaaatgatagcgaagatgaggatgacgaaaacgatcactccaaaagaatcatttcatctgaagcctttgaagaacctaggcgtgcgacttccaaaggtaatagttcattgactgtcgcctttaggaacaacaggtcatatgttacaagagataacagaattggtgtgttcaaaacggatgatgaagacgattctctagaatttgtagctgccataaagaatatttctaatttaggtggtaaaagcattgatcctcataagccaatgttgtatatggaagatcgtaatttaattttgactgatggcgaaaatgagaacaaactttataagatggatatagaaagaggaaaggtgattgaagaatggtctactggtgacaagaatgttgttcaatatggtccaaccaaaaaattcgatcaaatgacgcctgaacaaacaattgttggcgtttcacagaaaggtgtctttaaaattgatcctagaattaacggaaaaaataaaatagccgtcgatgaatcaaaagattacgtgggtaaatataactttagctctattggaacaacagagagtggttatattgctattgggtcagaaaaaggtgacataaaactatatgataggctcggtattagggcaaaaactgctataccttcactaggccaagcaatcaagtttattactacctctgctgacggtaaatggttattggcgacttgcgagagtactctgcttcttatggatttgaaaattaaggatggaaaaaatgctggcaacattggatttctgaagtcgttcccagccagtgaaaatgttaaaacatatgtattaaaaatacgaccagaacattcggcatcaatcttaacgtacacaaaaaaaccaatccgatttacgaaggcttattttaataccggtataggccagcaagaacaaactattgttacatcgacgggtccttatgcgatttcttggtcattaaagggcattttaaatcaagatggtagtaataattatccttacagaatccgtaggtacaatgctgatgttgttgctgataattttgaatttggttcagacaaaaaggttatcgttgccttgaaagacgatgtctctctatcgaaagtgaaatcctttaaacagccaagcaaaggagtcttgatgccaagtgcttccctccaagatttttatggctaattcttattttcaaggttttaaagttgtattccgagtgtattatatagttgtttcccttccggaagttgtgtaatatatagttttgaatatatataatggtgttaaatagaaatgccaaatagtacgtagtaatattatttaaattgcatgcgtttttttcgttttaaaaagagattttagtgtgaaatgcagtcaaaaggtacttttgtctgttttatagtacttgtacatcagacaaggatgaattaatcttttttaaagcggtctcctagtctccttctgaacccaaaagtagatctcatttcatcccaaaataaaagccttaaagccttaaatttctgtcgtggagttggcttataaagatattgaaaagcagttgattggtcagtgaaaggatcttctttaataccatttactttcctatataccttgcgtacaaatctatggaaacctggactactcagtaacttgtagtaaaaccattcttctatacttcttggaggcatgcttaaactgatgtgataaacatattcttgttggtaacagagtgttcgttcaatctttttaagatattttgtttcctaatttcttcacatttttgaattactgtttttcttaatttcataacgggttcttttcaaaaaaccgtaaaaatttgaggtcacaccaactaaatacaaattgtttcatcacggtgactatatcaagaacttcgtaaggaaacatttagaaaactcaatatagtaaagtttcatcagcaatcttatctgagtaatattatctacgatctaaatataggatgatctgccgatttaggaatcgtactgtagattgctcttggcgacagatatagtgaaataccttttacaaagtggatacaggttgcctatcactaccgccatttcactagcaagtagagtattgagaaaacggtaaactttgaaagttgcagatgcagaatatatatctggttttgtagttctatccgctaaacgggacgatcgcattttagccgccgacagtgttaatataagtaatgaacttgggttaatttgattacgcgtcacagctactaataaaataagaccgagagttttaatcagctagtgcataccaaaacaatgagtaaccaacacagccctcagccattttgtttggacaccaaattggtgaaactattagaagagctccaggagggaaagcaattcaacaataaaaacatattcccggaaaaagcattatatttgaagctcgctcttgattattctttcttcagaaagaatttactagagttttgcgtccaccttgacaagataaaaggagtcattagaccaaactatgacactatatatattttgtgcctgttggaggtggatctcctcaatctggtatttaccgacaatatattggaaatatgtttgcccaggtttgtttcaagggaggacttgagggtttttaataatactttttacacatatcacgataaccgcctacgtattctccaagaagacttttctcaattgttcaaaaaaatcaaaactaaggcttctgtactatgttttacagttgaggaaatttttctgacaaaccaagaaattttacctcaaaactcaacagtggcagaactgcaaaagagcactaataaagtacagacaaatgggccgcaacggcacgatttcatagtcactctagaaataaaactgaacaaaacacaaatcactttcctcattggagctaaaggaacgagaattgaaagcttgagggaaaaatcaggcgccagcataaaaataatacctattagtgataaaatgactgcacatgaaaggaaccaccctgaatctgttcaacaaacaatactaatttcgggtgacttatactcaattgcattagccgtcaccagtatagagtctgcattaattactttggatttatagattatgcggaaatggtgttggaagataccagattgtaagcttatttgatcgtttcaatgatggcttatacaagatcacacttaattcgtatcattcgaaacggaaaaagaaatgtggattttctttttcaatttttttttttttcatgatttttttgggcgacgcagagatgagataaaaaaatttttcaactgctattctcaatcgaattttttttgttatcctcacctatttgttacataaatttcgttattttgcacttgttacccatcgttttttctttcaagaaaccaagaaccaatatcctcattaacaatggctgaaggtgttttccaaggtgctatcggtatcgatttaggtacaacatactcttgtgttgctacttatgaatcttccgttgaaattattgccaacgaacaaggtaacagagttactccatctttcgttgccttcaccccacaggaaagattgatcggtgatgctgccaagaaccaagctgctttgaacccaagaaacactgtttttgatgctaagcgtttgattggtagaagattcgacgacgagtctgtccaaaaggacatgaagacctggcctttcaaggttatcgacgtcgatggtaacccagtcattgaagtccaatacttggaagaaaccaagactttctccccacaagaaatttccgctatggtcttgaccaagatgaaggaaattgctgaagctaagattggtaagaaggttgaaaaggctgtcattactgtcccagcttactttaacgatgcccaaagacaagctaccaaggatgccggtgccatttctggtttgaacgttttgcgtatcatcaacgaacctactgccgctgctattgcttacggtctaggtgctggtaagtccgaaaaggaaagacatgttttgattttcgatttgggtggtggtactttcgatgtttccttgttgcacattgctggtggtgtttacactgttaaatctacttccggtaacactcacttgggtggtcaagatttcgacaccaacttgttggaacacttcaaggctgaattcaagaagaagactggtttggacatctccgacgatgccagagctttgagaagattgagaactgctgctgaaagagctaagagaaccttatcttctgtcactcaaactaccgttgaagttgactctttgtttgacggtgaagatttcgaatcctctttgactagagctagatttgaagacttgaacgccgcattgttcaagtctactttggaacctgttgaacaagttttgaaggatgctaagatctctaagtctcaaatcgacgaagttgtcttggttggtggttctaccagaattccaaaggtccaaaagttgttgtctgacttctttgacggtaagcaattggaaaaatctattaacccagatgaagctgttgcttacggtgctgctgttcaaggtgctatcttgactggccaatccacatctgacgaaaccaaggacttgttgttgttagatgttgctccattatctctaggtgttggtatgcaaggtgacattttcggtattgttgtcccaagaaacacaactgttccaaccatcaagagaagaaccttcacaactgtcagtgacaaccaaaccaccgttcaattcccagtctaccaaggtgaacgtgtcaactgtaaagaaaacactttgttgggtgaattcgacttgaagaacatcccaatgatgccagctggtgaaccagtcttggaagctatcttcgaagttgatgctaacggtatcttgaaggttactgccgtcgaaaagtctaccggtaagtcttctaacatcactatctccaacgctgtcggtagattgtcttctgaagaaattgaaaagatggttaaccaagccgaagagttcaaggctgctgatgaagcttttgctaagaagcacgaagctagacaaagactagaatcctacgtcgcttccatcgaacaaaccgtcactgacccagtcttgtcttctaaattgaagagaggttccaagtccaagatcgaagctgctttgtccgatgctttggctgctttgcaaatcgaagacccatccgctgatgagttgagaaaggcagaagttggtttgaagagagttgtcaccaaggccatgtcttctcgttaagatgtcattctggttaaggttatacacatatatatatttttcatttttaatgtcttagcttttgtatcttagatgaagttttagttctgtatatcacgatcaagatatcatacaatcataaattcaattattcttctgtttcccctcttgaggcatcaaacgagtgtttgactgatacacaccaacatactaaggcaacttttctggctgcccaaagctgtggcacgtatgaaactgcttttcggctgcataaaacaaccatgtggagtttttactgtattcgcatttcgccccgctagcattcttcgttcatgctaaaaatgaggcgtgggctaatattcagtattaataattccggcacccgcacagcccataccggaaaaggggctggctgttgggcttggcaaaaaactcaatctgagcagtcatttataaagaaagactttaatttgtcttgctaaacacttgtaagccttccaaatatagatcacttaagacaatctaacaagtgtccaaaatgtctgcaaacgaattctactcaagtggccaacaaggtcaatataaccagcaaaacaaccaagaaagaactggtgctccaaacaacggtcaatatggtgccgacaatggtaaccccaacggtgaacgtggtttattttccactattgtaggtggcagtgccggtgcgtacgctggatctaaggtgtcgaacaaccattctaagttgagtggtgtgctgggcgccataggtggtgcattccttgccaacaagatatctgatgagcgtaaagagcataagcaacaagagcaatacggcaactcaaacttcggaggtgctcctcaaggtggacacaacaaccatcaccgtcagacaataacaacaataacggtggatttggcggtccaggcggccctggcggtcaaggtttcggaagacaaggcccacaaggatttggaggtcctggtccacaagagtttggtggtccaggtggccaaggattcggtggtccaaatcctcaagaattcggcggccaggtggccaaggattcggtggtccaaaccctcaggaattcgggggccaaggtcgtcaaggattcaatggcggttcacgttggtgaatggctcaacagagtgagtgtcatttttagctaactacatacttgatttatctatatatacatatatactactcgttttattatgatgtcgtaacaaatgacttattcgagaaaagaaaacgtgaaaaaataagctaaaaatttggcgatgaggttctctgttgaagttggaacccgcaattcatgattttggtaaggtcaaggatcatcagtaattagcttaaagtaagaactactcaataatattaaaccatttatccttggctcgtctttctattgaccaatcaatactattttaaacatctcttctaccacatactttcaatcagactagaatgaaattggatacttctcatatgagatatttgacaactgatgattttcgtgtcctccaggccgttgaacaaggttctagaagtcacgaagtcgttccaactcccttgattcatcaaatctcggggatgagatcgcagtccggaacaaaccgagccattagtgatttggccaagcttagccttatttccaaaatgagaaatgtcaaatatgatggttacaggctaacttataacggtattgattatttggctttgaaaaccatgttaaacagagacactgtctattctgtcggtaacactattggtgttggtaaggaatctgacatctataaagtaagtgacaaaaatggaaaccctagagtaatgaaaattcacagattaggtagaacctcttttcattccgtcagaaataatagagattatctgaagaaatccaaccagggggcaaactggatgcatctttcacgtttggcagccaataaagaatatcagtttatgtccatgctttattctaagggtttcaaggtccctgagccattcgataactcgcgtcatatagtcgttatggagcttatcgagggttacccaatgaggagattaagaaaacataagaatatacccaagctttatagtgatctgatgtgtttcatcgttgatctagcaaatagcggacttatccattgtgattttaatgagtttaatattatgataaaggacaaactagaggatgaaaacgattgtgggttcgtagttattgattttccacaatgtatatctattcaacaccaagacgccgactattatttccaaagggatgttgactgtattcgtcgtttcttcaaaaagaaactgaagtacgaaccaaaacctgattcatcaatgctcgacactgaaggtttcggcgatggttataaatatgcgtatccagatttcaaaagggacgttaaaagaaccgacaatttggatgaattggtgcaggcttccggatttagcaaaaagcatccaggagataggggcctggaaactgccgttgaaagcatgagaaatgctgtttataattcagatgacgatatgtctaatgacgaggccgaagaagaaaatggggagggcgattattcagaggaggatgaatactatgactccgaacttgataatgaaagttctgaagatgacagtgaagatgcacaagaagaggagaacgaacgtattatagaggcgctttccagtggtgttgaaaatctaaaaatggataaactaggaaactatatactagagtagtttagtttagacgactgcataaatggccgcaaataatcaagttgttatccataatttttttgatttttaagccatgttattcttcaggataaaaaaagtggtatttatgaactcttacatatgcgtattcatgctatattataatatcgaatctaagtcaatcgtattctactccggatccatcctcatcatcttcatcgtcatcattatcaatttctatcggaatatcttcgagttctaacggctccttaaactctttgtattggagttcctgttctggttgaccatttatagaagcaaaactattatctctattcaaagcgctttggccctttttgtcttcctcttcatcgtcttcttcatcatcttcttctgcttcctctccgtcttctgcaccgtctgaggattcttggccactcccatcggaaaggtcgctctcagcttcgaaattttggtcattttcttcatcatcgtctgaaaacacacctgcctttttctcgtcttgcatttgacgggtagcttcctgtagaatagatggctgatcggctgtgccatcagttgcttggcctttgctcttggatttagctttcaattcctcagacatagacttatccttcatttgtttccttttaacgtagtcgtcaattttagcgtattcagtttggtctatcatggaaaactcgtatttttcaccatcttttgtcactaagcttgcattgaatgttaatctggtaatagacgaataggttatagactcgatgtcagaagcgtcgaataacaaaatgggctttttaaacccaaaaattatatgatctggtaaaaaatatagcgtgccttctttagtacctctatgacactgcaggtgaaatgagtttattttttcagcatcggtatccaccagtgtactgttaacgaatgggttggagattttaaaacccgtcaaaatggcttgctttcttatatattcgacgcacttttcaaagtctgttacattggaatcaagaagccctaaatttttaaactggtttagtgtgttttctttgttcaaggtcattaccacaggttcagaaaacttgttatcctcgcacgatgtgtaagtcataaaaaggtatattagattaggcttttctggcactggcaagaacgaagccattttgatatttttgttcagctgataaatgcttaattccctgtcatttcccttcagtaatgttattacgggagacccgtcaacattggaaagatagaacaccaaatcaagctttttccttaatggtgacagtacagaaacaccttctaatttgaaaatagtattggtttccgaaatttcatctgttttaagcaggtcagaagagacatctattctgggctttttatggcgtccgcttctatcgttgctattttcattcaatgcatatttatacaattcctcaaatatttctaatgagcttggcagcactctaaccacggtaccaatctttcggctgagagactcaggcagttcatctaagaacaattttgacatcaaatctgtaggactttacgtttgaatagtggctttttggtcagcgtttccagcacctttacatcatagttattactacacactaatgcgctatagcgtatgttagatgaaaaaaaaaagcacgacgcgtcattaactagtggggtaacccacgaaataaagataaaaaaataaaattcgtttatatttaaatttttaaagcatatgttcttatgatgtctaattgaattctggagggagaatgtctcccccagtaaaacaagaaaaaactggcgagggtaaatggggcgtttcatgcaacttctcgttaaagtgcacgaatgatctcttgatatcattcggcaaattcctttgttgaatgttttcaatcgttggctgaacaaccgagcctttaaagtcttcgtatgatttgtataatgcatctgaaagcaactgccaacttctagaaatggttcctatggggtcattttgaaatttttcaattgttaacgtactcgtagcacttgtaacgttattctcgtccaggtttctttcggaactcaaacaagcgggaaatctttcgcagtcttgaaaattgtcagagcctaacaccttctcaggtagtacaaattccgccccttccgaagcattgctgttattagatatttccctcaacgtcctatctcttatttggctcgtcgcaccgtttgtatactgctggaaattattgaatcccaaatacatgttccgattaatatcattactgcgcacttcattggccagcctcctcttgtaacttttagcaaacaaattatcatatttttcacgcaatggaatcccgttctgcaaaataccatttttggacaagaaggaaccgaatctgttatttccgcttttctctactcttctgacatccttttcttcaaaattatccattgttattgactttacacaaaatatgttcgtacccatccccctcaaaaggtttgcgcaattaacacatataaatatgccgaagctgcaagaaacaaattgtggattgacactcttgcattcaaaacaattgttattgccggcagccttcttggcacgtaacaatctcttccggttttccatatctttactattttcaaacaaacgcatggtccatatattcttgggtcccttttataccagtactctcttgtagcttgtataatttgtaaattagcgttgtttttactatgcgtttgctggcctaacgtcacaaaatcactttcaaacggcgcgtacactcacggcgttaagtatatcaaactccgtcactattggagtttaccaaaaaggataggtataagagtaaggctccaaatcaaagaaaatctaaatttgaaaagaagttcgtaatttctaatatttacacttttagagtttgggaggtcgtatgttcgagtcatggatactatgaatacagcaaacactttggacggcaaattcgttactgagggttcttggagacctgatttatttaagggtaaagtggcatttgtcactggtggagctggcacgatatgtcgggtacagacagaagccttggttcttcttggctgtaaggcagctattgtcggcagggaccaagaaagaacagaacaggcagcaaaaggtatttcgcagttagcaaaggacaaagatgcagtcttggctattgcaaacgtcgatgttcgcaattttgaacaagtggagaatgcggttaaaaagaccgtagagaagttcggtaagatcgatttcgtcattgccggtgctgctggaaattttgtgtgcgattttgcgaacctctctccaaacgccttcaaatctgttgttgacatagatttactaggaagttttaataccgccaaggcatgcttgaaggagttaaaaaagtcaaaaggttccatccttttcgtctctgccactttccattattatggtgtgccgtttcaaggacatgtgggcgctgctaaagcgggaatagacgcattggcaaagaatttagcggttgagttggggcctctgggtatacgttcgaattgcattgctccaggtgctatcgataatacggaaggcttgaagagattagccggcaaaaaatataaggaaaaggccttggcaaagataccattacaaaggcttggatctacacgggatatagccgaatctactgtttatattttttcacccgccgcatcgtatgtcaccggtaccgtcttagttgttgacggtggtatgtggcatttagggacctattttggacatgagttgtatccagaagccttaataaagagtatgacatctaaattataatacgtataggtattgagtactattattatatgacactttctcgtatgctttttgatagttaattgtatattgatgaattttatatacaatgagtgcactatcgttgttaaacttcttacaaccatgaccgttgtgctagctttttattcttctttccaacaaggaaaaactcaagtacttgcattcatttggtcaacgctttttttaaatgctaactgatcaccagaataatgggggtcattttcaaagtgttcaatctcagaatgtaatcttttgacgtttttaatgtcaatatcttctaaatgattcgaagcaaatccatctgttgacatatttacagaaatgtcattccccccttcaatgctattttcaaagctagaatgatcgggttggttttcttccccggtttctagcatatcctggatgaaagggatatcagtagcttttctcaagacatcaccatatgtttgaactaagtatttgtttaaaatggtaaagtttgtcctattgttgttcacgttcgttttgacgtcattaccgttgccatcataagaaccattggttttttcctttctgttatggccatcactttgataagctctacattctgttataataatgcggaaaaaatcttgaatgcatgaatttgcaagattattcttatctatgttctcctggaagagtttaaaaaccggcgcatataaattttttgaaatcatatatcgatgatagtatttatcatcgagacacataaggtttttaatgcatcttactgctgttaaccttagctgcatcatatgattaccgccgataagtttgctaacagaatctagtataccgttttctaatatgaatcttctggataagacacgatcatgctcagtgcaaacaaatgataccaatttcactaaatgaattaacaaaagatcgtcttttgtaaccttttctatttgcccatctatttctgccatttccgttgtgatatccttcttgattaatggaccaaacagtatgggtgcgattttattatagaaatttgcaaaatattccattacttgaaattcagattcagattctggctctagattattcatttcatcgctgctatagtgatagttatttaaattgattgaatccgagtttaaaccataactgaaacttgggaaatcttcagatgtgttcttagcttcataatttgatctgcccataagatcatatgaaccttctccattacccacacatccttcagggtgaagcaaagtatttagcgcttgcacaacttgttctcgcaatccgggactcctgtcggacagaagaatggttgaaagtatcaataacaacttggaatcagtactggagctgtaatcctgcggatatttccgatgggaagacttgtcatcgggcgctgatttatgttgccgtttgaaagaatcttcattctgaacgttgtgaattaacaagatatcgtgttcgattatagtaatgatagtatccgtagctaaaatcctaacattactatccgtctccatgtgaaatgcataatctaaaactttgaatagaccctttcgaacaagtgttttatagaacttagaacggtcaaccgcatctaaattgattgacatttgaacacactgttgcaacaatctaatcccgtcttttcgtttttgtacaaacttctccttctctgaagagctttctggaagggttttggtatcataaagctctattagtctgtccaaaaacgtccctacttgaagaaagtcgattatacacgtttccaggtccatgacaatttccgagattaagttgaaattatgatcgtctaaaaatcgtactaataccacgtcttttaagaactgtaagcgaaaacattttttcattattatttttaagtcctcattttccaatggaataacctctttgaaattgggaccttttgatcctaaatatttcctatgatttgcctttgatgtagggtattcagtatcgtattctaaaatcccaactattcccataatcctatcgtcctccaccattgactccaatatgtctcttttattgtaaagtatcaaagttttgatgatgttacttagcaaaaataaatccttcggtatcttttcttcttctgctttgtggaaatgagaaatcagtgtatcaatgtaatttgactggaggataaactcaatggtttcgtttttcaaaaaatcgaaagaagtattttcattcaaaatctttagagcttctagtaaagtttgactattctgttgctggtcgttggagggcaaggtcacagggcccgttataatgtcgtgaacagacccgagtccgttgtcgctggattttacggtgactaaagaaatatttgactctatgttcctttggacgtgaacaatgaattcacataaggtgtcacatcccatactttcttcaaaactcaaggctatatctttcccccctaaatccttccaaacaataagcgtttcctcctgccgttgatattcaatatttccttctagtttggattttagtaaagtttcagttggggagtcttcatctgagacaacaagatatgcgaacttaccttcgtccacctcccctatacaaaaccctgtacctgtgtctttccattcgttgttctctaaaatgtaaacctttactcttttgggttcagtattaaccgaaacggcttgttcagtatcctcatccatcggggtcggagatgtagtaggtgtacccggtaatgacattactcttactatacgtaaatcctaaacttttcagttagaatttctgtttcaaacacagaccaaaaaaaatactgttttctaccggtttaatatggaataaatgagtttcgatgaattatagtaccagttcagtacactcttctttatttttttttttttcagtatgcgcgggttttgaaagcactaggtcttttagattttacgtcaaaggaggccgagaaaatattgttaactatgccactgatgcaagcaatctctattgtgcaattctagttatatctaccttgcaattgccctttagaaagtattggtcttctttcttttgtttcttcttcggatgaaacaccaaaggaaaaaaaaaaaagacagatagaaaaagaaaagatggcgcgtcagaaaaagaaacgacggttttatcatcttaaaagagaatcatgatggctatttgttcacaaaataagggattatataaaaattatgtatggtagtggcattatagatttgggctatcagagtttcaatatttggtctgtggattcatatccaaatggctcaaagccgaatttattggcgaaatctcgaggaatgaatcttccccccacgtaatgagttgtttgattctcccttatgtgagagctgcatggcttggggacagtcagagatacaagaacagcaggattaattgagggctgagagatcggacctttgtcaacgtcccaacctgtggggacgtccaccgaaacaatcgggataatgttttgcactttgcacagttcttcgacaatgcccttgaatggctctctcatgggaggcttgaaactaaaaccaaatattgcatctacaatgcataaggtcttttccggcttcaaatattccagccagtttccctcatcttgagacaggacaggaactttgaaaaaattcaattggtgaaccagctgtttgtagaattcagtgcgctcgcttctcttggggtagaaaacaacagggttgtaaccaaaaagcttcaaatgtcttgcgcacacgagaccatccccgccattgttacctggcccagcaataacaaatacatgtttgcccttttccgtttctgtcttgcctctcagtggaaactggcgacatacagcctgcgcgacactaaacccagctaactccattagctgttgtagagtgaatccgatttgaggacccatcaattctttgtcgatttcagctgcaagctttgatgaaacaactttcaacgtagacatttttaccttacaatgatttctctttaatacctgagattggtgtgttgaaatgaaaatatgtgttggcccagcaacagacaataatataagcaaggatcctggtcgtttgatattcttcttgagtttttttcttatatatgaacgtatgtgtatatattcaccatccctattgtctccaccccttgttcgctcgtagcgacggaaacaatcaaataagaggacccacggtaaaagtagcgtaaattttacggttctgctgcaaaataaagaaacccattttgtatcctttacatcaggaataacgtaaaaagaattatcattagttcgtagttatataataacgtctgttcattataaaagagtacaagaaacagtaagatagtaaacgtcactgttaaatagttaattataccgccaatctacaccagaaaattaaaagagaaagcaatatatgttaaacattattatcgtgtcatctttgtaaatcccttaacatacttctaacacaacccatgtcttcaattaacattttccttaaccactgcgtctcttggcgctgtaattccaattctctttctaattgcacaattctttggcctttttcagaaatgattgcgtcataagcttctttcaatgggcgtatcacggcttctgtatctataggtcccatgctgtttgaaggatttaaatcaactttcatttgggtgttattcgcgtttaaattagtgtccggaccatcatttattaacgcaccctctgctgcagttgtcatcggcctctgcctcttactcgtatttgtcagttgcaaaagttcttccaccgcttcgtcatccagcgtattaacatctaacgatcccagtgaccttcgtttccacgaatgggatccattattggacattgtattatagcccatggtattactggaagcattggggttcagatctgcatgactcaaaccaaattcaaatcctcctgagccaggactggttggctgtgtataatatcctgtcaacgaacgagaattgacatcttgtgatagcgtttgcagtcgtttttgtaactgttgagacaatgatggatcaaaaagcatattggtacctgggttgcttattgttgtattactgaatgcactcgtatctgtaatgccgtttctctctttattactatttttattgtttttcccatttttagcatttttagccaccctggtgcctctttttttcgttcggttgtttggcatgtttttatttccatagttcttaatattactcccatttccaatattaccattgttcccattattgttcccgttgtttattccctgtaaatctgatggggagcctttagttgatgtatttaaggagtttcccttcctgcgtccttgagttagaatttggccggtctgaggatcgaatactgtaaatatgctcattgagactaatcgccacaattcatcgttttctaattctgagtctgtctttatttgccaaagccttccatccaaccggcggaagtattttgcgtaaggacttgcgtcaaaactcagctctagttccttaatcatctgttgaaatctttgatatagttcgattgccgattttggtgatgttgatctatcgtcaattgacccagatgatagtgtagcgttatatagttttgatattttggcgaaaagttgagaatattgcgcttgcgtatatattccatttgaggtggcactagagctcgcattattaccagtagtggcaggattgcttgcattgctaatggctgaggtagaacttgaattaccattcggcgtaccattagcgctatctgagttggttttcgtcagagcattactaccagtgctagttataatctcatcgatgttaggtgtgctatcagaccccatcaaccctgttggattagctatccctgttccaaccgccccgttaaccatacctgagggcgtgttcgttgtcgtctgtggcgagtttgtaacactctgcaaggaagcaccactaatgacagactcgttagacagtaaattataagctctgattatgaatacatctaacttagtttggtgatgcattatgtgagtgtaacttttcgtcaaatactctttgtgttctcaggttcctttttggtttcttggttgttttcccattcagtctaggcgtaagaatgtgaagaaagtcaaatacagaccgcaagcaccttatggatgcgttaatgattattatgtctaacggacaactatcgcagaagtcgcggtacttgaaggagaaaagtcgtgaaaattttattttggacaaattgtccaagaaaaataagaaatatgacgttattacccgtattgagattccattgaaagacattcataaaattgatcagttcggtcataaacaaagtagaacttcgaaatatcaaatatgttcttgccactggtagcccatatttttttaatctgctcttgtagcatagggttgaaaatattacattgaagtcgataccgatatatacttctataaaaatgagttctggaataaaagtaaggctaatacatatatatagtgggagaatatccaaaggcagagttttttaaacaaggaaagaataaaagttggcagcataaaaaaaagatattctctcttcaaaacatttgtcggatatgacctcacctaagcacttggtgctttgatgacaataatcacactaaagagcgatattcgatagtgagacttttccctctcaatcttattcacattagcgcaagcaaaatggaatgaatggcacattaaaattgaaaataaaagttcttgttgttgcagaagcggtataggagttcgcaaaatggtagttaagaaaaaagatggcgggtttaattcatagtacaattcaaatgttagacagaaaaagaaaaaatttctgttatatgcacgttgtaatgtaatagtaaaaagataatttaacgtaattgaagagataaagtattatcgatgttattcttattattagtcggtttagaaaatattattataacaaataataaaagaaaaagaaaaaatgcgacagaaaatattattcttattatagtgggggaaagatgaaaagcaatgcatataatgtgatacatgcaaggaaatcaggtttttgcggaaccatttttttagttttttatatgaccaacattagaattgtaactggaaagcatatttacattaggatttgggttaccactgcctcctcttctgctgtttgggcccctaacacccagtgggttttttgaaaagcttaatctgatacctcccttactgctcacagtggagcgaggtaactgtctaccatacaattcagctaacgctctggttgcaaaactgacatcatcgaattcaacgaagcacatcggtccgtgactatgaccattagatgtggtattcttattcctgaatgatagtcttctgaagccttcttgaccagaaaatagctgtcttagttcttgctcagtagcgtcggagggtaaattccctacataaagggtattacaaggtggattttgatcagcagggttggcaggaggtggaattctggctagtagtgacaaatcagcctgagaaatcgaggcagatccagtaatatttgaggataatgaggtagtagagttattcttgtgtgaatttctacttgaacttaatcttgcgggcggtactttttgaggagtgttactttgattcacaggatacatatgctctggttggggttgttgcataaatctgttctgtttttgaggtgtaatgttcatatcagaggtgtttaccatatttgaaatgtgctgcgattgagaagacattaaaccgtatggaggcaatgaatttgaagaggttagggaagtgttaatcgtgttaccaatttgcatcattggttgttgcgagctggcagagagtgcctggttagcaccattattgctggctccattgttggagctggcgtttgcattggcactggtgttgctattcgtaggtgcaatggctgtcgatgctgcagagggtaaaaagaacgaagaaccatgttgggatgcagaagtatttccccattctaaagttggcgtagaaggttggggagtgctcatgtaaccgttgatgctggaaggtataccgcttgtgccccatatcttttcattaatttcagtgttatctctcaaaaggaaagatttgccaatatcagatgtttgaattgttgattccacagacaaatcttgatgtgaatggttagaatgtaacccaataacctggccttgagaagataacggtattgaagaattcacttgttgttgattacattgttgtggtgaatgtttttgcgtagagtgttgttgtggctgttgtggctgttgctgctgctgttgagattgctgttggcttaaaggagaatcattggaaaatggatcgctgaatgaaaacctggatctttgtgataacagacttggccttttcattcccgagttcgatttattcaatcttgaggtgtcattgaaaatggcagatgatgggaatgaaaccaagttttttgttgtgtcatctattatttcaacggttgttttattgggaaaactgggtccaaagagttcatttttcgaattcaaaataacggcataattaatagctagattcaataactcaaatctggcaatgataaaaatatcattctcgtcttctaatgaggcagaagtgatgcttgatgaagagttttttttctgtaattctatacttttcacaccttcagcaagagcgaagattgcatagcattctctgagagtaatatccttggctacatttgacaattttaggctgtagctccccttaatgttgttatcgtgattgctaatgttgctgcttgcaatgtcttggggcatacttccaagggcaagtgtgtttagcatagaagatatcgctaagggtgagtttgtgtcattcaaatacaactccccacttgcgcttcctctacccgacgcttcgtggggatgagaagtagtgttcagattcaaactggaacgatgactgggagaaatgttgtgtgtgttggtggtactagacacaacgttgtcgctactggacgcaaatgaccctgtttggtcaaaataaactgaactttgcatgctaagagatacaggtttttccctctgaaatattgatcgataaaggctgctctaggtaagtgacgcttacaaatatttgcaactcacagaaaagtgatgacaaagacttttaacttgaaatgatatgatcagttgagaaaaagctggtgaagcaaatgaaaaatacgggaagaaaacaggaacagaaggttttcaaagtacacgacttattttctctttaatgctaattgattgaataaagagaagacagaaaggaaactgacacgtaaaatatgtggacggaataaacaactgtgcgtgagcagcgtttcaaaagccttttctttttggaggtctgtgcttgtttaaagaaggcaattcaatcaggtggttatacttgtttattccggcttacttggtcgtgtttgttttttcttttgacctctcatgtccgaaaaggtccaaaacaacgagaaaaaaaagcagcaatcagttaccccatttaacgcgggtaacaataacgattgttctaaatagagcagatatccaatagttgagaacatgaagaaggatggcgatagaatcagtgcgaagcagtctaaagaagttcctttccctttcctttccttttattttgctaatagtatttgatataaagatgaaatactataagaagtttataaattttttaaattagaaaagctaaatagcagcttgatcgcaacaagtggggaattctgaccagcgcgacgcttgttgcatggttattcctgcatctgggactggtttttcatccatacacaatctttcaagcccgatggtgacatttttgaccttgtttgagtattccatctcttgctgcagtagctttttacctctctcatgcagaccattagatgatgcagatatgttaagatcttcggtaattagcgctactgaattgaaggaggttatgtcgttgtagttgatattatatttgggatcaggaactgatgagaccgtagtcgcattactggtcgtgctgcagtttgaccagcgtcgttcccaggaggtgaactccatgtcttgaaggacaaactgactatctttcgagacgtcgaggacgttatcattgaaaagttccgtgagttggacattaagaggactagatgtttgaatagcctgatctatcatgatcttggacacggtttgatggtctatgtcaaaatctagtccagtctgtggtttaggtttaccattttcagctgctgtgttctgattaatggcttctgaattcggttctttgaaacgaaattcttttgccagtgataattttttctgttcttttagccttttgtcttctcttttgtagttttctttttctacttcttttggcttctctctatcttttctacttgtatttttttttttgtttttagccattttatctaagaactttttcctttcttcaccaaaagctctcattttatccttttccctcttagtatctatttgatcaacatttccaccttttgatttatttttctttacttgtcgatcttttggtagtttcacttcgtactttttgtaaccgatgatttgatctactttattcatcataacagtaatatattatgtttttgatttttactatactgattaaggtagaaaatgggacgatcttgctttttgtgtcctttcattgaagcactgttatttatacggtcaactgcagccgggcataatttcggcggctattcatattgtcatccccgcactccttctttgacagcacgcaagcacatggaggctgataatgccctcccatattgtaatagaatatatttatgcaataaagagaacgcaatagctgcatttaaccaataaaaaattcgttatgacaataatatgtagacaaggatataaaagtataaggttggttataaataaaaactgtaggaaaaacaaaaactacttatgcaagaccttattctcagggtgcgaaatactatgatcagtagcgtttagaacgttagccgaaggattagtctcatccataatttggtttcttgggacattgtgccgatcacccacaccgtagcgtaggtttccttttcctcagtttcctgattgaatgatggaatacttgcgggatatccctgcactttagtggtgtaagaagaagcagagacgccgctattttcttctctcatcattttctcattgtacctgtctgaggaagccgtttgggggtccatcatgtcttggttgttattatcggcacggcgagaagaaacgctgttccacgcgtcgatgtgatgaggttgactttgaggtgaacctgcaccgggaacatgttggtcgataggcccattgaagtgcggatcagaggtgtcttgacaaccaatcggcacgttcttgctgttcattcttgcctcggtcattttactactatcaaaattggctagcgtagacctagcgtttttgttatagtcactgaccactctatttgtgactttgccacatcccgggataccgatgctaccggcaccggtgtttaaagtagggcctgggcattcagttggtaaaattccagagcgctgttcgtgagacgaagagtgtccgtcacgatgaggatatttgaggtcgcttgccctgccacaccctggaacgctgtacgttttatcctttgcctggttcatattgagagcatcatcacttgcatatgcttgagcagattggcccaaacccagcatcctgtcataagatttgtcaatatggtagccgaagccgtgctgtgtagcagaagactcttggtttgtgtctaattcattgctgtcgaaatagtgaaaagaaaagaaaaagagttagtaagatgtgtatgatacattaaaaggaagttaaaatacgatttctttttattagatggtatcattacattgtttgacgtatagtattagtattattagaggttgagaattaaagatattatatttagggaaacataaaagattagtggaatatcggtgcaaaatattagtaataaataaaattggtatcaacagagaataggagaaggctaatcgctgcaattaggtttgttattatttgtaatcctagctttaataataagggaaaaaaaagcctcctttgcaccctatgatacaacaggaacattctgttcagtatagacgcgttcctcttgaacccggtctggttcatcgcctgcgctagtcacagttctctttttcgttctcaatttcttaaagaacctatgattctggtgggattgagattgttggacctcagttacaggcaccgaggaaggtattcctccatttgttggaactggagttggagtttgtgagtccactgtcttggtagaagcgaaactgcggtcatagatgtactcgtttcttttatgagtagccaccatgatagtacagcaaatggcgtttacaattaacaaaaatactgtggtccaaataagcccaaaattcttgggacctagtctagcatcacgattctcatggtgaaacgcctttactgccttagcgtaacatcctgtgtacagacaagcggatagggttatgaagaaaagcgtgatccagctcattgcagttgccagagcggcggtacgtctattgtatctgattaaactggcaataaccgaaactaacgtgattaacaaaaagaaaagcccgattagaagcattgcccagcccactcttgaaagataatagtaggcatttctgttgtttaaaaaagttgagggcatgaggggggaactgccaaagttgtcccttggtgaaaacggctgagctgccatcttagaagagcagttgactgctattccgcggctttcccagccgcaccagttataattgtaccatctggttacggagggcgccgagttaaagcccgaagtggatgcctgaaaccaataaaaattcttcaacactcctgtggtcctgccacctgctagtatcagaaaaaaagtcaacaatgtagcccctagtagaaagaaaaggttaataaagtacacaaactttttgtaggacattgattattagaaacggaaatatatgaggttatacttaatgcttatcgtgatcgcaatacaagtaattgtttatggttgtttgaaaaccctagaaaagtggctaatttcggataagaattacagataggatctctaacataatataagttgttagggtatttagctaatgtttttatatcgaaagcaggggataacagcggagacagaaaacagggaatagtgatctcatctttccatccgttcatcccacttttacgtccttgtaaatagtacaaactgcgggtagtaatgcaagatttgatgatatacagggtgcttttgcattgcaaccccctcccttaaaagacgctggggagcaattttgttctagaagtcccctctttgtcgtcttcccaaatccgacttgtgcggctgtgcggctgtgcacttcagggggtgtccttgccgtaatttcgaggagtctttgtaagtgattaattttctcaaaaattcaacgtatgaaaaggtgatagtttcggcatctgcgatattcttttggaccagttagtgatgacgaaggcccttaagattatgttgggagccaaattttcgtagttgcatacgtaattttgaatttgatttgcttttttttcttttttgccttggctttccgttgatgcggattcttgagagttctaaaagtttatgtatacaaacaccgcattgaatgcttcgcctcttaagcagacaactagagtattgtaaaccaggtaatgggacctccgaaaaatttcaagcatttcagtaagagtaataaacacaaaaaggagcagaaagccctgattactcaagaagatttctacctggcagcgatcgactgtgaagaacaagcagaccgttggttgctatcggacataaagaaatgtttgcggttctatctaaaggctctagagcactacgaaaatggtctgactgctttagattccacgcaggaagggaaatataatatctattataatgaaacaaggctttttttgcaaatttatacagattatctggccaataacggctacattaatatcttgcaatacgtgaaaatggatgatatgcctgatctttccaatttggtgttatctgtgccacagattatccaacggtttgaaattgtttatgagactttcccagaacagagaacttgggatcttcaattcaatctattgacatgttatttgactctcatagagtccctagacgacaccgtttcgcccaccgttgcaatggaaggtgcagacattttaactttgacaaacaagtatattgaaatctttcaacacctggttaattatctgttacaagaactacaaaactggagtgaaaatgcagaacaagattccgatgacacagatacggaattgcaaagagatactttggatgaagacgcgatgcaagttaccagggacggaagtggtatccgaaccaatggacctgtacaacctccagcagaagttatggacgtttctgaacaagtgactccgtcttcacttaccgaagtactcgccaactctttaaagttcaaccatgctttgatggaattggttattgagtcgaaaatatctattgaaaaaaatgtcgaaacgaaaatcttgaatcctattcagattaatttcttggaagatacaaccaataaattctatttacaactacgcgacattatagactccatttccgccgccattccattagatttgaaggaaatcggtttagccaagactttaattgaaggtttgaacatcattagctccggaaccttcgagtcattgcaagattttgttctgcaaaccgtctcctttaccgatctgcttgatgaaaaagatgtacagggtaagattgatctttcgttgattagagttgatatcgttgaatttgccattctatgtttaaacgattattcttcagatgcatcttggaaactctctgggttattgaccaaagttcttacagaggctagaactttattaacagactatagaaatcaaatcttgtttctgaaaaatcagacattgaacgaacaattgagtcacgtagtttttcaactttgtgatgtcttagtaaattcctccgataatgaactgagaaggtacgctataaaagaatcaactgaaaagtcacaaaaaacccccgggggagcgcatactttaaacatattgatgaaaaacgctaacgtttttctgaataatgctgtcgctatctcatcaaaacagtgcgggttacaagaaacgattattgataaactgaagaggaactatatccataatcaagccaaggaaagactacttttcttacagaggctggaacagaagtcaaatgaggatgacggtacttctgcttcgcctaccgcaatgacgttcgatatgccaccagaacaccctttttatagccactatcggtagtgaaattacgtacatatacataagtagaagataattcgttgcgcatatgctacaagaacccttggtgaaacgaaatttgatacaagtaaatacatgcaggaaacatacattacctctgaaacaaagccgagacggggcccagcagtctttttttagaaatcgcgtggcttggtaacgcgataatgacgcgacacagccattagtgtgaaatttgattttcttggccaaactaggtataatatttgttacaaattattgattttaatatatatctcgggttcattttttacgtcggtactccaaaggatcaaaacacttacattttgaggcctaccggaccttgcagtactgcttgtttaaatacgcagtatacatttcttcttcttcttctctcttctttccttcctcgaagagtcactaaattaatactgggaagccaaaccaaaaaaactatacaatgagtgatcaaaataatcgatcgagaaatgaatatcactcaaaccggaagaatgaaccttcctatgaactccaaaatgcacatagcgggctatttcactcttctaatgaagaattaacaaacaggaaccaaagatataccaatcaaaatgccagcatgggttcattcactccagtccaatctttgcaatttccagaacaatctcagcaaacaaatatgctttataacggtgacgatggcaataataatactatcaatgataacgaacgagacatatatggaggttttgtcaaccaccatcgccagcgtcccccaccagcaactgcagaatacaatgacgtttttaatacgaatagtcaacagctaccgtcggaacatcaatacaataacgtaccttcatatccacttccttcgataaatgtgattcaaaccactccagaactcatacataacggctcacagactatggccacccccatcgaaaggcccttctttaacgaaaacgactactattataataacaggaactctaggacgtcaccgagtattgcttctagtagcgatggttatgcagatcaggaagctaggcccattttggagcaacccaacaataacatgaatagcggtaatattcctcaataccatgaccaaccttttggatacaacaatggttaccatggcctacaggcaaaagattactatgacgatccggagggtggttatattgatcagagaggagatgactatcagattaattcatatttgggtagaaacggtgaaatggttgatccttacgattatgaaaacagtttaagacatatgactcctatggagcgtagagaatatcttcatgatgatagcagacccgtaaacgatggaaaagaagaattagacagtgtgaaaagcggttactctcatagagacttgggggaatatgacaaggatgatttttcaagggatgacgagtacgatgatctcaacactattgataaattacagtttcaagctaatggtgtacctgcatcatcctcggtgtcttctatcggatctaaagaatccgacataatagtaagcaatgataacttaaccgcaaatagagcactaaagagaagcggtactgaaattaggaaattcaaactttggaatggtaattttgttttcgattctccaatcagtaagacgctattggaccaatacgctactacaacagaaaatgcaaacactttaccaaatgagtttaagtttatgagatatcaagcagttacttgcgaacctaatcaacttgcagagaagaatttcacggtgaggcagttgaagtatttaactccaagggaaacggaattgatgctagtagtcacaatgtataatgaagaccatatcctgttaggaagaactttgaaaggtattatggacaatgtcaaatatatggtgaaaaaaaaaaattcaagcacttgggggccggatgcatggaaaaagattgtcgtttgtatcatttcagatggtagatccaaaattaatgaacgctcgctagcattactaagttcgttaggttgttaccaggacgggtttgctaaggatgaaattaatgaaaaaaaagtggcaatgcatgtctacgaacatacgacaatgatcaacatcacaaatatttcggaatcagaggtttcattagaatgcaatcaaggtaccgttccaatacaacttttgttttgtttgaaagagcaaaatcagaaaaaaattaactcacatagatgggcatttgaaggctttgcagaattactgcgtcccaatatcgttacattgttagatgctggtaccatgccaggtaaagattctatttaccagttatggagagagttcaggaatccaaatgttggtggcgcatgtggtgaaataagaactgatttgggtaagagatttgtaaagcttttgaatcctttagttgcatcacagaatttcgaatacaaaatgtccaatattttagacaaaacaaccgagtctaactttggatttattactgttctaccgggggcattctctgcgtataggtttgaagctgtgagaggccaaccattacagaagtacttttatggtgaaattatggaaaatgaaggttttcattttttttcttccaatatgtatcttgctgaagatcgtattttatgctttgaagtggtcacaaaaaaaaattgtaattggattttgaaatactgcagaagttcttatgcttcaacagatgtaccggagagggtccctgaatttattcttcagaggaggcgttggttgaatggttcattttttgctagtgtatattccttttgtcatttttacagagtctggagcagtggtcataatattggtagaaaactccttttgacggttgaatttttttaccttttcttcaatacattgatttcatggttttcattgagttcatttttcctattctttagaattctcactgtttctattgcactggcataccattcagcatttaatgtgttgtccgtcatattcctgtggctttatgggatttgtaccttatcaacattcatactgtcattgggtaataaacctaaaagtactgagaaattttatgttctaacttgcgtcatttttgcggtgatgatgatttacatgatattctgcagtatattcatgagtgtcaaatccttccaaaatatattgaaaaacgataccatcagctttgagggtttgattaccacagaagctttcagggatattgttatctctctgggctccacttattgtttgtacctaatcagttcaattatctatttgcagccatggcatatgttgacaagttttattcagtatattttattgagtccttcttacatcaatgttttgaatatctatgcattttgtaatgtccacgacttatcatggggtacaaagggtgcaatggcaaatccgctgggtaagattaatactacagaagatggtacgttcaaaatggaagttctggtctctagttcagagattcaagcaaactacgataaatatttgaaagttttaaatgacttcgatccaaaatcagaatctcggcctactgagccatcttatgatgaaaaaaagactggctattatgcaaacgttagatctctcgtgattatcttttgggtcatcacaaatttcatcatcgttgctgttgtcttagaaaccggtgggattgcagattatattgctatgaaatccatatcaactgatgacactttagaaactgcaaagaaggcggaaattcccttaatgaccagtaaggcctcaatttattttaatgtaattttatggttagttgcattatcggcattaataaggttcattggttgctcaatatacatgatagtaaggttttttaaaaaggttacatttcgctaagtagattgattacccctttgttataaataagtatatgtgtttactatcatataataattaattagttgtaagtatggtatttttcaaagaaacatttagtattatttttaaagggtgcctttaccataaaaccaaaaaaaaatggcttctgagagaaaaacataaataattgataaaactgaaactcacaacaccaactcttccgctctaaacacccaaagctcaaaaaacgacatgtgcacatctatatccataaactttcaaaaaagtggttcattcgcaaattcatgaagtattatttaatacacagtaatctggcatttcatactatcattgctcaaattatccgccggacccttgaaactgtggcgctttttaagacgcatctccaaaaaaagaaaaagaacaaaagaaaaaaagctgcaaatatatatacaaaacagatttcacgtttattgcttgggagtaaggtaacgatccggaagccttgaagaaatttgaatgtatccaactaactattgaaaatcattcgtgatgtgcagattcttgattttcaaaggcaaacaaccgattcggctatctcatcttttaacaagaccagctcattctatcataaaccaatcatttgatagcagattacggctagacagaagaaggccaatgaatggtgatggttttggtgtcgcttactatccattggataccgagttaagcgaggacggtccatgccttttcaaagctattactcctgcatggaacaaccaaaatttgagtacattagcagaaaaaactaaatctgatctggtctttgcgcacgtaagagcctctacatatggtgtcctatctgagaccaattgccatccgtttacataccacagcttatgttttatgcataatggcggtatatctaatttcaaaggaatcaagagaaaattattgaatcatatcaaagacgaatacctgaattttattcaagggagcacagactccgagtgcgcatttgcattattcttagacactttagacaaattgggttacgacccaaagaagcaggacggcgatttcggtaatgttgcactaagaaaggcaatgttacgaacgattgactacatcagagattggactaaagaagcgaacaaggacgaggcacatgtggagccatctctcttaaattttgctgtaactgacggatccaccgttgtcgtttccaggtatataacttcaaagacggacgaggcagcatctttgcatttcagttgtggttccagctttgtagaaacttcaccaggagaatacagggtagaaaggttggatagaaaccaagatgtaattatggttgcatcggaacctttgactttcgagagaggtgattggactgcagtacccaccaacagcatattgaccattaagaaacagacaatattactacaccctattatcgatgagtactaccaagaagatccgttatacctaagaagttcaaccctcgcagaaagcaaggggctcatgggttctataccactagcaaaagccgtagaaaagaacgttcctccactagaaagagagggccgtacgagacctccaaccgctgtcgcacatatagcatgagcacacgctctagaggattgtaccattgtcactactagatatacatataaacaaataagaagcatcgacacataacaacaaccccaacatcataatttcataagtatttggttggttagtccatatggcgtctaatcctcgaaatgagaaggtacccgcctggtgtctatgacaaccttccgggtaataaatgttcatttgaacccattcatccaattgatatccgggcaatcacttccggaagcggaaatttacaaatatccggtgggtcctacaaggggactaaagaaaaaaaatacgtgaaaaacagcgatgcgatattttttgtatcgtcttgttcgagtgtttcttaccacgatgaccgggattttggccggtgaaaaaaaaaaaatgcgctcccgtacgtcagtggctgttgctgaaacgagacaatttctcaattcgtttgtttgtgtactgtatttgttatctttactatatatatgttgttaagtttcttttaccaattagtgctcacttctctcgtcttttattaggtgtgtgtgttgtgcgtaattttcgtttcgctgattactttatatagtgtagtttgttcttgaatgtaataaagacttctgttttattttgttttgttatttagaaacagtctatctggtttaacttaaacgagtgagcttaagataatctgactacaagaaaaccaagcttctattactttgtttctttctcttttttcttttttgaataaagaattttcctttaaggagtaacttaagcatttagctgcacattaaacacttttttttttacttctaactcacacacttttggaagaacatttattttttcgaccttctttcccaaatacccagcgctttataattgaaatatgaagttctcttctgttactgctattactctagccaccgttgccaccgttgccactgctaagaagggtgaacatgatttcactaccactttaactttgtcatcggacggtagtttaactactaccacctctactcataccactcacaagtatggtaagttcaacaagacttccaagtccaagaccccaaaccacactggtactcacaagtacggtaagttcaacaagacctccaagtctaagaccccaaaccataccggtactcacaagtatggtaagttcaacaagacttccaagtccaagactccaaaccataccggtactcacaagtacggtaagttcaacaagacctccaaatccaagactccaaaccacactggtactcacaagtacggtaagttcaacaagacctccaagtctaagaccccaaaccataccggtactcacaagtatggtaagttcaacaaaaccaaacatgacactaccacttatggtcctggtgaaaaggcccgtaagaacaatgccgcccctggtccatctaatttcaactccataaaattgtttggtgttaccgctggtagtgctgccgtagccggtgccttattactattataataagctttgaattggatttgagaaataaaggaagacctaattttctccggttttatgttttttaccccccctacccccttcatcctgaagtagtaaattctttttattatactatttcgactactatgtgtttacgtgtgcttgtgcaaaagtgaaatttattgtgattgtgttctttttctcttttttttatacaaaaaatggagaaaggaaattgggacctacgatttaaagaagtgttatttcctatttcaacgagttaaatgaatgtgtgtgtttcgttgacttgtaaggatagagaaagatcatccaacttttaatcatggtttcctttccttttttatagcaatcgaatgtggaaggaaaatagagcggagcttgataattgtgtgtgtgaatgtcttgctttctctttttccttatttctacgctatacaaaaagtgtgcttttttcttctatttttttttctttaatgactttgtgtgtttattaccctttaattaattaccaaaaaaaaaataaactacgtttttaatttctaatttatcaaaatttctttttttcacatataactatatatttatatgtcaccctattcaagttcgttagttttctttcaacggtccaaaatttgggatatcttgtgtgtactttactttctccactaacgataagacatctgctattagcctatattgggcttaataaaaaaggtatcttcgtctagaatgatatatgtatacaatcaaaagtttaaagctaaattttttattaacaagttactttatcaagtagtagttaacttaatcgaccgaattaattcaatagtaatcaattccaatgcaccgaagagtttgccagtcgaactatctaagtgatacttgtccatttttcctcgaagcgcaaaagagattacatcaccattaacgaattttcttcttttcttttttcttcaagagttgatggggaaggactaggaaggaaacggttcagatacgaatttagtgattaatcatattctgctcaagaagcgacttgtaaggtaaggaaaacccgcattcactgacggaataaggaacaggaccaactataagcctccttttacactcacatcttcaggctttattttgttaagactgaaacatttcccacttaattgaagttacatcgttattttatagaacgatctttctattttgttttttgttcacttgatataccttcccttctacataacaaattaataaatatggataatggtacagattcttccacgagcaagttcgttcccgaatatagacgaacaaactttaagaataaaggcagattctctgcagatgaacttcgtcgtcgtagagatacacaacaggtcgaattaagaaaagcaaaaagagatgaagctttggccaaaagaagaaactttattcccccaactgatggcgctgattctgatgaagaagatgagagctccgtttctgcggaccaacaattttacagccagttgcagcaagaactaccacaaatgactcagcaacttaactctgatgatatgcaagagcaattgagtgctactgttaagtttagacaaattttgtctagagaacaccgccctccaattgatgtcgtcattcaagccggtgttgttccaagattagtagaatttatgcgtgaaaaccaacctgaaatgttacaattggaggctgcttgggctttgactaacattgcatcaggtacatctgctcaaacaaaagtggttgttgatgctgacgctgtacctcttttcattcaactattatataccggctccgttgaagttaaagaacaagccatttgggccttaggtaacgttgcaggtgattcaactgactacagagactacgttttacaatgtaatgccatggagccaattttgggtctttttaactccaataaaccatctttgatcaggaccgctacgtggactttatccaatttatgcaggggtaaaaaaccacaaccagattggtcagtggtctcacaagcgttgccaaccttagcgaaattaatctattcgatggacactgaaactttagttgatgcttgttgggctatctcttatctatctgacggaccacaagaagctattcaagcagtgatcgatgttagaattcctaaaagacttgttgaattactgagccatgaatcgactttagtccagactcctgctttaagagctgtaggtaatatagtcactggtaatgacttacagactcaggtcgttataaatgctggtgtcttacctgcgttaagacttctgctaagctctccaaaagaaaatatcaagaaagaagcgtgttggaccatttccaatattacggctggtaatactgaacaaattcaagcggtaattgacgcgaacttgattcctccattagttaaacttttggaagttgcagaatataaaactaaaaaagaagcttgttgggctatttccaatgcctcttcaggtggtttacaaagaccagatatcataagatatttagtatctcaagggtgtataaaaccattgtgtgatttgctagaaattgctgacaacagaataattgaagttaccttagatgctcttgaaaatattttaaagatgggtgaagctgacaaagaagctcgtggtttgaatatcaatgaaaatgccgattttatcgaaaaggctggtggtatggaaaagattttcaactgtcaacaaaatgaaaatgacaagatttatgaaaaagcatacaaaatcattgaaacctactttggtgaagaagaagacgccgtagacgaaactatggctccacaaaatgccggtaatactttcggctttggttctaatgtcaaccaacaattcaattttaactaactgaatgtgaagaaaaagatcaactaaataagtttattcagataaatcttcattatctgatccattatttttaagtttttcttttaatgtatataagaaattctaatcttttaattcgcacaatagtattttcatgtactagttcgtacagtattctctttctctggggtttttcccttttatagaagttgacttgttctatagttgttatatatgtattgctgggttttttaatctattttgcggaagacgccaaaaataagaaaaaaattggaaagacacaagaaaaaagtaagaatatccacagctgaaagatctaacaggcgtatttttattttcgaagaaacgtcctaaaaggatctgattcagcacattgataatagcataggcatttttatctttcttttttgagttcatgaatgaatgtaacttctccaaaagatgggaatcacagtttctcgaagaaaaatagatttaatacaaataaaccgcgattccacaaactaaatgagcaggcgcagagtataaatttaccagaagaccgtgattcaattgtttcaagtaatacaacgtcaattatgacagatgatgcatttgattacaatgagggcattgcatcgcgtaccaaaaatattaattctgatagtgatagaagcaatgataccataaaacaaaacaactacaataaaagggagaccggatataaccctttctacaatggatcagggatcaatcagcgatatacacagtttcgaaaaagagagtttgaaccaacacttgcagaaaacaaagccgaagagtacatatcggacgaagataatgtaaaaattgatgaagataatatagagaacgaactccagtttacgccgaaaattaaagaggctagtatactccgatctagtttactaggacaaagaaatgttttaaatactcggaatccaaaatcaaaagaatcacacattaaagtaaaacccatcatcaataacaagagctcctcacaaagaaaatctagtgcagcacttcggaaacaattaggaaaacccctaccgctgccgtatttgaatagccctaatagtgatagtacacccacattacagagaaaagaagaagtattcacagacgaagtgcttcaaaaaaagagagaattgattgagtctaaatggcatagacttctctttcatgacaaaaaaatggtggaaaaaaagctagaaagtttaagagaatacgaaaggaaaagaatgcctccacgaggaactgatgtttctagctctgagcaggacaattctttcaaaatatcgacgccaacaaaatcgtatgtttctttggagcaaaaacccttaccaaatctctctgctatgaataactttaatgatgttaccgacaataaggagaaagaagaaacgaacaacaatatattaaagttccaagcgcaacgagatccattacaaatactacagtctgagatcgaaatgcatactaagaaacttgacacgataatagagttactaaaagacgataccgattcaaaggaaaaaaggaaagtagtgactaatgacaacgcagcgcctgaacaaatggtcaacaaaggatggcggaaaaacgtgatgatgatctacaaaaaatcaggaaatattatgaaaaagtatagggaatatttcttatggacaatttgtattttaatattgttatattgcaatatatatgtgtattataggttttaaaccatataaaggttagtacatgaagaagtgtgtacagttatggcaataactgttctcttccgttttaaagagagtattatcacggtctgaaaattaagcaaaaaaagaaaagcgtgcacttaaaaatcggtggtggacagaccgcatattccataaacatagatggtacaagggcattatgagtccttgaatagaaaaaatgatgaaagaatgaatgcaattccgtattgcgacactggcgaagtgttcgaggctgacacgatagcgaatgtatggaaaagagaagataaggaatggttaaaaaggactcaaagtgatcgaagtggatacgagtatccacgactaggagaatcaccatatatcaatatgacaagacgacttcagaatggaaaagaaggtaatatgtcaagatatcttttggtcatgtgatggtacatcgtttgtttctgtgcataatgattttggcatcagacaatatttagtgccggaggaaagtaatacggacaagctaaacagaaacctccttctaccatttacaaggttttttagaaaccagtctattgtttcatgtgcaatagacccgttttacacgctttataacgagaattccgacaggttagctggtgacagaatcgtggttggaggaaaaaacttccctctacaactatactctttgatggacgggcagtgtatcctcagctatgacacgatgaacaaaataaatggagaatacgaaactgtatacagtgtgaaaatcgatgttgagtctcgtgtatacactggctcatgccgtaacaaagtggcgatatacgacaagagcagacgagatgccgtgtggatgaaccagagtaccaaaaaagcaagcaagggaagacaaagcattatatcttgctttgaagagcaaccaatgggagggcaagctctctcaagaggatctctattgtgtggcagttatgcgaatgaaatgtttcaggtagactgccgtcatcaacgactagagagactgaactacacccgcacagttgcaggtgggattgtacaaatccttacaagcgataacgggcgttacgtgtacgttgtcagacgcaacagtgacgcgattagtatttacgatcggcgaaacctgcagcacgagcttaacgtattgcgcctaccgtttcggatccaccacaactctgcaaagttgaaggcatatatagatacggcttacggactaagtatggggacgccgcagggaacaatattgaactggggtcgagaccttgtggaatttggaggtgttccctcacacaatagtgttgaagacccactaatcacgtctatcccgccagagtcagagtggcgcactaaccttgattctactattcctgccacggtagtgaagaattgtcctggggatcccgaactgttcgccctatctcatgggggcacaatttcattatgcaggttcggcggctaaaaacggcaaacccgtattcgtgtatcacccggccagctttctccgatgaacgcgcacaagtaagaagttaaattgcatcccccagacaccacctcttttgttcacttcttgcctcatgccgtcaaaaaatttttttcgcatcgaaaaaaatccccaaaagaaaagaaaaaagttcttatttttatatagtgccaccatcgggaaaaacttccctgtaaagcattaacagagtcttccatccccgcttctgtcctttatttgtttcatagaagctattaagcatcatatactgcacacaggagcatgcatagtgtctgaagcctcttttgttctgtactgcacataatatttcatagaaaaactaacggaaagaatctacaactcatagtatctgtaaatccgtcctattgtcatatcacaatcacagactatgaccactcaagaatcgatcaaacctttggtagatagaatcctatcaaatcccctgcagttcaatgctgcaatgatctctaacaaatcgaataataatgatacttccgccgcgccggaaaatagctcgtatattgtgataggaaaacagcataataacaatagtaatagcacagctattgctgcaacggccgaatccaagcaaataaaagaaaataacttgatagacaggccaaacggaaagaaaaccaacactgttcctaaatctatggctgaagctttattgttgtatacttctaaaaatgataaagatgctgcagatgctactggtgccaagaagtcagcggagctttctacggagctttctacggagcctccttcctcttcttcggaagatgacaaagtaggaaaagaggaagaggaagagggtgaaatatttcatgaggcaagagactatgtagaaccccgaaaagctagtttgaaggaacgcgacaacgcagataagggcgatggtgaagacatcggcgaagacatcggtgaagacatcggtgaagacatcggtgaagacattggtgaagacattggtgaaaacttgggttctccattagcaaccattgatgattcatctaatgagaatgaaaaggaaaaaagaaaggaactgtctacaagcattagcagtgatgacgaaatagaagacgacgaggatgaggatgacatggattatgattctagtgctatggaaaaagagctccctgaagaagaggagaacgattccagctccaaaatttctgaaggcgaaaaaaagagtttatatcaagatttaatggaaaatagtacagtggaagtaaatcggtacgaaccagtaaacaacaccaaagaaaatggaaacaggaatccaaagggagaggaggaggaagaagaggaagaagatctgaaacataaatctaggtcaatcacccctccggttacaatatcaaatctatcaaacttttaccaattcaatgaaaatatcaatgatcgtggttctttaaactctactagaattgttaaaaattggggcgacaaattcaccaatttgaagcctcgtggccttttgaatcatggtgttacttgttacacaaatgctgctgtacaggctatgttacacattccttcgatacaacattatctttttgatatactaatggggaaatacgatagcaccatctcaaaaaattccgtttcctatactttagctgaaacaagtaaaaaaatgtggttaccggtctcaaaaaaccctagaaagaacgtttcagcttcctacattaatccaaaacatttgatttccagattggatgacattaattgtatgatgagcgaatggcagcaggaagattcacatgagtacttcatgtctctgatgtcaagattacaggaagattctgttcccaagggtcataaacttatagaatcgataatatatgacatattcggtggtcttttaaagcagatcgttacttgcaaatcttgtggcagtatatctaaaacagaacaaccattttacgatttatcgttgcacttgaaagggaagaaaaaacttgatccaaattctgacctgtcgagtgatagcattaacggcacttcagccaccacttctaccactacctccaatgctgccacaaaaccatctctttcatcctcttcatctgtcaatttaaacaatggctcaccatttgccgctgccagtgatttaagttcagccaaccgcagattttctattgaaaaatcaattaaagatttcttcaatcccgaattaatcaaggttgacaaggagcaaaagggttacgtttgtgagaagtgtcacaagaccacgaacgccgtgaagcatagttcaatattaagggctcctgaaactttacttgtgcatctgaaaaaattcagattcaatggcacgtcctcatcaaaaatgaagcaagctgtttcttatcctatgtttttagatttgacggaatattgtgagagtaaagagctacctgtcaaataccaactattaagcgtggtggttcatgagggccgctccctttcttcaggtcactacattgcccactgcaagcaaccagacggtagctgggccacttacgacgacgagtatattaatataatatctgaaagggacgttttaaaggaacccaacgcatattatctcctatacacgaggctaactccaaaatcggttccattgccattggcgaaatctgccatggccactggtaatgttacctctaaatccaaacaggaacaggctgttaacgaaccaaataaccgcccattgaagattaatagcaagaaaaataacagaaaaaaatggaaaaaaaataaaaaaaggaagttcaccaaatgaaaaaactcgatattcctggattttcctcttttcataggcatttttattagcatttcatttttattataccaaatcaatatatacatataaatatccggtctttattgacttataaaacaactctcagtatacagagttggagaagcgtttactcagaatagcttcagtactaccgagctttgctaacataacgggagaaagagaatttaaaacttatatacatatttacagaatagatcagtagaaagaagaaggaaggtctgttgaaaatttctcgaaattgacggtacttttttgtcttttcactacttacagatcaaggtacaaccttaatacccatactttttgcaacgccaactattgatttaacaataccttccatctccaataaactatgcctttcatcactcttttttatcttggctatttcgtaaacgtgcttcagcgataactctcctaaagcacgggttggtcccttggcaggtgcactgcctaacattgtccccacattcggttgtccatgtcccttgtccattttaagagcttttagcagcaaatatccggttggtggagatttcatttcaaacgtaaatgttctatcaggttttattgtgattaatactggaaccggtacacctggctgatagtttgctgatcttgcattaaattccttacaaaagtcaatggcttttatacccttggagcccaatgcgggccccacgggaggtgatggtgccgcttggcctgctcctactattagctttactatcacgttttttgctgcctgtgacattatggagactaatagttcctctatggtattcgagagttcgaaagtacaacaaacagaaataaatacagaaggttacgctgtcgatttgaatgttcacgctttttttccttcttatgagttgtagatttactgcactttctaaagcttctttgctgtgaaattttagaaaagggaattgtcgccttggtaagacaattaatgttacccgcttcattattattaattagtggcgcgatattttaacgaacttttccattaattattatcatactaagcttttacatttttctgataaaatagtagattatgaacaggaggtcaatctatttaggcttctatagaacggtaaaatatgaaattagtttaacagaagtaaatatgacattgtattttaacatatactcaaataggataaaaaaaggttatatacaaatgcttggaaaagaaataaaagtggggacgcttatttattgattattttgctttttctttttcttttctaggcctgcaatatgtgcttcactttgatccacttgtgtgtgatgatggtcttctcctctaaccactttgaacgataatccatcttcaaccaagtggcacatatcaatgctacggatccaaggatcttccatgatttcttcgatatttcctctgcatgcgggcgccaaatcaatcatacgtccaacaatatgctgagtctcttctggtaatgagtgcaacaatctttgtggcccgatattaacattattaggatctgatacattattggaagagctttcgggttttttcttttctgttgagtgcgattcatcgtaggaaggtggatcaggagttcttgtaaccaagctacttaaggagtcgcaatcacgtccggaacaaaatagtttgaatgaattgtcccttaatttcggaattttccatggaaatttcttcagtatcatacatgcaaaaatgattgcagaagaccaaatatctacgggacgtgggtcatacttcgcaaatatacagacttcaggtgctaaatatggatcacttccaacaattccacttgcttccacaagattttttgagaatggatatgaaaataccacagcagcaccaaaatcgattaattttacaatacctttttcgtttataacacaattatctagctttagatctctatgagctaagccgatactatgcaaatattgtacaccagtaagtatttgtttgaagcaacaacaaatctcttcataggacattttattactcattacaatagcaaataaatcgtattcacaatattccataacttggagaattctatcattttcatacacgatttcaattgtttcaatgatattgggatgattcaaagttgtaccaatacagtattctgatgtaattttcttgacataatctcttttggattcattttcaaatttagttctaaactccttcactgcaaatattttgttatctgaaattctttgagctaatttgacagaacctcctgctccagcgcctaaatcggcaccggttttgatgtacctttttgagaacggaattcctgaaccgccgtgactatgagaataaatagtatctccatttccgttataactagtggaatatgagttattccctgcggcaaaatgagacgatgaatgagagtgtgacggaacggcaattccgctagaaagaggtgatccgttcgggatcacgttgttactattcgaggaaaggttactgttagaactttttttgaagaacctctttaaatcaccgatggaagaatgttgtgaccttggaacactttgacttggaggtaagtggtcatgtacagatgagggggaaccgtaaaagttatcagtataggaaccagttggctgtcttgatgcagaatatatgctgctttgtcttgcgcggataggcttcgggataggcgtcgaaccattggtaacattgggattcttaatgtttggagaaggaccattggaattggcagaaaaagacatgcctgcagagttagaatttgaagattcttttgagtttttggaaaagaaaaaattcccaagctgtgaagagaatgaacctgaacgggatatagatcttgattgagtggcatttgcattattactatccatcgatgctttttggagtttttgtttggagataacaaaacgtggttccacgctatctacttttggggaggatataacatttgaatcgattgcagaaatattattgggcataccgcctgcatatgtttcgagccacgaagaagacaaagaggagctgttgctattcgagctattgttatctttgttagaatttggcacggagtaaggtatacttgatgataaagaaggaatggcccttcctgaagtatgtgacgtggtagataatctacttgtgattctgttctgtgcagcaaaagaaccaccatgtgaggaaagtcctgcagtaccttgatcgtttattaaggatccaaatctatctctactttgtgcacttgtgccgtagaatgatgcagtgtgagcaaagtttgcattaaggaagctggaggaaaactgattcctatcgtcgagagaggaaccggctgttgatgatgaatcttcctctgagtatatttgagtaacagttgtgacactgccaggaactggcacgttagccctattacgatcactactgctgctattactcacgctaccaatatgactactactcttattcctagagtgaaggtcaagcgattgtgactcgggcgtcgtggtcaacgtatcagcagaagttctcggtgatgagttcgaagtttcattttttcgtttttcctgtagcaatcgagttaatgaagacataatgtttcgtagagctttccttttttgtttgaatgggtatgagctgttggaaaatcagaaataggaaagagttagacaaaagtattaatgagttctggtacaagccaactagtttgtatggggttgaaaatgacgcaaaggaacgagaactcctgtttattattctttcaataacaaaagcaagatttttagtcactgccgattgttgccactaggtacgccactgactaatccgtactaactctatacaactaaaggcggcccatattctgagataagctataagggtaggaattgtgggatgcgtcattgataacgaaaaaattccgtaatagatgatcagtcagattgagaatgagatgtttcgcacaagtgatgaattatatctatctatgctgtatattttaataacattcctattttattgtacaaaatgcgcgactattccgtttattgcttgtcaagcatctgttggtgttcctcgtacagcttttcgtgcatgtcacgtaactccttgtaggcatgagttaatgcttctatgttggtcttaagttctgtaatttcctcatctttagcggcattgctgtctaaagatgaagtggcgtcgattttattgtcaatcacttttacattgcttgacaccttaccgatatgtgaaaatatcgattcttgcgttttgacctgctccaaataggcattaaagtcgttaagtggtaatgcgaggttaggatctgtctctgcttctggttctcctatctgataccaaatatcgtgtaaatggcctttgtttttaccatcaaagataactctttgtaagtttggtatcttcataaaattgtgaccattattattactaggttgtttgcctttggattctccttcaaaaagtaaatttccacgttcgagtctgtaagggttggttaagagattggtcacttctccaactgaatcctgtgatgtagttaaagtttggatagttctaatgatttgttttgagtaaatttccgcaatagaaactttcccctccgtatcaccgatcaataataatgtaccatccattgatatttctaggcatgacacatttgaatttaggacattctcacagacaagttggcccattgcatatagtgcatccaaatcttcattttcgccgccagttagtgagttacgttgcactagggaaaaaaccctacctttttgaactgtgtttactccggcggactgtagcagattaacgatagcattaccctttagtttataaaataaattcaatgaaaaacaaccttccgcagtaccaatatagcatgctctgtcagcaggatccagtacaatggatttgatagaataaggagttgtaaatgtcgcaagcaatactggggtcttaccaatactaacgtcattttcgtttgccttctgcttctttttgctgcctattaaactcaaatcatagcatctaatggtagcatcttgagatactgtgaagagtttcgtatcagtacatgataaaaattttccttgactagaagaaacttggaaatctgtcacgggtagagtatgatcgtgaaggatacataaaggcttaggatcatcattggacgctgataccaagtcaacagtttgccatataataactctcgaatcgttaccagaagtaataatatacttgccgtttaaaatggacttaatcttggtgatactttggtaatgagccataggcttcacgttcaataaaatccctgaatttaactcccatatgtacaatttacccgattcggtggagccaagtaaaaggtacggaagattgaagtctggtaaattatgattgacaccttgaattctatcatactgcacaccatcattttcaactacttccagacattttaggatttcaggtaatggtaagcgctgttcaacagattctcttttgaaagaacctgacagattgtagacattgattaatgctttttgtgcttgagcaataaaaaggtatttatttcctacttgaacacagctatttcttgattgagtggagcattgcctcaaatttatctgttcaaatgagtgtacagaagctattgttcctgaggtatttgttgtaaaaataacttgctcatccattttatcgtcccttgaaagatcctgttttatgaatattgaacaatcaatcttaacgcatatgcccttgtcagagccgtccttcgaataagcatatttggaatgggcatcgatttaaaattttcatttagtgggatgtaaaaaaaaattttagttcgcgcgtacagtttttcaacatttgccatatgatgtagaatggcgctatcaaatcatcactcttattacaggtgaatcgcgcgctaacacttcaattacagacacatactcctgaatgggtgctttcaaatcccctctcccccaagatcaagtcctatttcaacttctcctctcaaaaaccctctatgtgacgctgtgtattctttgttgtagttatgctccacgatacagtggctgctcatgagctttcctaggagctcagcacgtaaatgtatagcgtacatgctataagcgtggcagttattataatagttcacacggtatcttaccgtattaatttatcaaagtttgcagttatccattctgtgcccgcgtttcttttcagtttatagacgcgatcgaatgtgccttaaaaatttggaagaagagagagaaggatgcataagtaatagaacattacgagaaaatagtttacagaaacaactggctgccctgaaaggcttttttggagaggaacagaaacaaagaacaaaaatttttagaaaaaaaaagaaatgcctttgaatattattgggacggctctcctagacgggactgacaagattccttactatcaaacaatcaaaaaggtggcaccttatgtgctagcgactggtgccattaaatattggtcgagagggccatcaaatacatgggaaagaaagttgcacggtaaagtttacttggttactggcgctacctctcaaggaatgggaacatccgtggcttataaaatggcagagttaggtgcacaattaatcatcttgactagggaagtagatgaatgggttactgaatggtgcgaagaattacgtgaaaagacaaagaacgagttgatttttgtagaaaaatgtgatttgagcaatttgtgggagattcgtaagtttgccacaagttggttagacaattcgccacctagaagattagatggcgttattgtcatgtccggtgatatggaaccatggggtatcccgaaaatatctttgccacagaggagatcatctaaggatgggctggaattgcaaattgctacaaactatgtagcaattttccatcttttaaacttattacagcctagtttcaaggctcaaccgcctgatagagatgtaagaataattcttgccacctgctggttacaagttgttggtgatattaatatagaagatccgttgtggcaaaatgccaaatacaaaagcgccttgaagtttttcgcaagcagcaagctacaattgggattgagtatgatggaattgcaaagaagacttaccgaagacataaaaaaccaaaagacgaatggccctgaaagaacaggaaaaaatgttaccattactatggttcaacctggaactatgagatcaaatagcctacgccgcgtcattagtaatggttcggtggtattgttaataatactttactgtattctgttgtaccccatattgtggctgtttaccaagagtggtcgtcgtggtgatcaaagtttcttgtacgctttaatgacaccggaattggaggaagtaaacttaaaagacacgaaggttaagtatatctcagactgttcaattgtgaaatttgctcgtaaagaatttgatgacgaggaattacagaagaaactatttgataatacggaaagagatattttacaattggaaaagaaagtcgcggcaaagagaaatgccaataagaccgggaatcaaaattctaaaaagaagagtcagaacaagagtagaaaagatgattagaaatgagaacgtaaatatatgtgtagatttctttttttcttatttatgatatcggtatatgtaattatttatttactttttctgcctccttgatattaaagtattacacactttgacttctttttcttcttgtcgtttctcgtctttggtttagcttgcttgttgtgatgatattatttgaggcaattttactacctttgctttttgattgctcgtgaattttgtctttttgtcccttttttgtgggtttgatattgagagcttccttctcctgctgtaagcttcctttcggaagagtactatctgtactattattatggtgtggttgctgtttttgttctcgaatatttttatctccattggtgttggttgttgcagtcgttaattcatcagttagagtatgatttgctgatttttggttaggggattctggttcgtagatagcgtacctcaccgcctgttcaaagacttcccggacacctgcttgggtagcagctgaacattcggtatagcccataaacccacatctttgtacgagttcatctatttcctcttgagacacgtaatcggagtttgcttcctgcaattttttctgagttgccggatcatctcttaggtcacttttggtgcctaccaatagaattggatacttccctaatttagtataaagagaggtaccttcaatattggaagtctgcttcagttcaggtagccatttttctgtgacattggcaaaactagcatgttcgcttactgagaaacatattaaaaaaatatctgtttggggataacataacggtcttaaacgatcgtaatcttcctgtcctgcagtgtcccataaattgattttatatagttttctgtccgtacttggtgaagaactggcagatgaaagtgaacctcttttatcattaccattgtcaagctctagggggctactcgcagttccgttcgggatagctatcgtagtagaataattatcaaaaaccgttggaacatagtctgttgggaacgaattggtagtatatgatattagaagtgacgttttacctactgcaccatcaccaattatcacacatttaatagacctcatcagacttattagtatactatattgtatttaataaatatttcggcgtgtgctttgtgggtgccacctgtcttgtatttcctatccaactgaatattctggatattgtcttgtgcaatagaccggaaaaaaaaaagtgaatgttccaacgctttggaatacaatgatgggtcaaggatcgtgcttttgttcgttggtggatcggccgtacgtgtttagtgagggtactatttaaacttactttaaatagcaaaataggaaaagctacgagaaactgaaaagtaaaaaaaaaaaaaaaaaataaaaaaaaaagaaaaaaaaaggagaaacatgattgccagtactcgcaagaactaagatagagagaaaaaggacgatatatcaagaaataaaagggaaggtaattcaagtaagcactgcttagctgtctgcataggagccttctgcaattactcatctcatcgtattcgtcataacccgttacgtaactgatttgaccaagaagcgtaatgaaaattttgagcggacgccgaaacgttgttttttttttgctttagtccagataataaccttttataattttctttttagggaggaagaccggtctaagctcttagaggttctcgcatacccaagtaaaagctaagaccgaagcaaacacgcaggataattttccggtttactctcactgcagctttagtatagatgcagatctggtattgagagaggggggccggaacgaaaagattcaggggagagaaaggcccgggcgtcggggaacaaaaccacttttgcacaccttaattttttagctactctgtttctccgggcttgtatggcacataaataaaattctgctactttccattatctggtcatcacttaccgatgtggagagccttgcccttgaaaaataagataagacctccgattagggtatttgaaattaaccgctgtagaatgaaataaggacgcttgtttgacattttttagttgctttctctatctaccaccatttgcatcttgatttatgtcttgtttgaggagatttcggataaatattcttcgaggggaaaatgtcgtaaaaataaaaacaataaagaaacaaaacgattaaaagaaaaactcaaccatcctcaaaagtcctcctcttttttttcacgtgctgcgctgatgtaagcagcaggacatggcaggaagaaaatcggagaattgtggccgcgacacctgacaaacaatcctcaggcaaatgtaaaattgtacatgaaaggctgcgtagtcaatgtcttagaaggccggcccgcatgatccagaagcagaccataaaaaaaataaaaattcgcggtctggcagcaggcataagatgcatagcgttatcctaaatgacatcacgatgataaatcctccgccgcatgatgcttttgatttgcctaagggcctgccatcgtgctggctcaaactattgagggtcaacataccttgaaaatccaagtaaaaggatggatatcgttatactaaaagcaacacagaaaaggtccacgtcagttccacacaataacatttacgtagtgttcacgcgaagcagttacatctcaactaacataattgctggtgagcctacaacactgcatgcgtaaacgtcaacgggattacgttagtatttttggccgccggtaaattctcttgtttttttttcttgatttcacttcttttcatgttcctttggaataatctaattcctcatgattaaatgagactgttttttgtttccgtaacatccatacctttcctgtataatattcttgctgtaaagtttgttttttttatgaaaaaaacattttcttttcttgagatgaggcgccgcgagcctttctcccatgggcagtggtaaattttccaaatcaatgcagctctttgaaatacaacagcatttttcatacattttaagcaatttctagtttgtagatattgttagattagtttttgaacattgttttgataactgaaaataaaacagcaaacaaactacaaaaatggtcgctttaatctctaagaaaagaaagctagtcgctgacggtgtcttctacgctgaattgaacgaattcttcaccagagaattagctgaagaaggttactccggtgttgaagtccgtgtcactccaaccaagaccgaagttatcatcagagctaccagaactcaagatgttttgggtgaaaacggtagaagaatcaacgaattaactttgttggttcaaaagagattcaagtacgctccaggtactattgtcttatatgctgaaagagttcaagaccgtggtttgtccgctgtcgctcaagctgaatctatgaaattcaaattgttgaacggtttggctatcagaagagctgcttacggtgtcgtcagatacgttatggaatctggtgctaagggttgtgaagttgttgtttccggtaaactaagagctgccagagctaaggctatgaaatttgctgacggtttcttgattcactctggtcaaccagtcaacgacttcattgacactgctactagacacgtcttgatgagacaaggtgttttgggtatcaaggttaagattatgagagacccagctaagagcagaactggtccaaaggctttgccagatgctgtcaccatcattgaaccaaaagaagaagaaccaattcttgctccatctgtcaaggactacagaccagctgaagaaactgaagctcaagctgaaccagttgaagcttagatttaattattaaatacataaataaactataagtacaataatttcttctattctagtgcacttaattgttgcggtttcttgcatattgccgtgtttagtcaggagggtgcacgttgaagcagtgcgttgaaactagttgttatttacagaatcacaatattatataatcaaaagaaaagttttgtacaacacaactgtgaatataggttaagaagtgagtagcagttcatctttctcagcttacaggacgatttctcggatatgaatgagttcgctatcgttttcaccacttgtatacgccgcctgtaacacccctaatgggcttatctcccaactgtacccatggcgctcttttttgctcttttaaatgtgcttcataagcaagtcttcgtttcgtaacactctttgttctcagaatacatctgacatgtatgtaaggatgacttatgattccgattcttgtccttgccttgaattcaacacgttttctccaaaacccgtcactccctgtccaaatctgagagatatataagtcctctggtttcaaacctaatttttggccatcttttacacctttttgaagtagttctgctacttcgcgagcaattttcttattagaaaagtgacactgagatatagctttcataacgtcgaggcctcccaataacctcaacaaaagtgtagcctttttcatcgacgatttaattctatatgactgagcatatacggaaggttctagtacttcaatttctctttttgtgaactttagcttgtaacgttcgctagaatttggtaactttacaatagtatctttcttgtaaaacccaccattaattttacaattagcttcatatatttcccttttcaaaggagataataagctctgtgatgctaattgttccggttgctgcaacgatatgatatgttgctgtagtagtttatcgttttctatggttattgaatccctattaacttcaggagcctctccagaagaatcagaagcaatcgctaacctattagagaagctgcctgcatcttcatcccccctgttttttccttcctttggtttattttctgtaatgcttccgaatagtgatcctcctgaattattaagacttattggcgttacatgaatccaacgtctacttacagaagaaagtagagccctagaaatgacaccgacctgagatattcttgccgtgtggaagttcattttctttaataaaaaagatagggtgaggtgaggttctctgacttgctatgcggctcctaatggcgtatgttaaaatgccttccagattggatagttgacttttattcaaaatcccgagtacagtgaaggcttagttaccccgcccacagaagattaatagaatatcatgagtactgttcaagcagcaagcaggagaaaagactgaaagagtttcgtataatttagtatttatttatttaggagaactaaaatattttctttatacacaaagaacaaagttttctttttttttcattgcagaatggtatcattgttttttatgccttttaaaaggccttgtcgttcttcactattggcaataaagatgtttttatgatttttaatagtagtgttattcagcaagagctgattttgcttaattagtaaacatcatactaatagactgaagtcatcgtcatataatttccctcaagaacccttgtgaattgttctgaactgtatttctctcatcatgagagatgtcattatctaaaccacgtccgagtcgtatcgaatttgaagataaagtagaaaagccaccttgagtagatgaacccaatgacgaatatgtaaatgaagagccataggaaaatctgttttcctggtccatgaaattactccgcatattttgaaaggagccattcattgcggtaacattccttggtggtggcactggaggaggatttcctcttgccttaaaattgaattcgttgctgaacggattattagcagaagcagtctcggtgtttcgttgctgtgatcccgagtcttgagcttgaagtgacgcctcttttgcttgggcagttgttgggaatcccgttctgcgcccaatctcgtgacagaaggaatcgttttccttgaaatgcctctttgccttcctttttctaaccagcatgaaccaaactactagtacacatataagaataccaccgacgcttcctaccacacttccaacaatggtaccagtatttgtctttgaagtgccttggtttttgttattatccaaactgccatcaagccagtgctgatagaaagacatgtcagctgtgatcgtcgaagatggagcggaaaatgaggttacctcactttttgcaactgctatggtcgtaggtaatcccgtcacgaacgttgtagaggagtcagtaatatcatatgtttgggtatagaaataataaatagtttttgaatcttcggagcttgaaatggctaccgtattgaagacctgactggatgttggtatgggagacgtagaaatcgtactagtgctgggtgtttgagtggtgggtggtatactgctgctagtagtagattgtaaggactgaaaagtatacgtgcttgagtaagcacttgttgtatcatctgatgatgatgatgatgaaggacggtttgaaggtactttactgctggatgagctaacagaacttgacgttggcacggaaatcgtgcttatggaaactgtcgaagatgaagctgatggactgagtttcgatgatttgcttatggttgaaaaatcgttcgtcgatgaaagcgatgaactgtaaaacgatgtggaagtattccgactggaacttgggcatgtggtatctttatttgatatcgtagaaggagaagaaattgttgagaaccaactagaagagagttctgaagtggtactaatttgaaatgaagttgcagatatggaagacaagtatgtgtaactaggggatattacggtgggtgttgatggtgagaaaatagaagatctgctgtcgaacgaaaacaatttagtgtctgaatatgatgaagatagtgataatgacaacgaggacgataccagtaacgaagatggtgatgataacgacgaccatgatgatgacagcgatgtagctgatgacgataacgttggtgttgttgatgttaacgatgaccattccgacgttattgacgacgatgatgacattggtgacgtcgatgagaaaatggacatggatggtgtaattattgagtatgaggaggtagctgggtcatattgggaactatacgtatcttgctcgctcgatgaactgctgtcggtagatgatactaaagtacttgtcgaagatacatcaatggatgtatgcaaagtctcatcatatgttaagcttgtagaataatatgtaggagtagctgtactagacacgggcggtaatgaggtcagacttccttgttggggtactaaagttgaagtagatgcgaagacaacatccgttgatcgtgaattcagactgctacttggttcactgaatgacagggatatcgtatcagattctccaagggtggtccttccgatggtactattggagttcatacgatggccaaaataattactctatccagcttttcttttagatttccttcagatatcgacggatggggattgaaatactaaatgtgtgtcttaagcgaaagtgtgccaacaaccagtccaaaaaacggatcagtagtgtttcggtacctggtgagtagtttaggattttatgagtgtacggcgattatcagtgtattactaatatgcgaaccgctcctaaagatcttgtttacctcatttctttcttcttttttttttttttttccgtgcgttctccccgtgccttgataagcaataatggaaaaaataaaaatagcagcaattggttatacaatgtatatataaaacatgaatgattgaataatttacaagcgaaataatcgcattatatacgtggcacctacagtcagttcacgctgattagtcaaacttcactttcttaccttgtgatgggacaatagctgcagaacctctctgagcagtggctaaagctacactgctcttagttcggttattggaatctacaggtggacgtctgttggcgttggaccgcttgtattcgggtttgctgccgttatcctgtcccgcacgatcgtatcctttgttgttagagatatcaaatgatgaggaattgtttctggatacattttcaaccttcttacgaacttgtcttttacttctatcttcaccgtattccattcgcaatggccttccggcaatttttctacaacttttatcctttaattcattagtagatccttcttcattcttgaagtcgataaatgcgaatcctttacatttaccactatcttcgaatgttgccatgcggattttcacgatatcaccacaatgttggaagtgttttcttaacagatcatctgtgacatcgaatgacaaattaccgacaaatagaatccttgacggtggatttttggacatggcaactaaatcgtccttgtctggcctacctgaataattttcggagtccttgattagcatattccttccgtttaaatgagattcagataattctaagaccgctttcatctgctcgacgttcttgaaaaacatgtagcaaaatcccttatttttcatggcgttagagttcttggcagcaacacgaggcatggataacctggttatgtcttgttcggtgactctgctcttttcatcttcgttgtcttttgttttagcaataaaaaatcttactaaatcgtcctttgtggtgtcgaaggataagttaccaatccaaacaccatatttattttcatctttcttcttcttttttacaacctcgccagattcatctcctgttggagtgttgattgtagattcttcaccctgggcgtctttctcagaagcaccagactttttcttttcagcatcttctttgtattcctcgattgacttagggtcgatattgtacttcgcattcaactcctctagagtaactttacctcttctcaagagacgtttctgtttttttgataggggaatggagcttttcaggtcaatctcaatttcatcttcagcttttctcttttttgttggatcgagtaaagccttcttgacttgttcctcgttatccttttttgtaacagcatcttctttcgacagttctgtttctgacattctatctcaaattatagaaagttgttgggtttaggtaatgttctgtggggaaaaggatttctctttgttgtatggttaaatttatcatctatgctcatcgcaattttttctttcagactgaaaaatttcaggtttttggatttcaacgggaaacgtgactcctacagaattttctgagcaaaggcgtacaagcgaaatacaaagacaagcatgtgctttcggcaaaagtgcgatcctacatcagagtttacatacaacatggtattgttattaatacataattaggttttacatagttaggtatggcgagtacgtcatatatttaggtattctcctgattgttttcacttcaaaagctgggccaactttttaaagaaccctccattcttagcagggttcttttggacacctttatttggtgtttctttcgtgcccttaggtttcgaaggtctagtagctttcttagcttcgattttttttgcggcagcggtaggagcgccctgtttcgtctcgtaagtttgagtctcagtcgcaaccttgccggttggtttcacagaagtctctttagcatggcttgtaattgagcttacaggtactttttcttccggtttttcaaatttagcggatttacttaatggttccttattttgatcttctgaagcttcagcgtctgcacttgtactggtgtccttaccgccgcctttatcttcgtcctcttcctcttcttccttttcaagatcttcggccgatagttcatataatctagactcagaagattgcgtcttacccaaaccgtccgtaacatatccttcactcttaactagattaactttggggtgattctcttcatacggcttgattgctttttcctcgtttacaccaacattattctcaattatcgttgtagtaccgcttaagccatccgcattcttgcccgttttgttcacctgctgggtttcatcctcgctatcgggcaattcaaccacttcttgggaaaatatcgacctttctccggtttgtttatttgtcttgatcactctcttgatcttgaactttcttaatttttttgcacgtttttcagcttctggttcgataagaggggcattctttgaaacagctaatccggcactttcaggtaccagcgtgctagagccattttcgcgttgctttattacgtcttcctcggtaataaagttgttttccactccctcgtcgatgttcaccttgtagtctttgcttggcagccattggccatcaacaataaacttgaaataaaacttgctgctagggctatcaaacgttactggcagcgttatttcgaaggcgccactggggtccttcaccatcggcaaagtacctttccagtcgtcgaacgtgcctgtcagaataattgcttcgggtcctttgggccatttgaacgtaaattgaggtaagctcgattgcattctagaaacactttccctttaatattatcttataatgcttagaaagttaaataccatcaagagaaagaaaattaggtaatacagaggacagaaggacagaagtcgtttctatattacataaaaatcggccaccttttatttttttaaaccacaagagagggggagaatgatggatgtaaaaccttaaccatgtcaatgcaagggctcccgccccaaaagttcctatcgggccccttcgcttcgctgccccagatatttgcggaaaaggccagcctcgcagtatttcaccaatgcccttactttgatagtatgtattttgactactttttttcatttttatcgcttctttttactttgtgcggtgtaaaccctacacaaaatagggctttcatttagtatttacatttgcacaaaagtagagaagatacgtaatagtcattgaaagcatcgacatttttggtgcttgctgacaaattcacggtgacaaagtgagctagaatattgcttatcgataatcagtgtgttatagcagcgttttaatctgtttttcctttctttagtttctagcgttataacttatgacttctaagccgtctactagaaatgattatttaccaagggaaactcacaatggcgaatatactggtgattctcccgaatggcagttgcagattaatatcacaaacaaaataggtggtataaatggagatatttggttgtcaagggacggaaggagtgttaaatggtgtattgaagaccagtgcttacgtcagtttacttataatcaaaagatcatcaaagctgggtacattgattttgaaaagacaccagattgttttgtggtagttctctctgatattgcgcatgtatatatgttgaaaaatgggggttctacgactgtatgtttcccattccagataggtaatgcattctggtatgcaaatggagtaattttagagagagagacttcagcgtccttcatggatggtggctacgatttaaaacccattgagttcgatttaaaacataaatacatcactttgacggatccgatggcgcctttcggcttgatttcgatcacaaatacctttaaaggcggtataaatagcgcttcaggtaacaaaacggatatcctgcaagactttcagctcgtgctcttcccgagtgacaaggacaagtgtatagctgtttttttagatcgaaattccaaagtgttgcgattttattacagtagaattctatcatcagatcagtcacggaagggagagctaacaatttcctcgaccaaaaaaacaggtttggacgcagcaggcaatagccaaaagagtggcgggattagcaaagatttgcgtaagttttcacatttgacgcgccggtcgacgtctataaactctaactctcatgatttcaatgcagccgaaagagtacttagtggcaatgttggcaacgcttcaggcagaacagatattttcgctttaccttcttcttgttcaagaaggagcttatctgcgaccctagatagaatggggaacaatattgccccgaccaatagagctgcaccttctggattttttgactcgtcatcagcaaatactgctactcactctaatataacgcctgtatcacaaccaatgcaacagcaacagcaagaatatttgaaccaaacagcgacctcttctaaggatattgttttgacggaaatatcgtctttgaaattaccggatgatatcatttttacttcacgacgcttgagctctattttaagtaaattaaagttcctatcgttgagatttgaacgtcgagaaggacttttaatatttcatgagcccacacatttctgcaaaatctggttgattgatcttttacccgatgttctggattctattccattcaaaatatacgggaactctccgcaaaacatgatcagactagagaacttaaagcttaaggaaccctcaagaatacaagctatgtatattcatgaactccttgaaagttgcctgattttggtgtcggagggacagaataaggaagaatacaaagcatgtctatatgaccccttcgttaaaattacatccccttccaaaaatatctccgaagagctcactaaacaaaattctcttccttccttacagaaactattcccttatcccgagactagtttcaccaaactgtgcttcgaagccgtcaagtatattacttctcctgcattcaatatttcatttatatttctatggcaatctgcatattcgatacttctttcaagggctaacgacgacgtagttgggggtttgaaaatggagcacgatgctttttcactggttctttcattgctgattttaccgatacctagctcctctgctcaagaataccaggagtacaaagaaatatatgaacgcgacctgtttcagcatttaaagcaggactcagaaataacaagctctgtgctaccaagaattgttattggattgcatttaataagggaggaatattccctgaatgtattgtgtcgaaatgagcatgcgttgttaggacagtttctaagattcgctactgccgcgatgggctggcctgatctgtggcaatcttactatgtaccgaaaatggattcagaatcgaaaactttcctacatccaagggaacaaaattccactttttttcatcccttagatgaaccgccatcgattaccaagtcgttatacagcataactgaaaacagttcaataccattatgtccgttcattagtttctcgagacttgttgcaaccgatacacaggtcgaattacgcattactccaagaagtttcaaaatcttgggcttgtatgaactcgtacactctccaaattttttaccggattatgttttaggcatcctttccagctttaaagtggataaagacgagttacaaacatatcccttaggcattttggtgcctttacaaaacattttaaaaattctggaagataagctatctgaagtaagagacaacttggagttattagatagggccgatttacaaaggtgtagtgccattatcaatagtataagaagtgattctaaagaagttctcaaaagaggccaaagagatagttatatgttatgcaaagtgccactcgccaagaacagaagctctttgtctaagaagcccagtgacatatattcaatattatccgagattgtgaaaagtgcaagtcaagttccactggatggatcagctatgaggatgtcgaatattcaggatgatgaagatattgatgaaggtcgatctctcaaattaaatgcaggactgattttttcagaagataaaagatttactcatgttgtatcactattagcttattacaggcccacaaaaactcaattttttaccaccaagacagaatatgcccagatactagctcaaaagaaatatttcgctaaaatcatggctttgaggacatgtacaaatggtgttggctggggtgcagtggcatatgcaacagaaaaaccaatatctacccaaaaatgggtcattcaacccctcaacttaatttccgtgtttcctgatgacacaaagataactgtgaaagctccagaagatatagcacacgatattgtggagtgggggcaatttcatgccggtgttagctccggcctccgtatctcaaagaaggcaactggaattacaggtagttggattgcatttaataagccaaaagaactagatgcttatcacggtggtttccttctcggactgggacttaatgggcatttgaagaatttagaggaatggcatatatacaattatctaagccccagaaatactcacataagtattgggttacttttgggaatgagttcaagtatgaaaggtagtatggactctaaactaatcaaagttattagtgtacacctagtggcctttcttccaagcggatctagcgatttgaatatagatctaaaactacaaactgctggtattatagggatgggtatgttatatttaaactcaaggcataaacgaatgagcgattcaatttttgcccagctggtgtcactgctcaatgtaaatgatgaaatggttgctgacgaagaatatcgattagcagcgggtatatcgctgggcctcataaacctaggggctggtcagacgaaactgagaaagtgggattcatcattgttgggcttgggggacgatcttccggaagatgtttatgactctagtgatgttgaacaaaatgtaatgtatgaagacctgactacgaagttattagagatcgtcacaagcacatatgatgtagaaaacgattggataccagagaattcgcaaattggcgcagtaattgcaatcatgtttttatttttgaagtcaaacaattttggaatttccaacatgcttaaagttgacttaaaggaaatattaaaagcaaatattaacacccgccctgaattattaatgtaccgagaatgggcatccaatatgattttatgggaatttataggcgacgacctatcgttcatcatgaaagatgttgatattggagtaaaatttagtgaacttaataccgatttgcttcctatatattacactatggcgggtaggatcttagccatgggtattagatttgcctctactggaaatttgaaaattcggaatatactgctttctctcgttgataagtttctgcctctttatcagtacccaggaaagcagaatctagactttaggttgacaatttctgttattaacgttttaactaatgtcatcgttgtttctttgagcatggttatgtgtgccagtggcgatttagaagttttgaggagggtcaaatatcttcatgaagttgcatctggtccatattcagacttatttcaagaaattcctagttctaaaagtgatgtttcaggtgtaacacaggtgacttcaaacactaacacgcctggaaatagtgatcgtgaaagggttgatgagaccgctgcttctctcgatgacgaaaggtcctcaaatggcagtgatattagtgatccaacagcatatctagaagacaaaaaggatatagatgaccattacggtaagtttatttcgacaaatcttgcactgggttttcttttccttgggtctggacaatacgctctcaatacttctactttagaatctatcgctttcttaagcatgtccgttttacccacatatacaactccacatcccttacaagaattgaagcatttctggagcattgctgtagagcctcgttgccttgttataaaggacatttccactggtgacgcagtaaacaacgttcctattgaattggtggtcgaggaagacgtcgaaaaagaagaagtaataagagagatatcaacaccttgcctgcttcctgatttctccaaaattaaatctattagggtaaaaatgcatggttactttccactggaagtaaatttcactaaggactactcagcttctgatttttttagtggcggtacaattatttatatacaaagaaaatccgaaagtgttttcgagaacaaagcctcttttaggaacgtagaagatattcatgtggcactcaaaagaaaggcagcagaatctaaaaattattcaagattaaacctaaaaaatgaacaaggaaataccacctcttcgcaactggttgaaagtttgggtattcaagatttgacaatggtggaactcgatactcttttgagtgcaggaaataatacagcattaacggattcagaatcttataatttaggtttgctgtgttcagataaaaacagtggagatattttggattgccaactcgaattgtggtacaaaagctttggaccacatgatgaataatgcaaaactcaagaatatttatttgggtatctaagactagctttaaaaggttccaaaactggggtaaggtgtaatctttgtgtataacttggtttatgaaaggggtacatgacatggctaaaattcttcagacgaacatctttaatctaaagtttacatctaacaagtccaatctgaaaaatgtacagcgtataattttacatacctccaaaagaagaattaaatcaaagtgtgcagataatactatatacagcaaaataaatgctaactttacatatgattgctttcattttaaatcattctttccaattatgcctaatttctgtcccatcttaaccttatcaccaaccctaacatcgaacttaaattcagtgggagcttcaaaacaaagtacaacagtgctacccaattcaaagccacccatttcttcacccttaaccaaaggcatccctcccaatattttacttgcattctcatatactgcctggtagcaggtatgtggttccaagtgtttgtcgctctttgaatttgtcacaaattcttgatcaaaattcaacttgattgaaccaacatttgttgcaccaacaggagtcatgctaaaaaatccgtacttccaactacccaacaaagcaactctttcatttagaacgaaaagattagggaagttacgctggaaataaggtgccacggagaataaatcacctgggaaatggcggcgaaccttacaaacccagtcaactggagagtggaaatgatggtaatcaccgggagccaaataaatgacggcaaagaaaagttccgtatcatgaggctcagagcacgaaaacccattagagaagtagtttaaagaaagttgacttaaaagatgtatatttttggacacacttggtttgaactctcgaacagattgatcgccctcgtttttaaagttaagaagaggctgttcagtgtcttcggaacccgctaattgtattctatttaccctggcgaattctctatgcttttcctcatcagaagtcaaatctagactagatgcactcttagacatcaaggggtgggagtgagtgccaaggaattctttgatggaatatgtcattcccttgacttgttcgatttcgccagtttcagagttgattataccaacttgtaaaatctttccatcacttggagaagctataacgtcttcgccttgtgctactggacgtgtgcctggttttatgttacgatagaaaaattcggataaatttgcataatgtgtcaaatcaggatcttccatctcgtccaagttaactccaaaaaggaaagaatataacctgtaaccccatggtctaacccaaatgggtaacgtaagagaatttacttggccccataatcgagacatcgcattcagcggtaaagtagaatagcagaaaaagagccaattattgttaaatattttgatttttcttgtccttctcccttttttgccctctgtagcatcctcctctgtactatcattccttgacactagtaaaatggttcctagaacaatggtgaaactagttaaaacaacccatttcatggagacctgttttcttccgctatttgcggcagcagctttggcacgatccacaatctctccagaactgcgtcgttgctgaacgaaaagacgcgtggaaaactttctattccatagcaccgcagttctatttcttaattgcattcttgtagaaaactttacagcaggcatcctccccatgaggagcgtcctcccttgcgccaaggcgttcttaactggcataattgacatgctggctttgcttttccttcttcttcaaaaaataacgaccaagaaggatttgagcgatctgctaacaactggctgaagagtccttaaagcgctacgtacctctaggcgtctcttttgtgagtaagctgttttatattataggtgaagaacaaattttccacatgcttgtgcctgctttagatgtcccttgacctcgagatttgaaaaaacaccaaaaaggtgctggttaccctgcatgtgatatgtgattacatagcgtagcgtatacagaagcacaattggtcgtatatgtgccaagcttgtaggaaattagtaacgcataacgtgttatctgcgacaagcgtgaatgcgacagacattatgtttctctaaattcatatggtcccggccgattttcacattcgaagttcatgtcgacaatattgtcattattctgcaatagctcacagtgaacacggtcaccaggctttaactcgcctacacctgcaggtgtaccagtcaaaatgatatcacccggttccagagatatcatggtagatatgtgttgcagtattttatggagtgggtgcaacatgaggttagtaccaccatcttgtctcaactgtccgttaacagagcacttgactctgaaaatatcctgtaagtttgatttgtaggatgagaacttctcgcgggagactatagcagagattggcatgaaggtgtcaaaacccttgcttatagtccaaggtagccccttctttttggcttcatcttggacatttcttgctgtaagatccaatgctagagctacaccactaatagagtcatagacttcttcgggtttcatcttagtgacattggacaaatgtttgctcacaatcaatgccaactcaatttcgtgatgaaccttcacaccgcgtgggataaaaatgggcccggggttagttccgtcttcatttaaaccattgaaagtcgagtttgcaggtctagtggtcttgaccaatgatgaagacaatggtgtcacaatactcgaggttggttttaggaaaaaaaacggttgttttggagttgaattgttcagctctttgatatgcgctgcgtaattacgcccaatgcatataatttttctagctgccttcaaataattgtagctcataacgttttggcaatttcctgagtctttactcgatagctttcagaatatttctatataggaagttctggctgaaacgtttttccttatcagttagagaacggtgaccatctcttgaaagcgaacaaaaaaacgtgaggctaaggaagctatttaggaaaatagacgaaaaaggaatggcaaaagaaggaatggccctttcaaaataggtataagcagcacagcttgatacatgctagggttgcagcagtataactgtactctctttatgagcgtagtgaaaagacggtgaaattataacggtatgctctatgaagaataaatgctgtaggaaaatttacgataataaagcctttattgttgttgatcaacaaaaggaggcttaagcaattgataaacttctgaaaagaagaaccctattaaagtttatatcaaatatagaaaaaaaaatcttgaagttacataaatacagaaaaaagcgggagaataaaagggatttcctcttaaaaggaactttatagtggaatatttgcaatgagaaaagcggacaggttgaagagtacgaaagcatcagatagaagactatttaagaaccccgtcgctatctcgtcaattattgtgaggtagagtggatagtacatcatgcttattagtatcatgggtatcggaatttgcatttattaccaatggattagtaacagagtagcatgaattgattatattctgtgcactatttcccacattattagtagttgtgttacttttgctgatatttgctccagagttcagtgagtattttttatctagaattattggtcttgaattaacggaaggatagcccgcattttcgcttttgacaacgttagtgtccttattgaagctgtcttcttggccatccatgtcgtcccttgggtttttgcctccccttcggtaaaaattcgtttcacatatcaattgcttcatgtttgataatactgacattgcacttgaataatcactccttgaaatgctactctctaacaatgctattaaagatgtagatggtggtgatgatgatgacggagttgaaacattcacattgaattgggaattcgaggagcttgagggtattatgccgcatagcttcccaatgacctgagttagatcgtcatattcagattcatagaattgtagatcattttcaattttcttgatgtactctttctttctttttctaaatttagatgcagctactctatttctttctaaaaactcctttctttttctttcttgctcttcattctcatcaagtgttacgttgtttgaaattttattattttcaacatcatctttttgtgctggtgcagtcgtaactgctgagttttttcttgatatggaattttttcttgaagccttagaagtagaacttgtgctagacatccttctctttctttttcgtgttttgttattgaactggtcattgttctcaatttgagtcgttaaattttcattctccttgtgattatgagcggagtgctcgatggcattgaactctgccggattatccattttgacagccgctttcgttgaagtatttggggaaaaattggaattactgatgctgttgttgacggtaccatctgtggtatttgttgtaggtgttgatttgaatactggattagccaaaactccagtagatggtaagtttagcagagaactcaatcccggcgtaagtggtgtaccatttacagttgggtgcattatattaacatgagggtggttttcaatacttccattcactgtgacacttttgttgacatttttgctacctgttatagtatttttattaattgacggcaatacgggataattgtaagattgcgtaagaataccgggtgtcaacccggtcctgatattggactcattaggtgtcaacccagatttggacaagtttaataaaaagccaggcatttgtgaatcattcgtggggaagccgttaccagaattacttgtggtcacgttcgagtttcgtggctggcgtataagtgaagtccctgaaggagaagagctgtttggatacagagatccggaggtagaagaaacgcctattgcactagggtttgaattagagactgaaacagaatgtgaattctgactgggattcgtagttgaatttgcctgatataaaatagagggagaaaggagtagaggtggtaatcttttcgacccaccaggtgtgagaataggcggagatattatagtaggtctttgttggcctggtaaaaaactaggtgagtctttttttacgtcattatgattactattatctgtaacggttgaattcccattttcttctggaatactgttcaaactatgagtggaacgttgggaatgttgtgttatcgttgaggtagaattgtttcgtgaaagctcttttggtagagacggatgggagatcgtgcctggaagtgacaaagccttcttggaagaggcgaagctttgttcaaaaggattgggttctaaatcgaaagttgaaacagtacttggttgtctcgagcgttcctcgcttgacataatgattaagcagggtctagagactgggcaggtgtatttggaatgcagaaattgaaatgaaaagaatgaaataaaaataaaaatccacgaattgattaaggaacttatcaaataatagagatcggtaaaaagataggaatctaataagtggaaaactcacttgaataataaaagagtttttctcgataagaaaacacaattcacttttacgttgaacccctttggtagtaacttttctgagcttaaaaccactcctgagcgttggcaatgtagcaccaaattattgtgtttctggagaacaaattagtctcacgtatcagtaaccaaacttggtccttttaactggaaaaatgtgcagtttgtttcgaaaaccatcaccgtatgactgaattcattctattcagcccagttaattttcgtgatttttcccttcgattctacttttttccctctgcgacaaagttagcagggttatcgctagcgcggttaagtacgacttggtttatgaaagttcttagagaaaagaagacacaacgccattgaaattgaattctgggtactgttattgttccgtttcatgttattacaatataattgactatctgaacattttgtcttcatttttttttttttttattatcgttttgtttacgtttaggcgaaatactcacctctttactattaaaataatagaatttatcagaaaaaaagtcagcaacatcaaaaataacagatggatggctctaggataaaggattcttattctcttacgattgtctatgttcttttggtatttattttaactttatatatctgtcttaatttataaatatttataacaacccttggcgtaatgtaatcatttagttccaatccaaaattggccattttcgccacgatcaatttgctttctcagatgtctacttaataacactccgacctcatatttctccttcgttttcttgtcaagatattcttgaagcttcactacggctctatgtagtctctttccgtcttccatagataaagaaccctgtgcattcatcttgtttagatagtcaatttccttttgtaacttaatgcatttcatggataaataatcatgtcttttttccagcttggcaatactgcccagctcagacgctgatgtgataggagaggagactggcgaatcatacttatttagtgaagatttacgacttccgtttcttgaattggaattgctgctcaccgagataactctgaacggatttgtagggcgtcgtgtctcgaaattcgccatttttttctgtccatcaccatctgaattaaagtgatttatattggtaccatcttctttagaattctttttagggataaaaattttagtttgagaatctaagggagtgcttcctccagagcgattgggacaattctctgaattatcgtcatggggtgtttgatcagctaaacggctgctctcatggttgtattcattgtcacctcctacaactatggtttgcggttgtatatctagatccttattagcggaagaaaatttgtctaatacaagttcagcgtctaacttgttctcaccgcccaaggtgttattctggggcatgggtgatttgaaagattcaatctcactgttttcctctgttcccttatctactcgcccctcttcaacatccgatttttcatcctcccattcatcatcattattttcgataatttcaacatcagcttcacccctgttttgatctatattgactgtaccatcttctttgttctcagtgcaggagtcctttgccttttcatttccagcggaatttgcgacaaatgaattataggagtcaccaatagcaatggcggtgtgagttatctgctctttcgctataaaaggttgagtaaccgatagctgggatgggtcatccgtactcttattcgcttcattctcagtgggaatatggacctgtgcggttttgtgctcttcaacctgagctgaatctcctgggttactatccgctccatcattgccactaaaaagagccgtttctgccacctttacagcgtcgaccacacccgtatccttgacattatcttcgacagcttcgtcctccgcaggttcaactaattgtaaattttcgtcaatcatctggttcatctggttgatatctatctctatttgagaaagcctcttctttatcttgtcctggtccaagcccatcgtttctgttgttctatttcacactaacatagcatcaccataacagtaaatcaaattacaaaactattaatgatttttgtttattatgaagtttgaattttcagcgcaatatttatttcataacgcgtctaaaatggtctgggttctgggcatctctaaagcccttcactactagtgaagaagaagaacaagtaaggcttttggaaaagaaagagcatcaaattgaacgataggagaagtgctacatacatttgccaaagatccgcatggatagagtacgctctttgattggaaatcgccggggacgccgacataatcgccaacatcctccgtatcctcacagtgggtctccatccaccgtcaatctcttgggagctaatggttatggagacgaccaatctacaatatttgcacgagaaaatgaatctctggaaacctctgccaacgagggcgatgatagtgcggatgcagctactttgaatacagcggtatcagaaggctcaacaattggagacctacaaagacagggttatgttaacagagccccaagattcacgtcagaaagagccatgccattcgtttcggtgctactacaacgagggttttttgcattccccagtgaagaatctctccagctatttttacacaacaagaggaagctcgataacattgatccaaagaggggtctaggacttcccctatttcacgccatttctttaaacctggtcaagtcgcttttcagtgatcaaaatacaccggtaatgaggatatataaatacgttatgatagactcccaatgcgataaacctccattaaactcagaagtggtctctcgaataaacgaaaatgtctccatatataaatatgaattctgcactattctaaaaaaaatggaaagccataatttttcgagcagggtagagcacgattttatatttcatagaaaagatgaacctgatgttcatatccccatgattaattacaatcaaaggaaaaatgcggatacggcaattcatggattaaatcttcgttggtacgggacaactagtttagcttcaccttttggctcaaatagcatcaacctacttgtactcgatgatacgatggcatcctacatgaaccaacaaactattgaagagtttgattcttacagccgttcccgtcccacaagaccgctgggttatctcccagtatgggccagatacacagatgataaagttagtgtcataccgaaaaaaagaactttgagagtagctaccttgtacttacaagaaactgattcgtttgatgatggctctagtttaacatctaccaattatactgaaatgggctctaatatcattgaaaatgtgccgtgggatagtcagatacttacttgcatgtgcatgctattacatgaatatgaatcaagaaaggagaaacgccacaccgcatggggcagctcgaccacatatatgctaaatggaccggcaggattactgatgtaaacccatttgcatttacttgtgttttttcctgttactatttagtcataataccgctaagaagcatataaatattcaaagagaaatattgtcgtacaccattaatttttcaataactcttaaatacgtttagaatgtcacaagttttcctcacaagttttcctctattatgtaatgttccctatactactttattcctacagtaataatgttgactatctattccttttcctactatcttgttcatctcttggtggattcggcatacgattgtaaccaaacgtacgattataccactttatcatgttacgtggtggttcaccaaacaccatgtagtactcgcaaaataaacacatgggacttgattcgttaactaggacagagaaatctggaacacggttttccgttctggaaatatattcaaaatcatgataatagtagtttcgtagtttggataagttttcataatgatgatgcgggcaacaacttttatggtctctagattcgtcataaaagtcatgtcgccttacatgcccattctttttcgagttctttgacctgctgtgctttctagaagatatggaatgttgaccgtctccatgcaaacgagctgcgtcaacggtatcatgatcgatatctgtgacttcttctgcaacatctaaatcctctacatttgttacagttcgcaaccccccctgttcttcacttccaaaccctcccggtaacaccgattctatcatttgagaaatcttttcccctataccatccggtgtatccagttcttggctctcataatcgaaaattatttcggcttcttcgccatccaagttaagttctgagtctttaagatcatcatctaaaatattttgcaagtcctcctctattatgaagtctgcactatttctagaagctatttggcctattttactttcaaaggtttccttttcctctgcggaatcaatgtggtatgcactttggccatctattttcgcaagttcatcttccaaactcaacgagtccatcttaggaagagcatctttgagctcttctaaccgtgcatttgataaagcttttcctccatttcttataacgaattgcattgcatgaggagcgttttgaaaagcttgtctgtcttgaagctgattggaaagaattttagtcagcgctttcacaccttcttgcatcataacgtttattggcataggtccatcctctgaaagtacctccacagatgcattagtcgttccactagattggtttgtaggtgtcattttcttgatgatatggcatgaaaatagaagagaagagaatatgattaaagctataaattcgtcgtaagaagcacgatatcagtaaatatggataacaaattaccaaatatttagcaaagaaattcctattcagggtatatgcaaaaagtgcaatctgtagttcttgctgtagctctcgcttattttgccattctcatcgtccagatcatctcaactttcttgtcccatcgctaaaacattcactcgcgcgagagtatgtagtatatcatagaatacgtaagactggaaatgcttgaaaactgtgctatttcatctcatattcaagtgaatatacatacatacatacatatatttatatatattttcaactagtgaaaactatctatattagtctatgattcatataaaccctaaaaaaccttaattctttttcaaagtacgttgtttttcggcattttcgacaactttttcttcaatgaatagacctttccttcttctgatggcattcatatgcttacgggcaatattctctctatctgctgtatcacctagttcctccaattcttcttctgtggttgggacccaaaatggatctaaatcgatacactcgaatccggaaaataccaattgaggttgtgctgcaccagatgttcgtttacgaatatcttcacttaaaccgaatgcttccacaacgggcacatgtgcctcaatttgaaaaaacggtgtaccttctttcatttcttcagaaatgattttaccatgcctctgtagaataacggcatacacttttccaagtacatcgacagaggtttgaatatcacatgagtaaattgcccacataattcttggggaccagtctaaaaaggcctcatgtatagcgtcccttgtagaagttatcaacctccctgataagtccacaatatgttgttggtagcgcggatcttcaatagattcaatttcgtcttgtgacatcttatgtacgctttcaacaagaacacacattccctgtacgggctcatttgccagaggtccttcgctaacagccagttggaagccatttttgatggaatctgaatactcaaaggctgctggagtaccttcaaataggcttccaagaagattatcctgcgacagcaaaatgttgcacccaactctacttggcccaaaacctgctaactttactttaaacccacttaatagttctctgctcttctcctcctgatttatgacctcttcaaaagcaacgagtaaagactttttgtctagaaaagaacttccagttgattctatgacgggatccatgcttgaagtggacgtcttcaaaatgtttttaatgctattttgatgttgagataaaaagtctgtaactttaccgcttaatgggaacgttctgaatgtaatcttgtactggctcaatagtagttcatgaacaccccttcccagctgtgaattctgcggtggattcatatctgaggctgataaaaatgtttccctatatggaatagccggttcagaatgtgtaatttctattcctgcaaatctctctgttaaatcttttaggcatctttctaaatgtaattcaccggccgtacacagaatgtgttcaccagtattttcaacgtatgtgtgcacgcaaggatctgcttgatccaacaactttaatcctcgtaccaacttgctcatttccacaggattggctggctccacagcaacacgaacgattggcgtaaaatggaaattgacgcccgctagattgacgccttgtacgcccttctctatcaacgtaccactctttaaaactttaccggccagaccacgaataccgactatatttcctgatggacaaacgtccaaaggaaccaattccttacccataaacaaatataaatgcgtaataatcgcagtttcaatatgctcctctggacattttggatcatattttggacccaataccgaaatctcctgaccaactcttagtgtgccactgtatattcttgcaaatgctaccaagcattcttccttttcgtcaaaaatatcatctacttcatcgttcacatcctctgaaatttgcttaatactctccaaaagtggatcttcttcctcatattcaaacattgaacttagagggtcatttggatctatgtcagttggtacaaaatctaggccgaagttatcttgactatctgaatcatcctccccctcatattcaaattctaaatccaaggcggaagaaggctctgaaacaacacagaaaacatcattatttcttgaaggttttggctttgtctgttctcctacttcgggggtcataacggtatcttttgctcttttatataaatctgatgtatttttagaattgtcattcaaatccatcattgccatattttctaccataccagcatgttttgcagcattaagtgcttcctcacgtgcctttctacttctctccatcagctcatccgaagatgctatcctcttagattcaacaggtaattcttctctaggaattgaaagcatcttagatacgtatgcactaactggtccttctttatcacatgtcttcatggctttcagaagtcttggatccatggctgctgtgtcggattcggagaccaaaatagtgttcaaacgatcggtttgtgattccaaaggtgaaggtaatttttcaataactgttaacaatactgctgtgctgacgggtagccattgacccatgatagttcttaacaattgtttatcgtccttcgaccttagatcacgtgcaagtagcttaatatttaaagtttttgctattttttcgaccatttcagaatctctcgatgtgattatgttttgataaattttccatatattttcgaggattagcgatgtgaaaaggggtttcagggatcttcccttaaggcctttattgttaataattttttttgtcttgggatccatatagaaatcaccccataaaactttctgtaggttttcccttttagcgcctaatttttgttcgtaaaatttggccaattgaccgatgttgaaaccccaaccatcaattgcggaagcaaaaataacgttgttatcagtagggttaaagtaaatacccgaatcatccttttcaatatattccgcgttttcgttcttttctaattgctccctccaaaataaatcatccaattgtctctcgtttgcgaaaaaggacccgataactgagttgacttgttcaatgactttggacaagtgaatataagcttcttggggagttagttgtagttctgtgatcaatctatcaatcttattcaatactaaaatgggcttcagcttctccgtccaacattgtctcaacactgtgacggtttgcgagcataccccctctacgacatcaaccagtacgacagcaccatcacatagtcttgaagctgcactgacctcacttgaaaaatcaatgtgacctggggaatcaattaagtttactagatgctcgcttacaagaggctcatcggaaccttcttgtttacgcaataccctaaaatataaagagatagccgatgattccattgtgataccacgtagttgttcgtcaggcctggcatctaagaatcgaattttgccggcaagcctttgtgatataataccattcgaagccaaaagagaatctgaaagtgaagttttaccgtgatcaacatgagcaacaatacatatatttcttatacaggaagggtcattttgcagacgtttgtaagtctccgattccactctaggcatatttgcttatcgtgcttagaaaaataactgagtttggttattttataaactattttgataatcttgatgatgtacaaagattgtatttcgggtgcacctatctatcaatattcttggctcttaagttcccatttttcaaaatttcttttctcgtaggaaaaagaaaaaggaagcgatgagctgaaaattccactttacaatatatcgaatatccagtataccaaaactacatacaaacgaacacgtcattaaaagatgtctgataagcccgactcccaagtattttgtccaaattgcaatgaaagacttcaaaagtgtttagtacagcaaaattatgccattataatatgtcccagcttagtctgcggctacccattcaatcaaagagaagtactcgaaaatctaacgtatgtagacgataatgacgtcttaaaagttgcaaaaaaaagattatcttcacgaagcaaaccataaaatagttgcactattgctgttcattatctttcattatccctagtaacgccattgcagagtcaaatatgagcgataacaatataaagagcaataacatgatagttgaaattaacataaaagaagcgacataattaaaggtctcaaagagtgaagatcaagtatccggtttttacgaataatctactttctatgtgaaacccaaaaaagttcgtacaaggaaaactaaaaagtgtgtaataacttgtctagctttggcattaaaacttgtcaattattcatcaccaatatagactaatgcgttttggaacgccaaaccgcagtgacaaatagcaaatatgtagctgtcatatcggcatataataacagttttctaccaaatgctgtcctacattcagagatcttacatccttacatctaaagtaaaacctagacatttacttcgagttatactttttttttatttatctattttttctcttgcggacatttaacacctgaattccgcctaacgccaggactgatcctgccagggaagggagctttgtctagtgccaataggccggaccagtaggaaggttacagcagctggcccgcagagtgattgggtcacaggaaatagcgcaaccttctcttttgcccgggaaaggcggttcaatctaccttcgaagggctagtacatgagcgcgaaggaggcagataatagcaccattaagtggtccaaatgcatcttgaaatctaatccttaatagaggaaaacaacaattatcagtaaaaatgggtatgttataaccataattcctaatggtgaataaaatcaggaccaataaagaaaagctaatttgatttttattgtcaatgaaatttcataatcgtcatgaatgcataaacagacacacctagcaactgtataatctgcgcctaaaaagggcgtatacacaaaactaaacgatgcgcaataaaagttcagcagtcagcaatgaaaccgagatatgcagcaacagagtatcatatgcatggaggatcctttctgtttttctgataatatgctctgaaaaagctccaaacagcacagtagcctatttgtgaagctcaaaaaaggcttctatttccctcgctatcttcagattgtgcagtgatattctttgaggaaggaaacgtagaggggataagttggataactgttatttcttttcaatatgctagattttgcttaccaccttactgattttttctaataataaacttttttactaacattagtacgatgtctcatctatttcttctatttagttaacgttccaaagaccagaaagacctactgtaagggtaagacctgtcgtaagcacactcaacacaaggttactcaatacaaagctggtaaggcttccttgtttgcccaaggtaagagacgttatgaccgtaaacaatctggtttcggtggtcaaaccaagcctgttttccacaagaaagctaagactaccaagaaggttgttttgagattggaatgtgtcaaatgtaagaccagagcccaattgaccttgaagagatgcaagcacttcgaattgggtggtgaaaagaagcaaaagggtcaagctttgcaattctgaatctctttatgggtttcgcttttgtattttctttgctttaaaatctgatataattacatattattacaatataaaactttacgataattcctgcaactaatgatgcgttagtacggttcgggcgctctaggacgcgtgtcggtcgggtaaccatcattcttattcgacgaaaatgattagtttccagagaagcagttgcactccagtttgatctgcagtccagcgactatttttaacattcaaagatcatttttcgtttgaatagttgagcaaggtcatataaatttctatatcacacgaataagggttcagatattgctttattatcggcgaacactgatattaccacatagatatcgctctttttttgaaacgtaagcgtaaatttcagtataggtacacgtctgcgctgatccttctgtaatcctctgcagttttcgcaatgtataatagcagcaccaatcatcatgagggtgcacctacttcaggacatggctattatatgtcccaacaacaagaccaacagcatcaacaacaacaacaatacgccaacgaaatgaatccgtatcagcaaattcctagaccgcctgctgcaggatttagtagcaactacatgaaagagcaaggctctcatcaatcgttacaagagcatttacaacgtgagacaggtaaccttggcagcggttttacagacgttccagccctgaattatccagccacaccaccaccacataataattacgcagcttcaaatcagatgatcaataccccaccgccgtcgatgggtggtctttatagacataataataattcccagagcatggttcagaacggtaatgggagtgggaatgcacaattaccccaattatcaccgggccaatattctatagagtcagagtacaatcaaaatttaaatggcagttcttctagtagtccgttccaccaaccgcaaacgctacggagcaatgggtcatattcaagcgggttaaggagtgtgaaaagcttccagaggttacaacaagaacaggaaaatgtccaagttcagcaacaactttcccaagcacagcaacaaaattcccggcaacaacagcaacaacttcaataccagcagcagcaacaacaacaacaacaacagcaacatatgcaaatacaacaacaacaacagcagcaacaacagcagcagcaatcacaatctcccgttcagagcggctttaataatggtaccatatcaaactatatgtactttgaaagacgaccagatttgttgactaaaggaacgcaagataaagcagcagctgtaaagttgaagattgagaacttttaccaatcctctgttaaatacgccattgaaagaaatgaaagaagagtggagttagaaacagaactaacttctcataattggtcagaagaaaggaaatctaggcaattgagttctttgggtaaaaaagagtcacaatttttaaggctgcgtagaacgagattatcgttagaagatttccacactgtgaaagtcattggaaaaggggcatttggtgaagtcagactggttcagaagaaagacaccggaaaaatatatgcaatgaaaactttattaaaatccgaaatgtacaaaaaggaccaattagcacacgtcaaggctgaaagggatgttctggctggaagtgattctccatgggtggtttcgctatattactcattccaagatgctcaatacttatatttaatcatggaatttttgcccggtggtgatttgatgaccatgctaatcaggtggcaactatttacagaggatgttactagattttacatggctgagtgtattttggccatcgaaaccattcataaattaggattcattcacagagatattaaaccagataatattttgatcgatattagaggtcatataaaattatctgatttcgggttgtctacggggttccataaaactcacgactcaaactactataaaaagcttttgcaacaagatgaggcaactaatggtatttccaagccaggtacttacaatgcaaatacaaccgatactgcaaataaaaggcaaacaatggttgtggattctattagtctaacaatgtcaaacaggcaacaaattcagacatggagaaaatcacgtcgtttaatggcatattctaccgtaggtacaccagattatattgctcctgagatatttttataccaaggttatgggcaagagtgtgattggtggtcacttggagcaattatgtacgagtgtctgattggttggcctccattctgttccgaaactccacaggaaacgtacagaaaaatcatgaattttgagcaaactctacaatttcctgatgatattcatatctcttatgaagccgaagatctaatccgtcgactattaactcatgcagaccaaagacttggtagacatggtggtgcagatgaaataaaaagtcatccattttttcgcggtgttgattggaatacaatcagacaagtagaagcaccgtatataccaaagttgagctccatcaccgatactaggttcttcccaaccgatgagttggagaatgttccagattccccagctatggcacaagctgccaaacaaagggaacagatgacaaagcaaggtggaagtgcgccagtcaaggaagatttaccttttattggctacacttactccagatttgactatttgacaagaaaaaatgcgttgtagggacgcgttaaggacattcctctttattcaagtatttatctatggatgtagaacgcacattatgaataaataactgcacttttttcgggaaaaaaattaccaaaatagacatcagctttatcatatgtctccttgaagtatttgaacgaccacctttccgaagacaatgtacctagtaacctacaggctgcccttaatccatacatccacgcacaatagcacaatctcggtgatggctggtttttttaccttgaaaaacaagaaaaatggctgatgtagttgaaaaaggtaaaagagatggcagatcaggggacgattttgtagaggaagtatctatatatatcgaccatattgaaaaaaatatgaaataacatacacacgtgtaagaatatataatttttgttattaacacgtcgtaaaagagaaaagatcgtgctttcatcacgcgcttcctctcggcctttcgaactataaattataagatgatccagtcttacaatactgaatgaaactcagggaagacgatagcggaggttcgacaaccgatcactgtaaaacctacactttcaagttcattaatcgtcgcttgaaagatcgtcataaccaaatattgctagaaacaaaagcgttcgggataggtcaaaccatgatgaactagttccacacgcatatcttaaagcgtgctattttttaaaaagggcaaatttaggaatgtctgacggaatccctaatcatctttggcttttcccttcactcccttcttttaccgacgatggtttgaaggaaagagaaaaatgagcaataggaaaattcagtagtcgatttccatttcaattccctattgggtaatgtggcggcgagggctaaacattcggtatcattgattcaatgttctcacaatgttcaaattctcggatcgggtatccctaattgggatctctttccagaggaaggggccttgatgtgggattgaagacacatgagtttttttctcaccgtcgaaacttttgcttacccgtaaaacatcggccattcgttggtttattatgtgacttttttgtgacttttttttttgcgaagttttctcgtcatccgcggaagatccggcgggcgaaaaagtctctcacttttacccaatcggggcatgttatgtggacatgttatgtgtccaagagacacatgagcccaaaaagggtacactgtctaaatagtttaccctttacgaatcgaaacttctcgaagaaggggccgaaaattagcgcagaagttgacgaaagtttatacttttcctaatggagaggctcaggagctgaaaagggatatattcgtactctattgcatcttcaaactccgaagaatctcagtagggagtgaagccggcttctcgatgctacagttcaacatcgatactttgaagaaagaaagcgcctattatatctcttttaccctattagtaataattaggaaaaagggagaaaaaagtacctcactaaaaaaaccatcatctctgaaatataaaaagcttgatagagggtgacatttgctagaacttctgctgtgttctcttgggttattgctcttattgaatatcccttctatttctttcttgcttgtaaaaaatcagctcaaaaaacatctacaggattaatcgtcagttaagtaatacagtaatagaaaatgaagttccaagttgttttatctgcccttttggcatgttcatctgccgtcgtcgcaagcccaatcgaaaacctattcaaatacagggctgttaaggcatctcacagtaagaatatcaactccactttgccggcctggaatgggtctaactctagcaatgttacctacgctaatggaacaaacagtactaccaatactactactgccgaaagcagtcaattacaaatcattgtaacaggtggtcaagtaccaatcaccaacagttctttgacccacacaaactacaccagattattcaacagttcttctgctttgaacattaccgaattgtacaatgttgcccgtgttgttaacgaaacgatccaagataagtcatccgccggtgccgttgttgttgccaacgccaaatctttggaagctgtctcattcttcttctctatcatttttgacaccgaaaagcctattgttgtcactgaagattccgcttatgccattccagtcgctaacaataagaacgctaccaaacgtggtgtcttgtccgtcacttctgacaaattagtgtactccggtgtcttcactccacctactgcttgttcttacggtgctggtttgcctgttgctatcgttgatgaccaagacgaagttaaatggttcttcgatgcttctaagccaactttaatctcttctgactcgattatcagaaaggaatacagtaacttcactactccttatggtctattagaaaacggtgttccaattgttccaattgtctatgacggtggttactcttccagtttgattgactccttgagttctgccgttcaaggtttggttgttgtttcttctggttctaccaactcaacctcatctactattgaaagcactgaaatcccagtcgtatatgctcaagctaacactccattaaactttattgacaacaaagatgttccaaagaacgctgtgggtgctggttacctatccccaattaaggcccaaatcttgttgtccattgctgccgttaatggtgtcacctccaagtccgctctggaaagcattttcccatgaactgatagatattaaatctagcgaagcatagagattctttttttaccagtcatcataaccattattttacaaaatttccacgcaacagcttttattttcgttcgtaataggaaccatacttcccattaaagcagtatgattgttttatacacctttttattgttatttaagacataccccaaataattaattaattaattgatgaaagaatcatataaattcttggccatacatatttttttattatcttttgctacattgaccataggtgaatatcttcccggggtgacactccactgaagtgggaaaaaaagaaaagttttaaaacattgctcaccttaagtctcgaaggtctagcattcactacctgtaagtgtcaagaccccacatgtatacatggatacaataaagaaacaatgtccgtataatttgtatacattttactacagataagggatctcacccccttcttttgtgtctaagtgaaatcttctgatatatttagtgttttatagcgtccatgttttaaactagaacggcaaaatagtagttgttgtaaacgcttattttcgagacatcaggtaaaaaggatagttaaatcttacaatcaatgcatgtagtgagtggcgtttatcaatagtttttaacaattcccattttgaaagaagcccacaacaaccctagtagttcgttaatatacgttatgatggtcaagtgtcacagtacggaaagcttgcaaacagctcttacatagaggagttgcttcaaaataaacgtcctctggtgtcaagtgtctcatacagcgaccacatgcgaaagaaactactacagataagcaaatacacaaattataatcgtggattcatcatcagaatacgcctggccctgtaatcctttggctcaccaacattcgatggacacctttatatcttctaataacagtgaataatagacacaatacgaagaaaaacccagcggtaaccatgtaaacggtaccacttacgccataagctaaatagatcagaatggtagagactttgacaaatagctcgaaagctttagcgaacattagtcttatccaatttaagttgggttcattgccatctctacttttcataatatgttttatcacaggtgaagagtaaaatacaatgatgttatgaaactttccaagcaaccctaatttaccagtatccttatatgctattaatgtcgtgccaccagaaccaaatatcttggcaaatttccagtatcccacgatttcgattataaaatcattctctgaaaaggtcattgaattgaacccgctccttaatatgttgtatacggaaaatgggaataaaattagcccaataaagtaatctaaaatgaataaatttctaagaaaagttctgagagggctctgctgccttgctgtgaatggggaatcggccgtattggcgttggtggctcttatagtgtctgcattgattcctccatttccgtttgtggttgcatccatattagctgctctatttatatttgaagtagaactcatattcctcctaagggagttaaatattccatcgattgcttgctgtacatcctgctgtagttcttgctgagattgctcggttacaggtgaaggctctctactatgcctcgtttccgattcttctagaaatcgctgaaacagataatcatcattatcgtctctttctgtccaattactgcggcgatgattttgaggcctcgccattttttctcactaaatgcttgtgaggatgtatgcgtttgattcggtgtctctttaatcatattcccgaatcgaccctatttgaaggtagagggagttgtttcctctcactattgttataaaagatcatcaatgacggaaactaatatgcaatgaaaaaatgagaagtttacatgaatatgaagattaactgcacagcaatgttgttgacccttggtattcgcacacactaagccaacataggttcgttcaatttttaaaaagaagatggtccggcctcagaatgttcactggtttatcgctacaattgtatttttcatcggatttgtacacgctaatacagaatcaatcttatataaggttcctcacaactttcccctcaaaaaaccaagagacagctctacttatgcaagagatgtaaacttgatatcttccatatcactatcgggagaagcaatgagtcagatcactatcgaggccaataccactgacttggagttgcataatactacgtatattgaactggcggacttacagcgagacgaaacatatcagattaaagtgtgttggtcagcaatacatccaatttccattaataatctccaaactatcacaataccacgtttcactgaatttcagggaactaagtcagactacgcgagaatactagtgactttccaggtcttgtctgactcgtatcctagtgagcatgccatggttccaatacaagtctcattaatcaccactcggctaggtatccccgtggatatttacccaacattaatcgttatggtgctattagtagcagggcttgttgttacccgggcaccacacgtattgaacgatcttttgctgaaattttagtatggaagcctgagccccctttggctggatagcttggcctcatcacaactagaacgtaaaaaagtccattaaccatcaaatgcttctcattaaagtgggtatttttatcgaaagaaagggacctgaatatctaactcgccgctatgtcgaatgaaaacttatctcccaatagtagtaacccagatttaactaaactgaataacggcgaaagcggaactattgataccagcaaattctcgcccaacgaaatgaagctatacaaaatgtacggaaagctgccatcaaagaaagatatttttaagcataccatgcagaaaagaaaatatttcgacagtggtgattacgctttgcagaaagctggcattcaaaacaatgatccaataaactatggaaagaataacctgccattaacaaatcccagcaaactacgagaagatataataaaaagaaggataagcacttgtccgtcaactgcctcaaccgctggtgtagtagataatgcgacgttgatacaaaaggagggaagtatatcgagtggaccaccatcgtctaataacggtactattggaggtggtagtacaagttcaacgccagtggggaaccacagctcttcgtcgtccagtttgtatactgaatcacccattagataaatagacaacctgtacttttttatatttttttagggaaagagaagggtctcttatatttaacgcttattatgtgatttctcgaaatgtcaagtgttacagccatatggctgactgtgtttacgttaattagttatatataaacgataagccattctgatgttatcttcttgtacttctaattaataatatttactcgtcagaatttcgactttaatgagaatatagatatcttcctagttttccaaacattagagaaccaaggaaataaaaatccatgaaatataaaaattgggaaccgtcgataatatctttgtagcaagagatacaacaacccaccccaatgcagatgcagctcattaacatggatattgagccgtcaaaaaacaaccacagtataatattcagaagcccccatgcccctgccgcctgcaaagaggagttccactgtattttcctgatcccaaatgtgactcccaacatggcattgatacttctaataacagaggtcaaactgtcatggtggacagagctcttaacaacctctgtttgaaaaatattatccagaattggtacaacagaaccaaataacagtccttcaacaccgtagcctaaccagtttggcagaaccccattggatagccagttacaaagtttgacacccagtagaaggggtctcgatgcaaaatctggatgtaagagatgattatcgtgcaagtttctggacagttcatgatatgcgaaaccgctcaatgacaaaattaatacagcttgcaggtaatgaagaatattttgacgagtttgtctggttcttgacggaaagttttcgtgaatggatgatgctgataaaatcctttccaaattattagaagatactgtgttccttggcagcgagccgccaaccttatgggccaagtaaaaagtcgaatcaatagtttgatctctactatatttggtagaatctatagagacagagcgtttcaattcttcgtaaatttcgttatcttccgatctcacgacgtcatcatcatataatgaataaagctgcggtttagtcagagagcagattgattcggtgctcttctttggatccggttctcctctattggccattctgtatgctgttttctttgagaaatactttgtcgtttatcttcgtccttgtcttctttttggtcctttgtgtttgagtgctttccaaactttttctttaccttttgcacgccaactactatgccctttattgcaaataaaataggtactacaataagccctatcatcaatgttgagctgtcaactagaagtttaaggaaaagaacatctcgaagtttagtaatttccttgctttcatattttaaatgtctagctaatttcgtatctaccctttatctcatgccgataaaaagaaaagttcccccctcgtggccagcgacgttcgtatatacataaaactgcctcaccctcctttcggtggcaaaagcatgttctacaaatgagtataaagatgtaataagagcttgtacaagcaaggactcgagctagggcggaagtgtgacaacagtgagctataggcacattgtagtgtacatctactgcaagagcttgcattaattttgatataaaaaaaaggaccatcaactaatttttgctatatttaagaatgtcggcggctatcgaaaaagaaaccggaatgttggatgtaggaaagcactgtgcatattgtagacaactagacttcctacctttccattgttcgttttgcaatgaagatttctgctcgaaccatagacttaaggaagatcaccactgtaggtggttgctagagcatgaagaagttcataaaactgaaaaaagtcctagcaaaagccgggatggctcaagttctaacgatgaagcatatttcaagagtctgttacctgagagggccagtgttagaatccagagagtaagtgaaacaagagagcctttgagaggttctaacactgccaaagtgagctctactttgaactcaaagacattagacaaaatatttaagttcttccaaaggaatgagaaaagaaagagcaataacaaatcaaaaaagaatttcggttcctcgtcgaataagataattcaattggctaatctcaagaaaattgctaaaggtgaccccaagattcctatgcaaaataggatttacatttggtgttacttggtggatggtgatgagacggatatagccaaggaggatacaagaatgccattatacattaacaaaatgtggcctgtgggtagggccatggactatttgtctatccagctaaacgtgaaatctagcacactaactaattcaagttctaatgacaaatttcaactatgcaaattgaaagagggtaaacaagtttcattttataatattggcgcttccttaagagtcactaatgagatcaaagatcttgatactctgtatttagtacacaataacgccgacgaaaaatctaattaagaaggacactataaataacaaacaatcgcgcggaacgtcaagcgtatatactatataaaaagaaaacaaaaaaaatcaataacccattaaagatacataatcaataaaaaacgatattaaaaagcacgtaaagtacttaatatttttttaataatagacattttcgcccttactttttaaataaaaaacataaaaaaatatcaaatgtacatcaaaatcataatactagaacaaaatgtgaagatcactggacggtggtgggaatgattacaaaaaacctcctccgttttctattctaacagcatcctagcttactgaaaaaacctttcgatgatttgttactatttctatcttgcgctgcgtttttagcgttttgttcgtcgttcgccgttggttgcgcattatatggatacttgttagtttgaccattggcacctgtattggcaaactgtttggatttctgttgcatttgcttttgttgttgctgagcatatttttgttgagtttgttgctgatatgcttcatacgaagttggatcaagcttcgacgcctctctttcttcgtcatagtgcgagtcatctggttgtaattgataacgattggcctgttgctgggcctgggcttgttgcaattgttgttgctgcactttggcttgtgcttgagcctgtgcttgagcctgagcctgctgttgttgttgctgttgattgtaatgatggtgatgatcgggtgatgaatattgatggtttttacttctatgcctttttgatttttcatttggtggatttgggtgaccataaccatgtaagttcggctttttgtttatcgacaaatcccaaccacggccaccattcagcttcatccaatcatattgtccatctgctgtttcacctaaatcatccaacacagataaaagtaacatgcggtagccctcataatcaggagtttcctcaaacgataaatttctgactatttccaaatacctaccaaattggattgggagaccctgagctaaatcgtaaacatttgttagtcttttcttttcgccaattttttcgtacttttgcttgttatttggtgctttcaaaccttgccatggtagctgccccctcaagaaataaaagaagacatgacccatagcttccatatcgtctcttctcgattgttctctacccaaatgtgtatttatcgacatgtatcttgctgtgccacttaatgatttcttttccctgtacggaatatgttgtttagtttttggatcacgatattgtttggccataccaaagtcaattagatgaactttgttagcatctggttgacccggtcttccgatcaaaaaattatcaggtttaatatcacggtatatcaaatcatgagcgtgcaaatcttcaattaaagttatcatttgtactgcgacttgtacaacagtttttaccgaaaatcttcttccacaccaatcgaataaatcttctaaagaaggaccaagcagatcaataaccaatatgttatgtaatccttcctgaccaaagtagtattcttgtggtataccaggtgttcccgctaaaattttataggtccgatattcgtcctttagctgtggggcttctgtttttcttggttcaaacttgatagcaactggtaatccattgatcatgtttgtaccttcaaaaagtacaccaaatgaaccttcaccgattttcttacctatcttatagtgcagcccgactatagtggaatcgtcgcgtgattgtgagccagaataggaggcagagctattgccagtgttgtgatttaggttagagctaacatgtaaggatgggggtaaagtaccattgaccaatctaacattgctacggttaggcatttgtgagttcattgtgttattattgacagctaaaccagagttcgttgctgtcaaaggactttgcacttgagacatttttggaaaactattttcttggcttatatgctgtgttcagtagaaacaacaagttttgtctatcaaaatggagaaaaaaactttctaatatgatctgcacagaaacacgaaacacaaccacgttcttaaatctcgaaagagaaaaacaatatcaaacgaaagaagtaatttccgtaaagaaactctttttttctgtctgaaaaaaaaggtacttaggaatatatgcggattacaaaggtatacaaaaaaaactctatctcatacacaataacttaaacttgctttttattatcatgttctttacttttctttaatttccctcctgaaaaaattaaaaatttttcattactcattttgtggagacacccacagcccacactttaatgagtgttctaacgttcaaggttgatattatcaccaaatttagcatacaggatcgccttcagagcatcaagacgggaatcaatgtctctttgcttgtcctctaaagtctctattttgttgtcgagacgttctgcgtctttttcgagctgtgcggtaactttgctctgtttcatgaagataaagaggtcgcccaccttgtattgcacgggctcatcttcgtcaatcaattcaatttctagagacacatcatcgaggtactccttctcctccctctgtaaactcaattcctgcgcaatggcgtccttacgcataatcaacttcgaaaactcgttgatcttttgctgatcttcgaacgttacctgagtgttgttcctttgtccctgtggtaacagttccataatggtcctctgttagtttcttggcgttgtgtattctggtagtttccgcaggaccaaacagagcataagtcctctaagtacttagcttcctgtaaaattgtatgaaaagccgcctctgctgatcatgaatgacggcctagcgttcctcatatgatttagataaaaacatagaaaggtatgttaatagtacgagagaattcggagaccttaggtttcacaactggaattgggttaactcgttgagtcactgtcgaatgtccgaagaagtatggaatggaaaccaaggaatcctctccgtatatgtgagcaaagctagagacttgcctaatttgaataaactggacaagcaaaatgtaatgcttaggttgcgaatagctcatatgacaagagccagcaacactctacatcgagcaggtcaaaaccctgttttccattatttagaaaaatttgatattactccagagataaagcctttaatgtacgtcgaagtttactgcgatagaaggaaaaaatctccgctgccaattggaagatgtgaaatagaccttttaaatgctattagagcagacccgaaggagggttattgtacctggtacgaactgaaaagaagtggggatgaatttgctggcactatattcattgagttgactttcactcccaaagtacctcgtttaaacagggacgatcttaacaaagaaatggacaggttggattcatctatggctatgaggccgataccaccattgccaacagaatcagagtatgactatgttcatggttctacgatgagacagattactccccagtgtgttagcacaagtcacgaggataaggatgagggacagccctacagaaatggcaatgttttctccatgtcatctaaatcagatacagcggtattggcaaatagtaatgacccaataattttacctccaactttttcagcatccatgggtacaacgtctacattagaaactaatgatactgctatatcaaacacttcgaatacaaaattccattttgccaatttaaggaaattaaaggagaagataaatatatttaagaatcctgatagttcaacaaacaactgccaaaatgaatctaacaaggtagatattgaggcacttcaaaaggctattggtgtaacttcgttgtcttacgacgaagatgatgacgatgacgacgaaaatgacgcattttattcttccagccatagagtctcccacaactataaccaaccgcccttacctcctataccgaccagagatgatatgtccaattattcaagttcgcgcaatacgccgttagtaagaagagatagaccctcacgcctagattcctcttcgcctaactcacatcctcatccatcaggcctgaattctccaaaactaccacctctaccgactacttcgaattccaattttaattcgaggaagaattcgatgtctcctacaagaaaaagaccacctccaaggctcagctaatgacaagagaaacatgctgttattgtaatactaatatttaaatagaattaagatttttaatgtttaccaagattttttcttttttaaattttattatttcaatatgtatacataaatctgttgcgccctcaccgccgatctaaaccataaagaaaaatgctaattgtacaaattctgctttgaagaatatccaaaaatatggtaaagcggtataaattttcaactaaaaggcggcctcttcatttggatcctcttcatcaccgtaatcatcatcgtcaccattgttgaaatacttttcagcattataatcatcatcatcttcttcgtcttcatcttcttcgaaatcatcatccgccaaatcatcatcttctccttcgcctgttttacttccttttgctgccccatcacccgtcgacgcatcatccacatcttctgccaactcctttaactttgccagcatggatagtccgatgttttcatcttgtaaacctgtaccagtaaaaacatcatcggcattattaaacttggagattgccaataattttttcttgttgatccccattacattgtacaattcattgggaaagaggttcaaattatacggatgatcatcaatagaaatacctattttcctttttttcaaatatttatcggaatatctttcaatgccatcattagtatcgtcttcgtctaggattatgttgggtttgcgtttaccgctcttgctgttttcctgttgatctattatcaagctcattgatccggtataaaatgggccatctttaacagtctttccaaaattgatgtactttactgctaaagatctttccttatttgttataggaccattgatgggcaatgggatggatggaaattccgtaatatgatttttgcctacatctccataacctaatccgaagggtagattgctcatatagttgctcccgccacctctactgccgcccctataagaactcatgtttgttcggggtatatatgctcggtactatcaagttacaatatctttctgtcgtgttgttttctataggttgctgcgatgaggaaactattttcttctttgagattttttcaaatttctcttcatttttcatgcggccgcacaagagttgaaaccactgacgaaagcaatttcagttcattgagttacacctagcgaggcacttctttgtggaatggtagccattgtattgagatttttcttgtcgaccatcagcctttttcttcataagagaaaagaagatctcgttcatgactgctaattactttgaacgatcacctctgcaatgtgacatttgttcgaaagccgcccattagtattgaaaataatttatattttcaattggctagactacgaaatttggacaagccattgctgcgtaatcctttctcttctacgtcacagtacatctctttaaaccttttcgtttctcggctgtttaaggaaagtatcgtcttgccgtatctacataaatcaattcttacccattttcttttgcattctagccgttaattcacggcttagtcgtttgatatcgtgtttgaattgtgaattgcatcattcatgcggaatgggaatcatcgcagtcgttatccgtctcacaaacgtcggcatttgctgactattaaggcgacacgtaacctacaaactcaatttgagacgcaaacgcaagttgattagacgttgagaatgatgcaagtagcaacatcggtaatggttagactattttatcagaaaactatagaaaaactaaaaacaaaacaatgtcacaatgacaaagaggaacccatacatacacagagagcctattcttccagtagttcctcaatatcagcatcactatctgggtccaacccttggtttcttctcttagcctcttccaaagcgttttcaaacaactcctgttgtcttttaactcttcttctagttttcttaccccaaccgaaagaagttgtttctgctgttgcagcatcatctggcttgtcgatcaggtcttttgatctcttttcctctttgtctcgtttgtccttttccacttgggcagccaactgcttcttcgccaattccctggatgcgatatttcttaagagtaaataaccacctacaattatcaccaatcttataaagtgcttgtagtcatagttgactagttttgccatccaggtatccacccatgtttccgctacttcagacatctctttcaattactcggcagtttttctcttcataacatcttttcctcatacaaaccgccgagtgcacataaatacaactacaaataataatatgttgacatcggatggagatcactaactaaaccgccaccgcgctaattctgcacaaattcaaatttcatcatcgctctccacgtcatcatggacgtcttccacctcggcggattcttcgtcttttgatagaatttccacagcccgcggacgcacaaacgatccgtgacccggcgccacaggcccaaacagtgttaccccatttatgcgcccatcgtttttgcctgcggcttccgggaattccacaccgcaccatgtgcccatcacgtccaacggtagtggtcctacgtaccgtaaaatggcctcacgtggagcgctcccgtctactgtgacacgacagtggcggccgatagccgccgttaattgctctcgggcatatgcttcgtcctgctttgccagcgcagcgcgctggctctgctgtgcagcattaaacctaccatagccgtgagccatcttccatcgtaatacggattgatcccttcgcaaataatcctcctcgctaattacttccattgaggggattccttccgcttgcgtggccagctggttagagattgattgggcattagagtctgtaacaaccacaataagctcctcctctccttttaggaagttggcatcttcatcctcatttgaataggcacccccctttttagtactatatatctccttgttgtcgtactgtcttttcacaactatttccatatcctctggttccactccggtaacatggtacaatcggtccttgaactgccttaatttaagcgaatttggtaattccttttctgtacggaccaattcactctctatgacaactctaaccatagttttgccatgtaatttttttttctatctctttatttgaattcgttgctctatgttcttgtcgcttgtcttcttcaactgccgtttccctgcgagccggaaaaaagtactgttctttcgaacaaaggcgaaaaaagctgtagctgaaaacagacaactgggaaacgacaattaagaatacgcatgtacgtgtatactactacagtaaaaaagaaagttatttgagagcagcactttgtttactacacagaacattaaccaaaaaaacatgcatcagcaacactccgtatgtttcacttcttattttcttccgtggcaataaccttccttttgacttatttatactaacattataataactatgtttcctttttgaactaagaaatcagagaacaaaccacaacagcaaaggaaaaaattcgaaggccctaaaagagaagctattctggatttagcgaagtataaagattctaaaattcgcgtcaaattaatgggtggtaaattagttataggtgtcctaaaaggctatgatcaactgatgaacttggtacttgatgatacagtagaatatatgtctaatcctgatgatgaaaacaacactgaactgatttctaaaaacgcaagaaagctaggtttgaccgtcataagaggtactattttggtctctttaagttccgccgaaggttctgatgtactatatatgcaaaaataggtttaataatataatctcatataaactcccttccttacagttgaaaacaaaatcaaatcacggtatggcatttctttacatattctcaatacctgactgacatagtatgcgctacatagttttgtcctattttttttacaccgcgatttgaagtctaaagccagagaatgaggaaaaacgaaacaaactgagatcatttgtataaggggagtcactgtacagctgccaataccaattttccttctgccaaatcaaaaaagtatccgcatacacatacacccctccctctacaatcttaattatttactgattcctttcgtatttgtccagtatgagcaatactaagcataccacttctcatcacatggaactcaaaaggatcattatccttacacttttattcatactcataatgttgatatttcgaaactcagtgtccttcaaaatgacatttcaagaactactgccacgattttacaaaaagaattcaaactcagttagtaataataacaggccctcatctattttctcggaaaacttggtggattttgatgatgttaacatggtcgataagaccagactgtttatttttttatttttcagtttcatcattactataccgtttatggtataaattagaaaagttaaagcagcatgttttcatttgaaacaaatactaatgcaataataggtacaccatctactacataattaattgatagtttccttttccgttaagtgcatgcataggacgcccataattttttaagttaaaaaagcatgtatttacctattcgggaaatttacatgacatggatgccataaggaacgaaaatgaaacatgcatgtcagaggaaaaagaacaaagcgagaggaaaaagctgttgcattaccacgtaattttgtatataaatatctgataaataaccattttatttccatccacttcttctgtcgttcatccgttcattgacatcactagagacaccagcgagctatcatcttcatacaacaataactaccaaccttaatgcaaccgatcaccactgcttccacacaagccactcagaaggataaatcctctgaaaagaaagacaactatataatcaagggcctcttctgggatcccgcctgtgttatcgcttaatttttgacgacaaccaagaggtcaaatcaatatctaccctttcatttattacgtgttgctggcaaactaatttattccaattctctcatcattagctcaccctttccatactttttcatacttttatacatatgtatttgtagttatcactttaacagattttttcatgtttttcttttctgatacgcctttccctccgcaggaaatgaaagatgaaccacccattacattcgattttttttttaattatatttttgactattatttaatcattaaaaacacatatatttcataaattcgtaaggtcgttagttctatcgtaaaagtgaaaaagttttgagccagttttcaaaaacccgcaggatcccactatgtatggctttaaataatggtttttcacgtgcatcaagtccgtactatcttcaccactataaactcttataggtggattattcgtttcgaatgctggtggcagtgccggtttgaaaataatcttacctacccatgggtggtcttccgttaacggtttgatgcatcttaatgagtctttgatatatcttttccttgaaactagttgtgtcgccggtgcccacttcgaatcgttactggattgattcttatttccacattttagtgacaatttctttggaaaatcatgatttaaacaaccagtcacggaaaagcttttcgtactgaatattgtaccgtactcaacgtccgcattctcatagcgagattctctttcatccaaatataccaatctattgatgtcatcatcctcaacatatccatcttcatcatcctcttcgtaattagcatcgtcttcgtcttcgtcatcatcttcatctccatttacatcttcattgccacggtttaacttttcttcacgattcgtacgctcagcagaattcgaaatagttgaccttcctgttccctcgtataccggttcaaaattattaattttcaacactgaccgatcacagcgcaaaggatctatagggttggaattcgatctacttctgaagttttcatggatggatgtttgtgccgttaaaacagaatgtgctgtgggagaaaaagtggaagatagaacagaagtattggtattagtagtactaccattgtcatcgatttcttcttgaacactattcagttccttcgatctcattttttgtccaatgtccatattagagttttttctcgaactggaatctgttttaaagaaatttcttagttttgatgtaaataagccacaaaaatcagtttgagaactctcccctgccaatgaaccagagtcattgggcccattggagtcatgactcgcatcggatacagagggaggtagcaagcttaaacttcttgatcttgatttgtttgtcggacgttcgttgccggtggccacttttgttacaacagaagaggtgtgtgatcttcttaaaagtaaagagtgggagcgagaatcatttctatcactattttgtctgctcttgtttttgtttttgttcttattgtgttgcttaaatcttcttgccctcggatgtctccttctgggaacgcttctataggtgggcatttccctcaattccagatccaaggacagggatatacccatgttcaaatacatagcccaatagatcaattcgtctacatgagaaaactgcactagaaactgttgtccctcacaacgcattcttaaaacaaaatctctagaggaataatctataggcagaccaactttggcacattgcagggagtaactcttaaagaggcgctcatctgataaaaatttgtgctcgtctcgtgctatttccccgcatatcctttccttgtcatatttatcgaattggtaagtggatttcgtcgtgaacgcatttaataacgaccgagccgaatgatggcgatcgctagcagttttggaatggtgggaatggtcaaacatgtcaccaccacgatagtttttaatatgcctggttaatgaatcgtcaatagaataaaagtttatctgcgtagagtttatttgaagaataaagttgttccataatcgagaagaagcattttcaaagggcgatagtttttccatcttcatagaaaccacagtatagtgttctacagacggtgtataactgggaggtttcacagaagtgaggcacggacgacaatgctcatatatagggtacctaatgactttagacggattcgcaaaatcataacacggaggttccactgggtacggatctatgcagtaaagcacgtttttgtcagcaacatcaacatctactccggattgtggctccactatttcgttcatgatgtttgtgttaatgtctgttatgctatcgatatggttaaaagtcactttcggaagcggagaatccagaatagaattactagtagtactggaacaaagaaactcgtcgcccatggatatggatgaggctgtctgtgaaagcttcagccccgtactatccataccgtcgtggtctattgtcatttcaaagatgctggaggacattttctgaataggtccgtttatctcttctgctgtctgcgaaaacaacgtaaaaaaatagtgcttagtgttactgcctgtgtaacaactagtgccaaagttacaaagaaacttcactaacagtttttgcaatttaccaagaaagcaccaacaaaataaataaatagcatgcctgtatatattacgaaaagtccttcaactacgtcttccacttgctctatcccttggcggaaaacagaatacatgcaaattttagagaatttttcaagatgcctgccccccacattttcttacttgatcaagagcagatctgttcctttgcgcagggggttgcatgggggagaaactggccggaagcagccgaaagaaagttcgcaaaaagataatggggacagtattagagaaaacggcgtggaggggtatggaggaaacagttagcataggtaacgaaaaaccgcagcaaaataattctctctttttttcttttgacttagttgtgggacccggatcattcggtactgcatcttattcccgtgccaaggtctctgggtgttgctgatttccgggtatccagagctctatctgcttccgtacccagtgagtgagctaaaataaaaaaggggcctcggcggaatttgaattcgggttacgtttcccacggagccccggatagaaaagattagtttcaggtacatgtgtcaaatgaggataaatctcaaacacccatgtaccgaaaatcgatgtgttggttatattacaaggttggaatagaccacggtgataagacgtggaatttttgactgaccatgcgactctgaaggtgttaaccggaggaattcacgtaatttacatctcaagaacagcagaacaaagatcgagtatatgatgaaatttcgttttacatgaataaagtcatattttaactcactgtgcacggattaagggctgtgatttagtgggacgagtggttctacactactcaagaagtcacgctgtcatttgatggaattacagtgcttattaggagccgtgtagcttagtgtgaattgatggaagctttcgagtttcatagaacatatctggtgaatgtatatgagtttttcattccttttacgagacgcaactttccgcggttacggaactgttgttttgttttacatcttttcatttttcatacattttattgaggcgtagaaatgaaatgggtagagcggcacatggatgtaacaatctccattattcacgtcgagccgatacccgcttctgttgacgctctgttaagcatagaacctacgagatttgtgctaaaggacgttggcaaggaagaaaactattgttgatgacaggatttatagcagtaaatatttttttcttttttgcgaaattatgtacgtttctcatccaagaagaatcctgttaatatttaaatttctgctagtcattatcatattgcaatggcttttattagtgaaagccactgtcaacagtaactgagctactccctccaatgttgtctaactctatgctctttttggcgtctgaatgagccataacgagggaaataactgtatcaggaatactaacagaatacagattggatgcactggtgctggtgagttttctttttctgatattattggataatattttcagctatagactatcatcattcagcattggtcacgctaaaatatacgttccatgcatacgtgatagcctactcggttgtcaacttcattttataggctgcctggtcaccgattaccgccccgctcagcaggacggtttaagcttctgttcttggaaacgacgtaattcatgtcggccatcgaaatcattcctggctttgtaatagtcataatgaacaaggaatgctgtcttgggtttttttccctttgcgaatacccgggctgccaaaatagaaaaggaacaaatggtaggtctttaagataagaaagataagataagacatcttttttttttttttttttttttttttttttttccgataacaaagaagaatccttcggtctcttcttactgctgttactgcttatcaagagtgtctggtaatagtcaaagccagataagataagaaatgtaaaatcgactatttccctcgtaaaaagcttcaattgctcacgcatcgacgaatactaagcggcgtgaagaccctgtgccttatcaatgaagtattcagtacaagaggtgttcattccgagccacttttctgcaccatatataagcagtagttacacatgtgctaaccaaacatcagtgggtagtaatcattcgtgctttcacgtcctttcaaattaaatatccttcttaaataataagtctgcacagagctttgaaagaagtttagttttgtaatatatcatacttaatatattacaatacaatatcaacaatgtcttacaattttacaggtacgcctacaggcgaaggaacgggtggtaactcgttgacaacagatttgaatacacaatttgacttggccaacatgggatggatcggtgtggcttcagcaggtgtgtggattatggtcccaggtatcggtttattatattctggtttatccaggaaaaagcatgctttatccttgctttgggcctcgatgatggcttccgccgtgtgtattttccaatggtttttctggggatactcattagctttctcacacaacactagaggtaacggttttattggtaccttggaattctttgggtttcgtaacgttttaggagccccatctagtgtcagttctcttcccgatatactgtttgccgtttaccaaggtatgtttgccgcagtcaccggtgccctaatgctaggtggtgcctgcgagagggcaaggttgtttcctatgatggtgttcttgtttttatggatgactattgtttattgtcctattgcatgctgggtctggaatgccgagggttggttggtcaaattgggtagcttggactatgcaggtggtttatgtgtccatttaacatctggacatggtggtctagtttacgctttgatactgggtaagcgtaatgaccctgttacacgtaaagggatgcccaagtacaaaccacattccgtcacctcggtggttttaggcacagtgttcttatggtttggttggatgttctttaacggaggctctgcaggtaatgcaactatacgagcatggtactctattatgtccacaaacttagctgctgcttgcggtggcttgacatggatggttatcgattatttcagatgcggaagaaagtggactacagttggtttgtgttcaggtatcatcgctggcctagtgggtatcaccccagccgccgggttcgtgccaatctggtcagccgttgtcattggtgtggttactggtgcaggatgtaaccttgctgttgacttaaagagtctattgcgcatcgatgatggtctagattgttactctatccatggtgtgggtggttgtattggttctgtattaactggtatctttgctgcagactatgtaaatgccactgcaggctcttacattagtccaattgatggtggctggatcaatcatcactataaacaagttggttatcaattagcaggtatatgcgctgcactagcctggactgttactgtcacatctatcttgcttctaactatgaatgccattccatttttaaaactaagattaagtgctgatgaggaagaattaggtaccgacgctgctcaaattggtgaatttacatacgaggaatccactgcttacatcccagaaccaatcagatctaaaacatcggcacaaatgccacctcctcatgaaaacattgatgataagattgtgggtaacacagacgcagaaaagaattctacgccttccgacgcttcttctactaagaacactgaccatatagtataatgatatactcaagcagactatgattttatgtttaatctttatgtaacgcttcatttaataattttatttctaatatttgatatattttctttttttgataactccgaatgatgaggggagacgttagtattacttctcttgtcttatgttattatcataatcgatgactttaactgtgcacactataatatacagcatctccagagcatgatagcaagaaattttctttaagaaagcctctatataccctatatatgctgttaacaggaaaagagcacaaggtttattttgctttggttgcaaattttcatcgcttatagaagacatattttgatgtaaaaaccttgatatacttcctttttgccttatctttcactgtttccatctcttttcttttttttttttttttttttttttttttttttttttttttttgaatcttaaaattctcgaaactgcactgaaatggcgcaggaaactgacctcatcgcatgccaacgaagattgaaaaaaattaacatataaggcttatgaaagcgacatcttttgcaaatgaataattgacaagcaggcctgtgtatttatagttattttgaaataataactaccattagaactaacaaaagaaaagaaaaaaaaaataatggtttctgtggagtttttacaggagttaccaaaatgtgagcatcacttgcatttggaaggtactctagaacctgacctattgttcccattagctaaaagaaacgatataattctacctgaaggttttcctaaatcggtcgaggaattaaacgaaaagtataagaagtttcgtgatctgcaggatttcttagattactattatattggtactaatgtcttgattagtgaacaagatttctttgatttggcgtgggcctattttaaaaaagttcacaaacaaggcttggtccatgctgaagtgttttacgaccctcagtcacatacatctaggggcatctccatagaaacagtcactaaaggtttccaaagagcttgtgacaaagccttctctgaatttggtattacatccaagctaattatgtgtctgttaagacacattgaaccagaggaatgtttgaaaactatcgaagaagctaccccatttattaaagatggtactatctctgccttaggattagattctgctgagaaaccatttcccccacatttatttgttgaatgttacggaaaggccgcctcattgaataaagatttaaaactaactgcacacgcaggtgaagaaggccccgctcaattcgtctcggatgctttagacttgttgcaagtaacaagaatcgatcacggtatcaacagtcaatacgacgaggagttattggataggttgtcgcgcgaccagaccatgctaactatttgtcctctctccaacgtgaagctacaagtagtccaatccgtttcagagttaccactacaaaagtttcttgacagagatgttccattttctttaaattctgatgaccccgcctattttggtggttatatcttagatgtctacactcaagtttcgaaagatttcccacactgggaccatgaaacatggggtcgtatcgctaagaacgccattaaaggttcatggtgtgacgataaaagaaagaacggtttgttaagtagagtggacgaagtagtcactaaatattcgcattagtaccatttgcaagacattgtataatatttttgttgaaagtctttttcgattcataagcgcttttttgtaaatttataacactatgtgtatgcacaaatttcattcgatgtttttgatgctttttacatccccttttgtgtgggaaaggatacaatagaattctacaaacttatttgagtgattatacgagcattagctggaccttttgtatttcacgagattacaattcgggaactatcaaagtacacgttaaaattcagctcgggtatgttaagtactagtaattacctctggtacctactgacgtaattcccacccttgggaccttgcggaagcgcctgagtattgctctttctatttccgttgtacctttgattttcattggctctatgggcagcaccgctatctcgtgtatttctataatcttgcgtttgaaatttgtttctaattgtttcatccttcttgaatcttttattcggcttttcttcattttctgaaggcgagtcgcgcttgtaagatgaagcttggtaagggttggctttgctgctgtctttgccctcttgaaatggcttttcaggaaaccgtaattgtgaacgttgtgaactgtttttcttatactcttcacgtaagcggttatccctttgatcaaaaccatcgcccctgtccggacctgtgggtctaagtgccctacttctatcattatatgttttacttttactaggtctagttggtagttctgaccttttatgtgcataactactgattggcttaatatttttgggtgcagaacgatcattgcttggtcctctatagttggaactaccataaccatctttgcctccagcatttccgctgtacctacttgatcttttggtatattcaggagcagcagcttcagaatatgagctagtcgtatctgggtatggctcgcgcgagatatttttaatataccttttaagcgaatcaattttttctgcaaaatctggattttgaggattttgaatgagtgtcctaaagtacctttcgaatatttccaaagtcgaatttctaaagtcgaatattggcatattttgcttagataatttccttaaattccgagtttcatcgtcgttctctactaaggaaattgccttttgtaaatggttcgtggccaaataatggtttatatcgtcgacgtgcctggtgactttggaatatgaccattgactactagaaggttttgttgggattacaggctcattacgagaataagtatatctatccttgctatttaatccagcactgccgcttgcaacacttttgggtggatcattttgaagtctttgcgacttattaagctctaactgctttcttaaagctacttgcttttgttcattttggcaagctgtttcataatttttgatctcttctaattccatttcacgtattctcttttgttcagcttcctcttcagttaaggtgcagaattcgtccaattctaaagcgtccttcaaacgcgctttcaaatggccaatcaatgcgctgcttggtagtttaatatcctccctttcttcatttatcaagttttcctctaaagttgtgtaaaccaactggatatgagctttcactacagggaagacactagtgacgtgcttcatgaattcaataccgtttctaattgacatgtaatttttttcggataaaaggtcaatgacttgctcggtaattactgaatgccattcataaagctttcgagaagcttggtcgttgaaatcgccatttaatctcattttttcaagctttttaagaacgtcagtgaaaaacagacctaaattgcctgcttcagagctagtacaacagaacagcaacgtttttaaaatatttgatgtaatacaagtattcaatatcgacatcaaattttctgtcctaaaagccataaagataaaaaacgaagagaagagagcatctgaaggagaaaataaaacccttggcacaacacaattctgcaagaatatcttaatttgatcttccccgcagtctttgttccagacatttgatttttcagatataaattctgaagttttcttgaaggctctttgatgcgaaattccagtaaccaaaatatccttgatttgattctgaatcaggtgtttttttctatttgacatgtggcccgtgttttctccggatagtgcattcttacgctcgtcatatagtgatttatcgaaatggatatcgtataatgaaagtctccaaaaagtagtgaaaagatcctttgatattttcgttaaatcaacatcgctaaactctgcaccttcaattaattcatcaatagaaaaattctcatttgagttcaattgattatccaagtagtctctccatatgtggaaagtccacggtgtcgataaatggaacctattattcaattctacaaatgggagaacattctcttcaaatgctttccctttcaaacaatgtttaattaactcaataaacgaccataacaatgtattcatttcatcgcatctagtggataaaattttgtaatgagaattttgcgtatttgctttcaggtttaaagtgtataacaggagaataatctcagaaatagcgctctgatcagtgaaaaatgaggttagcctcgacgaaataaccgaattatcatctctaaaatcatatatgagatgtcttgcatattgctttaatggtgatcctgagtttaacattaatagttgcttcatattaacttcgtttaagtctctaatgcccccgactgtaataattaattcctttaggatagaaactgctatgatattcccattatgcaacgtctttaaaatataggtgattatatttgagatatccatattgggacaatttttggccaaacctgcaataaatattgataatctctggacccacatggcctggttaacaccatcaaattgaacagcaggcctgttataagttaagcgtaacaataatacaaattgcaatacatcatacgcaaaatcgttaaagtacttcgtggtgtaaacaacaagctcagaaactttgtcatagttttcaatctgcttaactgctggtaccagtgaggccaatggatttgtagagattaatttggcaaatctcctggactcttttgcgattgtatctatactcaaagccttcaaaatactcttcgcttctctttcggccttattgaagctcaccttaagcggtagaatatcttgggataatttcgtcatcatttcgttgtaaataaaatatcttttttcaaaagggaaaaatttcattagttcgtaaacttccgatgtggcaattggattgttctgcaatagcgaggtagctggaaaaatgaattttcttacatagtctatccacttatcaatcgtaacatgcagagactcagaaccgtggttcttttgaatgtcagctaccccaatacgtgaaatcttactcaaaagcgtaggaattctccccaaatacggtcctatgatagataaatagatatgcgagttttcaaatagatcatttacagaagcaaaaggagtcaaattggaattccactcgctgtaatagaagacgtagcttgaattcaattcaagggattcaaatggctcgtgagttttatatttatggatcaaccttggcttatgggctagaataccattatctatacgggttatcatcaaagcagttgccatatcttttgattcaccagatgaggtcattgatgtgtacaatggatttaaaagatattcaaatactcttcccaaatatctagataaggattcactaacatataacactttcggatattgctttaacacatgtatcacgggaataacgcaaccatgtatgagtaagcgttccaagagttttattttaccaaataataaaatatcttgctgagttttctgcttgccttttgattctatatcagcgtttgtttcctcagagattttatccttcatattaacatcatcatttacaacaagggcgttgtcttcgtcagtttcattttcagtggacaaagcagctgccatagccaagggattttctacgcctttagtggactcctcttccagttcagtttctaagttttgaatatattcttgtagaaattccatctctggtttaacgttatcccaaatagaataaaaattgacaaacccatttttcagtaaaatgcaacacatatccatataccgttcatagttttccttatcgacttcttcgttatattgcgataaattgaatgaaataatgtttgctgcaatcatattaccgccttcattaagagaagaataattggaattgttagctacatggctagatggccaagaatccgactttcgtaaaagagcaataaagaacttgtacccttcagtgataaactgactagaaacgttcaaaataacatctaaagtacgaatagaatccaaggaatatttccccataatatgatagatttctttcaaatatgcggacactttggaaaaattgtcgggatcataatacgccaatattaataaggctaccaattgaccataacccactgaattttctaccaaaaggttatatttcttcagttcgtattttgacttttttaacaaatgccttaataaggtggtttgttccttgttgagcagcttagaggatatccaactaaatttgaacaattcttcatgcaacgacggtattagtttacataatgatatggttgttagatcatttatatttggaacagtgcttgagacggcgataaacattttaccaactatggaagcctgggacacttgcctttcatgattcactaattcattagtaaatgatgcaacatcagaaagcttgaggggagaattttcatcgtttttatttatgaaatcaaacagttcaataaacaaagtcctcaaccagtcttccttttcatcatttgactccagtgcagtgaaatcggagcagagagtttttgatcgttcaggccagtttcgtatcacctcttccgttaaaatgcttgcctgactaggggaagctggtggtatcactttttgagaaagagcgttcaatttggaaagtagcgtctgttctgccataaagtcctgaaaatgtatactggtgcgaatatgtatcaactgaaaccgtttcaccctattatgctttagataaagacgataaaatcacagccctataatttatgcaacagtgtttgcttctaaatcaacgtgttccctgggcataaactctcatacgttatgtcgctattgaagaaatagcggaaaatcttacgccgaagttagcgttgtcacccgggaagaagagaagaacataagccttctcattcagaacatgtaaatagtggctaaaatggttatattacacaattcgaaacagtgaaattaagaaaagaaatggtatgttacgttctattgcgctttagtttgaattgaaatcatctttaccatggtactaactacgcttgcgatgaatcgtgcaagtccgtgcggcttatacgtaatgctaatactcaaaacaggcggaaaagcagaggcagttgaagttgcagaagatatacaaacaaaagtacatcggactgggagatgagagcactacacgagaacagtggcagagaaatgtgagaaacgatacactaaatacattacaaggccactccgcatctttggagtacgtttcattgagccgaggagaccttagtatacgtgacactcgtattcacctcctgaaatccatgtcccctggctataaagcctacttacgagaagagaggtaggacgttgaagccacatccataaataatttttacataaaattacgcctcgtatgtcgttctcaagatttatggtagagatcacactcagtcagtaaccttttaggcattgattctagtaactgtcgaacattattaaccttgatgtttatataaagatataaaatgttgggacagtatacaattcatatcgtttaaaatgatctatacatgtcgcgtgaagtcataaacagggatttagaagtgaaatcttttggtagtataggggaaaactcagcttgaaacttttcgtaattgagtaggccaagttgcaaccgtgtgaaatcgaatcatgcctgactctaagtacacaatgcaaggttataaccttgttaagctattaaaaaggctagaagaagccactgcaagattagaggatgtcaccatctatcaagaaggttatattcagaataaattggaggcatctaaaaataacaagccttccgactccggggccgatgcgaatactacgaatgaaccttctgcagaaaatgctcctgaagtagaacaagatccgaaatgcataactgcgttccaatcttacatcggtgagaatattgatccgctggtagaattatcaggaaagatcgacacggtggtcttagatgctttgcagttgctaaagggaggctttcaatcgcaattgacttttttaagagctgctgtgagatcaagaaaaccggattattcttctcaaactttcgctgattctttaagacctatcaacgaaaatattataaagctgggtcaattgaaggaatcaaaccgtcaaagcaaatacttcgcatatttgagcgctttatctgagggtgctcctttgttctcctgggttgcagtggacactcccgtgtctatggtcacagatttcaaggacgcagcacagttttggactaatagaattttgaaagaatacagagagtctgatcctaatgctgttgaatgggttaagaaatttttggcctctttcgataatttgaaagcctacattaaagagtatcatactactggggtttcctggaaaaaagacggtatggattttgctgacgcgatggcacaatcaacgaagaatacaggtgctacttcatctccttcgccagcaagtgctacagcggctccagcaccaccacctcctccaccagccccaccagcttccgtctttgaaatctctaatgatacaccagcaacgagtagtgatgctaacaaaggcggtattggcgcggtcttcgccgaactaaatcagggtgaaaatatcactaagggtttgaaaaaagtagacaaatcccaacaaactcacaaaaatcctgaattacgtcaatcctctacagtttcttccacaggaagtaaatccggtccaccaccaaggccaaaaaagccatcaacattgaaaactaagaggcctcctagaaaggaattggtaggaaacaaatggtttattgagaattacgaaaatgaaactgaatctctggttattgatgcaaataaagatgagtctatcttcataggtaaatgttctcaagttcttgttcaaataaaaggaaaagttaacgctatctcgttgagtgaaactgagtcatgcagtgttgttcttgattctagcatttccggtatggatgtcatcaaatccaacaagtttggcattcaagttaaccattccctacctcaaatctccattgataaatctgacggcggtaacatctatttatccaaggaatccttgaatactgaaatctacacctcgtgctcaactgctattaacgtcaacttaccaatcggcgaggacgatgattacgtagaattcccaatccctgaacagatgaagcatagcttcgctgatggtaagttcaaatctgctgttttcgaacatgctggttaatattgcgaggagcattaattgtatttagttaaaagaaataaatcacatttgaatcaatcagaaagaaaagtgaatgaataaacaattatatactttttgtaaaacctttttttcatgtgtaaccttttcttaaagaagtaacaggaaaacgaggagcgactaagtgactacttgatcgttcgagtagaacttaaaaacaaaaaaaattaaatatttacagtgtaaagagaggctgaagatcagtcaaaagacgcgtgcaacaatacacgacgatcatttaccatttctcaagtaatacatatatgcacgttcatgaacaggaacatcaaatggtgaaattacttcggattggcctggtcgagcgacgggatcccttaggtatacagcgtggcatgtcttgaaagatatttccaaatgatgaggtaaaatggcgaaaggcgataaaaatggtcttggcttccatggtgtgaaaaagggttttttaggatcttgcctaccataaacataatttttctgccacggcaagtttatcaatttacgtgcttttggttcatcaccttccaattcagataatttaatcggatcatgatattttaaatttttggcccatttggggtcgaacgttagtgaaccatcagaaatatcactcatcctagttttgaagtggtctgttatatttttcgtccatagtttcacgctttccgctatgattctttttccagatcttaaagcggatttggctccatcagataattctttttttgtggtttcgttaggattcatcatttctgtagccagtgaaatcaactcgtcaggctgacatttagaaatgatttctcttctaatttcaccggatttgaaaaactcttgataagcgttatttagactttctaacaactgagagtcctggatctcagggagaccctgtttgagttcatctatcgacaagggctcattattcgacttacctatttccttctctacatttaaaagctttctcaagataccttcctgtgtgcatccctttaatgcgttatattgctgtgactccagattcttattatattgcctcaaaaattcttgaaactgaagtttctttgggttagaatccgacatcttttcaaaattttccaacttcttctcccaaacttcctttggctccgttttcgcttccttaacatacttgttccataaaactatttgagtcttatcgatctttagcgcttcttggaaacttggtttcttggcaccgagagcttccagcactttgtccggtttgacactgaacatatctccaggctttaaagtatagcttggatgcttaatttttacaccattaacgcgaacatttccatgcaagatgaactgacgagcttgtcttactgacgaagcaaacatagccctgaaaagggcaaaatcaagccttttttctaatactgcaaaagtttgtaataaaaatggtgtttccttgatttcacctccacgcagtgaagcatccaattgtgctactgaatccaatttgggtttgaaaacggtttgccatctcttttctgtcaaatgttcaccatgataagctcgggtttcctgctttgccgtccacttctgttgatacaaagatttagacttcaagtctacaccaccctttttgtacaaattaaacaaattatacttattgaaagaagtgcgtactcgtcctcttgccaaagattttagcaaattagcctttcttggcattatctctgtattttaattgtaaccagtcttccgtaccaaaaaagtataaaggagctcctactcgatatatattcgaattagttgcacttcctctggggaaaccttcacctttttgaccgttcgctctctctttttgtatatcttcagcatagttccttaactaatactgcgaagcgaaacgtatccggctgccaccatgaaaagtaaaatcgtgcttaacgaagaaatcaatcatataatctatgaagatggattggcggagtttattagaagttgctagctgctagtgaagaaaagggaatcgtggatgtgatggtagtacattggacaattgtggatgaaatacgacttcttagatgggcatctgaattcaaaccggccggaattcataagcatttccacatgttttgcatagtggaaagaatgaattcgccagataagtatccagtgacgctattacagaaagaaaccatgaagttggggaaggtatttactgcaaaagacatatgggataagttgagccaatcttacaatttagagaaaattgatgaaatggagaatacatattccttggaagccactacagagagttcacggaatggcaatggaaatggtgacgatgcagaaattcatgaagaaactttacttgaattgaataatcgaataagagtacgcaagcaagattttacattaccttgggaggaatacggtgagttgatcttagaaaatgcaagaaaaagtccaaactctaacgaagagtatcctcgagttgaagatatgaatgagaaagatagtacaattccaaaggaaagtccttctacagacctaaagaacgacaacaataaacaggaaaaaaatgcgacaattaaagtgaaagagttgcctgaatatcatacagaggaaaatgatagccccatagacgtccagaaagaacccattaaggaggtgcaaagcgatgaaaaggaactccagagggaacatatgagtgaagaagaacagaaaatgaaaagtacaaataaaacagcagctccagtaagaaaatctcaaaggttgaaaagaagtaaggaagttaaatttgaagatgaagaaaaggaagagatagaagaagataatacgaaagacgaagaacagaaagaaaagaaagaggagatccaggagccaaaaataacccacaatgaagaagtagataaggaaaaaaacgaaaacgaagaaggtgatgatgagcgtgaaaaatccacctcttatgaaaataccaatggctctgaaagcgaaggagttgacgaaggagttgacgaagaactgggatacgagtctgaacgtgaggcagaaggtaaaggaaaacaaattgaatcagaagggggcaacttaaagaaaaaaacggaaaacaaaaaaggagatgatcaacaggatgataccaaaaaggattctaaggacaaaaatgaaccattagcaaagagaactaggcattcatcatccacaggtaatactagcaatgaaacctcgccgaaaaggaaaaggcggaaggcaggctctcgtaaaaatagccctcctgccacaagagtttccagcaggctacgaaataaaaaataatcactgctcatatatagatcgcgataataaacgctcatccgttccatagaggtatctgtatttaatgtagtgtagcagatatagaataaaataaccttaatgaagaaatagaatatacgtatgcttctccttgtctaatcttttgtaattatatatctatttcaattaaggctcagatacttaccataaacataaataaaaagcagaaaggcggctcaattgatagtactttgcttttagttgaccttcaacaattcgacgtcgaaaaccaaagtactgtttggtggaatcaaacctgggaaaccacgtgggccataagcatatgggccagggatggttaacctagctttttcaccaacagacaactttggaataccaacatcccaacccttgatgacttggccgacaccgatgttacattggaatggagagcccctgtcaacggaggaatcgaatttttggccgttctccaaggtaccggtgtaatgaatggtaaccaagtcacctgtctttgggaaggtggcaccatcacctggggaaattctgtcaattttgacgttaccttcaattacttcagacattattacttgttttgattgattttttgcttatactcgagtttaggtgaaaggccttactttaagctttcacgagtttatccaccaaattctttcaacgacgtctctcttccggcaattttttttgcccgaaaaagactaaggcgggtgaggggaattgaacggcactataatgtggaggtaaacagaatgatcaagcgctatatacataagtagctatagattatttatttcaagacggcaaccaacttttcgccagaattcctcccgtgcttaatatcatcaagtaactgtgggatatcatctaacccgttcttgtaaactttcactgggatgtggtggatttcaccatcattgatttttggattgatgaacttaataaattttatggcggcttccttgtattcagggtctgctggcaaagtaaacgtgccaaatgggacgtcgttacctcctatcaaatatagaagggttccttcaatactgacgttttgcctcctgtcttcctccttgatatctttttcggttaaaacggtcaattgaacgaccgtagcgtctaagtcatcagcggcacatttgtacacctgttgaatagtttctgtgttggagacacagtccaccaagtaaggaatgttgttgtacttcttttttatctgttcgataacgtcagcatcgtggtagtcaaaaagttcatctgcaccgtactctttcaacaatttttcatgtttacgagaagcaacgacgatgatcttgctgaaaccgtttagtttttttgccaattgaataagcatctggccaacagcagtggcaccaccccaaaataagatgggttgatctctttgcgctttggagggcttccatgtcatgtccaagccaaaactatgtgtaaggatcataccagccgtggtcaatgagactgggagggatactgccccttctaaagattttacggggccttctggtagcttgtctttaccgcacaatctaaactctctggctggtttataagcagtctcggatgaaatggcagagtactcagcaaaggcaccgtttgaggggaacctcactgaagcaccgtgaataaccccataaatgtaatcaccaatggcaaagcgtgcagcatcaacatttgggcccaactttacgatttggccggctgcatcacagcctaagagggcaccttgaggaccaatcttgaaatcaatatgtttccaatcggtagggttaccggcaacggcgacagtcttaattagaacaaatccttcttctaattcaggaattggaatgtcctgtttgactacagccttgccattttcaatgacaacggctttcatggtttctggaatcgaggcggacatgcttgatatgcagtatgatattgctttttgctgtgtatagttaacgattttttttcaactagaattacagtactaatcaagaagtgagaggaagaaaacggcaaaaaaaaaactctctccttttaaatcgaagcattgccgaaataccttaaaaacggtcttaaatccttaacatctgtccttactaatcgatgccaatccaacggagggagcccatatgctaggtactaagagtacgcaggggcggaaccgcgcgacaaccgtaagcggatccgaggaactttagtcagcaggggctgtgatgaccattaaaaaattgcggacacaggtagtggaacgagcaatcaatgtgatcaatttgccatttcattccacgaaatggtttccattctaagcatgaatgctttgacgttacgggtgttggttatttcggttctttttattgcttccgtgggcacgtacgagaagggaagatgaatagaaaaagagtttccgagttttgtatgtccaatgtttacataatttatataacttgaagtttaatcttggcataaagctctagttgtgacgaagtgtgtaggccatcacatcagttctccagttttctacccaatttttttatggataccttgatttttggtttagggctggatgtctttacgccctttatttgtgttttactgcccaaactagtgccggtctctaaatatttttctgtattagtagtagaatcgttctccattagtaatgctttttttttcttttcaaaattgattgccttgacgtctaagtagttattcagttctttttccttttttagcaactcattcttgctcttctggtaaaattccaggtcctctttactcaacctagtaaaactttcacggtctctcaccaaaccgttatattgtttttgtttactaatagcattagacctaagctgatctcgcagggacttcctggttttccttttatattccgcttcatattttttttgctccacttgctctcgtatcctctgggcctctacattaccaactccttctgacacgaatttcagtggttttttctctcttgcactattagcattattatcactggtagatgacatgatgatataacagagcccacagtcttttgttggaaccgctttctctaggtttcgatggacttacatctaattgaacattctcgtgcgtttaaacgtcatttttccctcagattggaagtgcatcaaaagtaattcctagggacgacaaaaaggcggaaaaggtttcagaaaaataagcggacttagctcagttgggagagcgccagactgaagaaaaacttcggtcaagtcatctggaggtcctgtgttcgatccacagagttcgcaatttgaaaaattttttttaatgattacgcatgtggatgtgttcagtatcaaccgatgctcgcttttccaatcaaatgatacaagccagaccgaacattgcatgttttccattgtaacttcccaggtatatctgaattagttgtaaaaagtaatagtttacccggaatcgtgtgaaaaattttgaaaaaaaaaaatgaagagccaagatacaatgagatgagatgaggtgctgaagatgcatggagattctgtatttatctcaaataaagtacgcaatagagtatataagccaagtcaccttttatatttcttagtttttaacttgcaaagacttataagagacttataaaacaaggagaaaatggccaaaaaagctatcgattcaagaatcccgtcactgatcaggaatggtgttcaaaccaaacaaaggtccatatttgtcatcgttggggacagggcacgtaaccagctcccaaatttacattatttgatgatgagtgctgaccttaagatgaacaagtccgtcttatgggcttataagaagaagcttctaggattcacttcgcacagaaaaaaaagagagaataaaattaagaaagaaattaaaagaggtacaagggaagtgaatgaaatggacccttttgaatcttttatctctaaccaaaatatcagatatgtatactacaaagagagtgagaaaatattgggtaatacctatggtatgtgtattcttcaggacttcgaggcattaaccccaaatcttttagcaagaaccattgaaactgtagaaggtggtggtattgtggttattttattgaaatcaatgtcatcgttaaagcaactgtacaccatgactatggatgttcacgcccgttatcgtactgaggctcatggtgacgttgttgcaagatttaacgaaagattcatactttctttaggttcaaatccaaactgtttagtcgttgatgatgaattaaatgttctaccgctatctggtgccaaaaacgtgaaaccactacctcctaaggaagatgacgaattgcctccaaagcaattagagttgcaagaattaaaagaatccttagaagatgtccaaccagctggttcattggtttctctatccaaaactgtcaatcaagcccacgctattctttctttcattgatgccatttcggaaaaaactttgaatttcacagttgcactaacagctggaagaggtagaggtaagtctgctgctttaggtatttctattgccgcggccgtttctcacgggtattctaatatttttgttacttctccatctcccgaaaatttaaagactctatttgagtttattttcaaaggattcgatgccttaggttaccaagaacacattgattatgatatcattcaatctacgaaccccgacttcaacaaagccattgtgagagttgatattaaaagagatcacagacaaacgattcaatatattgttcctcaagaccatcaagttctgggccaagctgaattagttgtcattgatgaagctgcagctattcctttgccaatcgtcaagaacttgctgggcccatatctagtcttcatggcatccactatcaatggttacgaaggtacgggtagatctttatctctgaagttaattcagcaattgcgtaatcaaaacaacacatccggtcgggaaagtactcaaaccgccgttgtttcgagagataataaggaaaaagactctcacttacattctcaatcccgtcaattacgtgaaatttccttggacgaaccaatcagatatgctcctggtgacccaattgaaaaatggttaaacaagctcttatgtttagatgttactttaattaaaaacccaagatttgcaacaagaggaactcctcacccatcccaatgtaatctatttgttgtcaatagagatactctattttcttatcatcctgtctcagaaaatttcctggaaaaaatgatggcactgtacgtttcatcccattacaagaattctccaaacgacttacaactgatgagtgacgccccagcgcacaaactatttgttcttttaccaccaattgatccaaaggatggcggcaggatccctgaccctctatgtgtcattcaaattgcattggaaggtgaaatcagtaaggagagtgtcagaaattcattatcgagaggccaaagagctggtggtgatttaatcccatggctgatctctcaacaattccaagacgaggaattcgctagtttgagtggtgctcgtatcgtcagaattgccactaatcctgaatacgcatccatgggctatggttctcgtgcaattgaattactgagagactatttcgagggtaaattcactgacatgtctgaagatgttcgtcctaaggattattctataaagagggtgagcgataaggaactggccaaaactaatttattaaaggatgacgttaaattaagagacgcaaaaacgttgccacctctactattaaaactttctgaacagcctcctcattatctacattatttgggtgtttcatatggtttaacgcaatcgttgcataaattctggaagaataacagctttgttcctgtttatttacgtcaaaccgcaaacgatttaactggtgaacatacttgtgttatgttgaacgttttggaaggcagagaatcaaactggctcgttgaatttgccaaagatttccgtaaaagatttctgtcgcttctttcttatgattttcataagtttactgccgttcaagccttaagtgtcattgaaagtagtaagaaagcacaagatttgtctgatgacgaaaagcatgataataaagaattgacgcggacgcatctggatgacattttttctccatttgacttgaaaagattggatagctactcaaataatttgctagattatcacgttatcggtgatatgatacccatgcttgctcttttgtacttcggcgataaaatgggagattcagtaaaactatcaagcgtccagagtgctatcctgttggctatagggttacagcgtaaaaacatcgacactattgccaaggaattgaatttaccttccaatcaaactattgctatgtttgcgaagatcatgagaaaaatgtctcagtacttccgtcagctgttaagccaatcaattgaagaaactctaccaaatatcaaagatgatgctattgctgaaatggatggtgaagaaatcaaaaattacaacgctgcagaagcactggaccaaatggaagaagatttagaagaagccggttctgaagccgttcaggcgatgagggaaaaacaaaaagagctaatcaactccttgaacttagataaatacgccataaatgataacagtgaggaatgggctgaatctcaaaaatctttagaaatagctgccaaggccaaaggcgtcgtcagtttaaaaactggtaaaaagagaacgactgaaaaggctgaagatatctatagacaagagatgaaagctatgaaaaaaccaagaaagtctaaaaaggctgcaaattaagcgttctactctttgtcaaacccttttatagctaaacgtttacttaatttgtacaataatatagaatagaaacatagttgatgtttgaacctttacatattcctttcaatcgtgtcgagcgatataagtattacgattatgccggcgaaaactgaacccgttttagacaatttcaatcaacatactccactccgtagtgagtaacttttggagtaatacgaagtaaccaaagaggtcaaaacggaactatataccccaaaataagcatcattcaaatggtcgaattaactgaaattaaagacgatgtcgttcaattagacgaaccacaattttccagaaatcaggccatcgtggaagaaaaggcttctgcaacaaacaacgacgttgtcgatgatgaagatgactctgatagtgattttgaagatgaatttgatgaaaatgaaacattgttggacagaatcgttgctttaaaagacattgtccccccaggtaagagacaaacaatttctaatttttttggttttactagctcttttgtgagaaatgctttcacaaaatccggaaaccttgcttggactttgaccaccactgctttgttactcggtgtgccactatccttatctatacttgccgaacaacagctaatcgaaatggaaaagacatttgatttacaaagtgatgctaataacatattggcccaaggtgaaaaagatgctgcagcaacagccaattaattttaatgatgtaaaagaaaagagagggttttagaaaaggagccatacatgttccaatgggacactaactaaccaatttattttgtttgcacagttctatttattgctttagagtaaagttgaagaaaaaaaatcttcgttttaaaccgctatatcaatacatagtcatagtgtacccattcagacttctatgaacttccgatgcgaaacatttttttttgcctttttaccttttctgttcattttatctagcattccttaggttaatttaaacaaatgtataaacttgtacatatttcaaataaaaaactttcagttttatttcaagaaagctaaatttcttttggatgtttaattgataaagcgtaaatatccagaaaggtagtgatgtcatagataatatcattgatgaacattccatggatagcaagtgtcaagccgagtcccatccaaaccaatgcagaaactatgcttcctttttggtaatctaaaacgtaaaccataaatgcgtacaataccaattggatagttgggattaaaaatgggaaattgaccattgggaatggttgcatggttaaatgagcaataatcatccgaccaactacaaaggcaaccgaaaaaccaatcgataaaattaaagccaaagaaataaaagatggttgaatcaagactaaggtaaaaattgaagagaagtatgcaaagaatggcaaaagaccatttactgctttacttatattttctgcagttttgcttggagttgcagatttggtcgattgggattcgtaatacctcacgacgtttgtatgagctgtgacaatattaaatattaatgctcctgtgcaaaatgcatacattagatgaacggtttcaacatcaaacacaaaatcttgccaggagaattgcgctactttagtgtgccagatggtttgaggtccgtaaattccgactgcaatgaaagaaatacacaaaacaataataccttcaacaggaccgcagaattcagctagataaagtttgtgggtgtgatactcttcccatgtgctcaagtaaaagctgcacaatatcgcaaattgtgaaaaaatggtcatatatgtgtaacccatacctgtcatggaacagacaggaatcattgacaaagttgtgttgattgaatcaatacaatggtcaaacaattcccctagagggccctgctggcctgtacgacgtgcatgcattccatcgcaagcatcaaaagtctggtataaaaacaaacctatagcataggagaaataggtccaacgtggcgattcctggtcaaaatacgggtcgtagtaaagtgttgttaacacattaaatataataaagcagaaccctaataatgttaccaaattgggtgccatccatagtggaaaaatagtcgcaaactttctccaaaagggcctcaatacatggtttgaaaggaaagagcggtcatcactttgatacctaaagtcagattagtaatttaatgttacaatagttagtatttatttttcttgccacagaagatttagggtgcaataagataagcaacatacttgtaaagcttcaagtttcccaaactactctgaggaataaagaatcccattgtttcccctgaatcagttagtaatactgttttcgaatccatggtagatgattttcaaattcatgaattcagtatccattaaccttttgctatctaatctttcatattggcagaacgccaaagaaaaaaaaaaaaaaacgtcacttcccgcgaattttcacatgcactttaatcgataagtttcagtaatagaactggactataggaaacaacaatataggaaggattgcacaagatcaatttttatgcaataggaaatcttgttatttggtaaatcagcgagatgttgtatgacatgcaaatgcttcactattcgggcaattcgcattagcacctgagtatatatctgacataaaaagatttctgaagttatcgtcagataagaagatggagtcaaaatgtaaacaataactttaacctatataaattttcttacatttgcttttaaatactcgaagatttgcattgaacgatcgttgccgttgactcatttgaaacagaaaaacaatacacgcaggaaaggaacggcagttggtctgagaaacaaaaccaacttgcattttaggctgttccgatagtttatcagagtaagggaaaaaatagcgtgcaaaagctatcgaagtgtgagctagagtagaacctcaaaatatgacttcgaaaaaagtgatattagttgcattgagtggatgctcctccagtggtaagacgacaattgcgaaacttacagcaagtttattcacgaaggctacattaattcatgaagatgacttttacaaacatgataatgaagtgccagtagatgctaaatataacattcaaaattgggattcgccagaagctcttgattttaaacttttcggtaaagaattagatgtgatcaaacaaactggtaaaatagccaccaaacttatacacaataacaacgtagatgatccctttacaaagttccacattgatagacaagtttgggacgagttaaaggctaagtatgactctattaatgacgacaaatatgaagttgtaattgtagatgggtttatgattttcaataatactggaatatcaaaaaaatttgatttgaagatattagtgcgtgctccctatgaagtactaaaaaaaaggagggcttccagaaaaggataccagactttggattctttctgggtggatccgccgtattatttcgacgaatttgtgtatgaatcttatcgtgcaaatcatgcgcagttatttgttaatggagacgtagaaggtttactagacccaaggaagtcaaagaatataaaagagttcataaatgatgatgacactccaattgcgaaacctttaagctgggtgtgccaagagattctaaagctttgtaaggattaggaaagcgccacaaaatcgatgagaagtataaaaaaaaaaaagtaaaaacaataaaaataagaatgtgtacctcgatagataacttaaataagacaatttcagaaccacaatattgataacaccatcccgatttttgaaattatttttttggtgtaaatgagagaggaggggagtgaattagaaatggaaaaaggcttccttaaatggaaaccagtcaacttgatgaagaaaatattgtctttaccaatgaaaaaaactaaaaacgatataggtttgagattagatatatcatatattttagttaatctaatagtctgctcatacccggtaaacacgtatccaaaactgctttataggaatagcttggatgacttaatattgtttctaacagtgtaccatggcaagggaaattttagaatttttaattttagaggtgagaaagaagacagcgattataaagataatgatcttattggtatcgctgccaagtttgagagcaaagattttgaaattcaagaattacgttcgacgctgattaatgatggaaagataccaatatcacccattgatctcgaaacaaggaccttggtcgaagaagaaaccaataatgtaatttgtgaaaggatcggttggctagatcattttccaccgccatttgaactgctggaagagattgtagatggtatagaaaattacctgtccgtttcgaagaatagagtggctgttttacattgtcgaatggggaaaggccgatctggtatgataacagtagcatacctcatgaaatacttgcagtgtcctcttggagaagcaagattgatattcatgcaggctagattcaagtatggtatgacgaatggcgtcaccataccctctcaattaagatacttaaggtaccatgagttttttattacccatgaaaaagcagcccaagaaggaatttctaatgaggcggtaaaattcaaatttaaattcaggcttgctaaaatgacgttcctccgcccatcaagcttaatcacttccgagtctgctattgtaactactaagattcaacactacaacgatgatagaaatgccctcctaacccgaaaagtagtatattcagatatcatggcgcatgaatgcggtggtaatatgaccttcatttttggtagggactacttaacactggaaaatgattgtcgtatagaatttaccctggggaccagcaagtccaaagccgccagtagcataatatcttggacttcatgcgccagctgttggctgaatatataccttgagactttgatgcacataattaaagacgattcttcgccagattactttcaagtagagaggttaaagagagacgaaatgcttggaacaaccataagctggcaagagctggacggttttggggagctcagcactcacggcttgaaattatttcaggcactgaaattggaatgggaaattatataggtttatgcatttcgtcaaatccattcattcgttaaacttagttaaaagtgttatatttattgtgaattggtttgttttggtaggcttttttctatattatgtattcttttccttttcttcaatattcttgtatggtactttaatttactggcaggtattttttggagcggtcaattatatgaatcaaaacgccattctagaaacaggaagaaatatatgagaaccaaggagtaggttgaaaggcattgtagagaaattttattagtatttatagccgaagaagaaggttaagtgacaaattttcatttataagcctcgctaaaatgaatgctagtggaagatctcattccaaaggccccattataaggtctgtgtctttagaagatcttaagagaaactctagtttcaaaggcaatctaaagtacaaagatgaagtcacttcacataaagaaccacaggtcggaacattgagcaacgaagaactgctaaaagatttggacaacatgttgcgcggtaaactgaacatgggaagaaacagttttcatgccgataaaagaaataaatcagatggaaatatcagtgccttaaccttcaaggcaagatcaggtcttgagggagatattcgtaccatagatatacagcaagatagtagtgatgaaaatgataattttaagttcagtgatgatggcgttaataaggatagaaataatgagaaagataataatactgataacgccgttgaatttcaagacgatgctgaagaagctgaagaggagaatgaggatgaatcatttgctaatgtagatgaactggatggctttgatttgaataaggtttctgatggcaagcatgttcctatcaatgaaaagggcgaagttgattataatatgccggtagataaagaatttcagaaatcacttgaccagtgcgcagcttcacttgaggaaagatcaagtgcaccttatgctttacaaagagcagtggactgggaattgaagatgttttattctttggaagatgaactgtcggaatggttttgcagctctgattatatgcattttggacagacacagactctgtttaaacagaaaattacgcaaccacaattattctttgatgatgaaaactatgctgcgagcgtagttgaatgtttaattgaagacatccccaattctttagcatctaatttactcgcattatcatatatttctatgggatgctttgcgtttacgaatagcaaaagtgagcatacaaagattatacgacgcaacaatttaatgcttgttcctcatattcaagaaattgttcatgccttcaagaagattgcaataagttgtagggatgacaacagaaatttaaagaaacaaacaattttgctatttcattcgtcaacaatcctatacttcatatgcagtatttgtatagaaggtagaggagaaaatccggaagcagtaaatgttgttatcgacgcttttgagaaaacagatttgttggaatttttaacaaagtatattgaaaattggaggtggaatagcagattagctatgcgcataagaaatatgatttctttgctcttcaagcttattgtattacaatttggtgacagttctgtctacaaacagaccaaatcatctatttataatctccatggcttaacatatccatcaaagcatccagaaaagctttctatctccccattacattatcaagcattcagggaggacattacttcccgttttcctgattacaatatgcccagttctggcttacctaaagatgttgacaaatcagaatctctttcccagtttctggaaattcctcgtccaaaatcaaagaatcctctaaatatggcgctcattgttcctgaaaaacatattgctacacctgctccttcaccgccaagctctccacaattaatgcatttaggtgaaggtcctagacctcgtaaatctttccaaacaaacatggcatatccgtgtttgtatccatctgataatgaaggatctgaagatgacactctggaagataggatagatttaaatatagagagaaaacctgataacgatatagttattccattcagtaccgaagaggcagcgagaatattaagcgagagtttagaaattaagctgagtacaaaacaactttggtacgaaagggacttattcatgataactgaacgtggttggaaacagcaattagaaaatgagccatatgattatgccgcgcttaatcatgatgcaaactcttcaaaagaggaaaaaagtgcgatttgcattatgcagcgaattgacaaatattataagagctgcctttcgagctttaactctcttgtttttgtcttactgcaaacaatggaatcaagcttgacaaataactttcataggaaaagtgaagtctccgataaaaatcttctaaatatgctgacaccccaattggagatcgtgagagctaaggaattgtccctaaagtcagcagcgggcatattacatgcgttattgaagtggtttaagttaagccatattttgaaatttgaacacttggcggtagttattcacgattcgcgatacatcaacacatgcgcatctattttaagcaaatattctgaggtttatccagagagggttttcaataaatatgtacaaaccccgaattcattttggaaggagtgttctctctctaacgagtcttatcgtgaatcctattcagtagatgactcaggagaggtcgacacggagattatgccttcgtttgcatatctgttaagaatcttgagaaaagtcacagggaataaaacacaaaggttaaaggagctgcccctctccatcggcattctatttaaacgctattatcggctcttcaaccttgacatgtatcatccaatattgaaaataacaagagaactcacaccattcaaaaacaagaggtggaaatccgagcatatggaattgatatcgggggtttacctttatgaaaagctggagttaactgataattgggtaacagggaaggatatatcaggagagttgagcgatgcttgtggtcaagaaattgcactccgggccttgcttcaattttacaattttcaacactatgaaatatctatggaggaccttggatatggacaccgtaatagttccagccaagatctgttaaacaaggaatccgagtatttgaatatttaaatctctacttacggataccgaggctcggggcgcgatgttattgtcattaacaatctcctatccctccctatgtttatatagttttcaatggaggagcatgaaaaccccttaaatagtgtttatttgatcgcgcaatggtgatgattggatcttcatatcacaagtgggatactaggacaaccgttgttggatttctattatcataatatatacgggtaacgatttttgatgcgtcgcgtttgtaaacaaaactaaacaaaacaaacaaatatactcatttgatggcttcatctgcatataagaaatagaagagccagaatactaagcataaccataatatatattacagtctatttcagttgtagctgaaaaatcaatatggaactagagcccactctttttggtataatagaggcattggctcctcaattattgtcgcagagtcatttgcagacatttgtatctgatgtagtcaatttactgcgatcatccaccaaatcggcaactcaattaggccctttaattgatttttacaaattacaatcactagattcgcctgaaacaacaattatgtggcataaaattgagaaatttctcgatgctttatttggaatccagaacaccgatgatatggtaaagtacctctctgtctttcaatctttgcttccatcaaattacagagcaaaaattgtccaaaaatcatctgggctcaatatggagaaccttgctaaccatgaacatttacttagcccagtgcgggctccaagtatatatacagaagcttcatttgaaaacatggaccgattttctgaaagaaggtccatggtatcttcgcctaatcgttacgttccctcttcaacctacagttctgttactttgagacagttgtcaaatccttattatgtgaacactatacccgaggaagatatcctaaaatacgtatcatatacattattagctacgacatcggcactatttccgtttgatcatgagcaaatacaaattccgtctaagatacccaattttgagagtggacttttacatttaatatttgaagcgggtttattatatcaaagtttgggttataaagtggagaagtttaggatgttgaatatatctccaatgaaaaaagcattgattatagaaatttcagaagaattacaaaactacacagcatttgtgaacaatctggtctcttcagggacagtagtgtcattgaaatcgttatatcgtgaaatatatgaaaatataataaggcttcgaatatactgtaggtttacagaacaccttgaagaattgagcggagatacattcttgattgaattaaatattttcaaatcccacggagatcttactataagaaaaatagcaacgaatttgtttaattcaatgatttctctttattatgagtatttaatgaattggttgactaaaggtctactccgagctacttatggagaattcttcattgctgaaaacactgatacaaatggtacagacgatgattttatttaccacattcctatagagttcaaccaagaaagagttccggccttcataccgaaagagttggcatataaaatattcatgatcggcaaatcgtatatcttcctagaaaagtactgtaaagaggttcaatggacaaacgaattttctaaaaagtatcatgtcctgtaccagagcaattcttatcggggaatatcaacgaacttttttgaaattataaatgatcaatattctgaaattgttaatcatactaatcaaattctaaatcagaagtttcattacagagacgtggtatttgcgttaaagaatattcttctcatgggtaaatctgattttatggatgctcttatagaaaaggccaatgatattctcgcgacaccatcggattcattgccaaattataagttaacaagggttttacaggaagccgtgcagctttcttccttaagacatttaatgaatagtccccgtaatagttctgtcattaatggattggatgcgagggtactcgatcttggacatggatccgtgggttgggatgtttttactttagattacatcctctacccccctttgagtttagtattaaacgtaaatcgtccttttggcaggaaagagtatctacgaattttcaattttttatggagatttaaaaagaacaattatttctatcaaaaggaaatgttgaagagtaatgatataatcagatcattcaagaaaatcagaggttacaacccgctcatccgtgatattatcaataaactttctagaatcagtatacttagaactcaattccagcaattcaactcgaagatggaatcttattatttgaactgcattatagaggaaaattttaaagaaatgacccggaaactgcaacgcacagagaataaaagccaaaaccaattcgacttaattagattaaataatggcaccatagaattaaatgggattttaaccccaaaagctgaagtactaacaaagtcttcaagcagtaaaccccaaaaacacgcaatcgaaaagacgctgaatattgatgaattagaaagtgtacataacacgttcttgacgaatattctttctcataagctttttgcaactaacacaagtgaaataagcgttggtgattattctgggcaaccatacccaacttcattggttttacttttaaattcggtttacgagttcgtcaaagtttattgtaatttgaacgacattggatacgaaatcttcattaaaatgaatctcaatgatcacgaagcatctaacggattattgggaaaatttaatacgaatttaaaggaaattgttagccagtataaaaattttaaagacagactgtatatttttagggcagatttaaagaacgatggcgatgaagagcttttcttattgagcaaatcgctccgttaagaaatgatcccgtcccgtttttcatttataataaatttcctccacgcaggtttaatgtataagttgtaatggtagcaaatgatttacagatttatttgcaagtaaagagactcttttttcgttttgtttttcctggatccgcaacacaaagtgtattacatatggatacatggaatatctttacagtgctaaatatattaggttaaaaaaaggtcgttttctgtaaagaatgctttttcagcgttaactttacgtctttttgataataaagaaatttaattaggtgaagcggagatattgaatattatgtactaatgatatgatgagtaggcgacgtaactatcgcgtatataacatgaatcaggtcgtcgaaaagaactagaccttcattggatataccattcttaggaagtattttttaatgcccggacctaaaagaaggtcatatttagtctttctttcttttaatttaccccaatcttcatcggcagaatcggtatcgtattcgcttgccttccattcttttaacttctcgtttgtcatagcttgtctttccgttaatttcatcctgatagaatattcacgaaggatagaaattaaaattagtgcggcaataaagcagcaaccgcaaaaaatttgtgcatgtaagtaaggattgctcttatctttctccaccgtcaatgcctgggcaatcacctcacaaaccaataagaaaggcgcaccacagtagttgacgaaggcccaagcgggcaaaaactcttctggtttaaccatatcggcaatcagaacggtattcatgacgttggcgacaccaacgcatgagccaactagaattgaaaaaaagatgagttgaacaaacgtatgagcggggatccagaacgcaaacatatatattgttaacaaagtggttaatacgatcgttacgtttgccctaccaaacttatctcccgctaaacccatcagaggtcttccgatggattgcgagccgttcaaaatggcagtcaatgtggaagcgtcgtgcgatgataatcctttcgagattgcgtatgaagataaagtaaaaaccatcatattgtaggcaaataatgcgaacatgaaccataatgcaataagtaccacaaatggcttagttataacctttaatgaaaacattgctttgagctgttcaaacatggcccgaggcgatttcaatcctatggcaggtgtagggtttctttcttttaagagcgcaatagcaactagaacacttatgctacacgatatgcctatgatacgaaggcaccaccgggtatttccaaagtcagaaagcattttgtttgtagccaaaccgtaaacgacaccaccagcaccggtacccaataatgagacacccattgcgacagctctttttttcaagaaccatcctggtaagacggttgttgctggaacgaaaatcagtgatattgaacaaccgaccataaaaccttgggtgacatacaattgccataacttggtagtaaaggaggccaagagatatgcggcaagcattacagcatcaccaaaaagcatggtggtccgcagaccaattattctcatcagtgccatcacaaggggggataagagttgaccgagaaagacagttaggccagcaattaaggcataatcgtacttcgaagcaccagggtaagtatcatggtttaagtagtaggcaaggtcgacaccgaaggatgcgttgcagccccacgtggaaaacatggtcaagaacacacagaatgtcacgacccagccataaccaccgtcggggggcagttccagctgcccggtagacttgttggtgaatactttttttacagtcggttcatcaggctcgaattcggttattccttgggcctcaagatccttaccggagtgtttcgtggaagccggatatagtctattcctcatgagtttggagtccatggaagctttatgttctgtagtatcattttgaatagaagaagcagagaaagcagaggaagatggtgccgacaacgaggcgcctgcagtcgtggtgtgtgtgactgggatgtttaactttgactggactgactcattgtgctgtagcctaatggcatcggccacgtcaaatctagattctaatattttattaacgtctgcggaattttcttccgtctgcaagttgtcgtcatcgacagcctttttaatgtcgttgagccgattagttaacgtcctactaatagacaattttctcgatgcatcgttcgacttggtgctgtgtagatcagagcatggaaccggagcagcaatagaagccttagagaatgatacaggctgtgaagagtttatcgaagaaacctcggacgatgtctcagagaccattccggaagaagcagaaaagtagtcgtttgagtgcgttgacatttttcagatttattttcagaagccccgtaattatacctaaagaaaaagtaaagaaaagtggagaaaacaaaagaaaaagataaaacttttaaatatgtggtgtgacaaatgcaaaatactattctgactcgcacatttaactaacaaaagaaaatttgtctaagtctagcagctttggtagaatatagaagaaacagtctagttttggctccgatatgagtggacaaagcatcaagatctaaggaatgccaagtatttatccaggttctcccgaagacttttcttcaatagcggcgggggttttttttttttgcagattgccgagatagcccgcggcaaagatacgttatctcggttatcgtcggcaagcgctattgtaactagatataggaaactgtggtctgcaaagatgcggtataaggcctccgtctgttcttactgcgttatcagcctttgacagttttagttcgtcagggtctttgaccaaatgataaattccctggtttacattttcactagtttgttctcgagcaatgcttagttggcacataaatgagtcaggcactaccactcgggtaacggtctgcgcgtttctttttgcggccatgaaatttttcaggcgatgagcttaaaggtaaaggaaaaagatggtaggatgataggtaggatgaagcggtatgaaagtggaagaagcacaatatagcacgtcgaaacagtgctaatcatgagcgatgacttgttttctaaggctttggagaatcccgaccaggacttgaacgtggaattgcccaaggatgatgttgatttaggtcttttaggtgatggtgggaacgagaggaagaccgatgaaccggtagcagacgcagaaagatcaacaggcctaggatccggctcttctgaatccgaatcagattccggttctgattctgattctgattctggctcttcaggtagtgaggatgattctgcagatcaggacgttgaaggagaggacgaaggtggtgacgcgattgaaaatgaagacgaagacgaagacccttcaccttccggtcctatactatcgaagaacgaaatactagaggaaactgttcctgaactaccggaagattatgaaatttcagaaaaaacgatcatcactcctattggtgttttgaagtctgcatttgaaaataatataatcattcacgccacgatgtcgggcgaaaagcgtgttttaaaagagggttccattttctgtctcgaggatagaactttgatcgggatgttgacggaggtgtttggacccttgcaaaacccattttatagaattaagttgcccgattcaaaaaaaaacttattcgatgaattaaaagtgcgtttgggtgagaaagcctttatagtcacccctgatgcccactggatagatactttcgagttaaagcgcaacaaaggtactgatgcgtctaatgggtacgatgaagaattacctgaagaggaacaagaattttccgacgacgaaaaagaggcccttttcaagaaaatgaagaaacagcaacggcaacgaaagaaaagggacaaccgcaaactagccaacgatagtgacaatgtcaaggtaaagagagctcggcagcccaaggccaacagtttacctaaactggtaccgccgttgggcatgagcagtaatgctccgatgcaacatgggtacaaatcaagaaacgcacgtgaaaatatcaagcgtgaatccagtgctacctctaatcggaatggctcctccccagtgccaatcacacagcaccaccaacaacagttttctgcaaataattatcccttccctcaacaaccaaacggtatgccttatccaccatactcacctttccctcagccgactaacttccagtatccacctccaccatttgggcaggcgacaccggcccaattctccaacactgttccatatggtagcttacctcccgcatacaacaatatgtcgccgccaacacagcagtcgttcatgccaatgacccaaagtcaaccgccacttccatatggcgtacctcccatgaatcaaatgcaaaacccaatgtacatccaaccgccacctcaagcacctcctcagggaaatggtaatttccaacaagtaatggaattacatcaaatacttttgcagcaacagcaacagcaacaccagtatcagcatcagcatcagcaagatccaagaacctagagtcacgattgaaatatttaataataaatgctatgtatcatagataaactagaaagaggcaagaaaaatttaacaagtttcttaattgaatattattttactgtcactaccattattagacgccatctcagcgtgtgacatgataatttttctttttttctttttttttcctcaaggcgatgatatgaaactttcaaaaaatttatatgtaaataaaaaagttctacgagggtttaaatacggaagtttatttagaagatatttatactctgaatacacacgtagagtacagtaaaggttttttagatctactaatgaccatatcgttgagcaatataaagaaaagagaccattctaaaatttccgatggaacttctggtgaatcatcgcttgtaaaaaggaaacagttggaaagcgccaccggagatcaagaggaagaatatacagaccatgaaatcattatagagccgttgcactttgctaataataataacactgtactcacagattcagaaaattatctaagatggcaaaataccatctccaacgttgttaaatcagtggtttccattcatttttcacaagttgcgccattcgattgcgattctgctttggtatctgaagctaccggatttgtcgtggatgctaaattaggtataattctgaccaataggcacgtcgttggtcctggtccgttcgtaggctacgtagttttcgataatcatgaagaatgcgatgttataccaatttacagagatcctgttcatgattttgggttcctcaaattcgatccgaaaaacataaaatattctaagatcaaagcgttaacgctaaaaccaagtttggctaaggtcggctcagaaattagagttgtcggtaatgatgccggtgagaaattaagtatcctagcaggttttattagtagaattgacaggaacgctccagaatatggtgagctgacatacaatgacttcaatacagaatatattcaagctgctgcatctgcttctggcggttcaagtggttctccagtcgtaaatatagatgggtatgctgtggctttacaggcaggtggctctacagaggcatctactgatttttttttaccgttagatagaattcttagagcgttaatttgcatccaaaccaacaaacctatcacacgtggtacgattcaagttcaatggctgctgaagccttatgacgagtgtagaagattaggtttaacttcagagagagaaagtgaggctcgtgctaaatttcccgaaaatatcggactgttggtagcagaaaccgttttaagagaaggcccaggctatgataaaattaaagaaggtgatactctaatttcaataaacggtgaaaccatatcttctttcatgcaagtggataaaattcaagatgaaaatgttgggaaggaaatccaattggttattcaaaggggcggtgtcgaatgtactgtcacctgcactgttggtgatttacatgctatcacccctcatcgttatgtagaggtttgtggtgcgacttttcatgaattatcatatcaaatggcaaggttttatgcgctacctgtcaggggtgtatttttaagtagtgcatcagggtctttcaactttgattcaaaagaaagagtgggttggattgtggattctatagacaataaggaaacccccgacttagatacatttattgaaattatgaaaactattccagatcgtaagcgcgttactgtacgataccaccatctaacagatcagcattctccacttgttacttctatttacattgaccgtcattggtgcaatgaattcagagtttacacaaggaacgatacaactggtatttgggattacaaaaatgttgctgatccacttccagccgatgcgttgaaacctcgttcggccaaaattattcctattcctgttaataatgaaaaagttgcaaaattgtcatcatcgttatgtacagtggctacaatggcagcagttccattggattcactttctgctgatattttaaaaacatcaggcttaatcattgatgctgaaaaaggttatgtcctagtgtccagaagggtagttccacatgattgtcttgatacttttgtcaccattgcagattcccttgtagttccagccacagtagaatttctccatccaactcacaacttcgctattgttaaatatgatccagagttagtaaaggctccactaatcactcccaagctatctaccaccagaatgaaacgtggtgataagcttcagtttataggttttacccagaatgatagaattgttacttcagagaccactgtcaccgatatttcctctgtaagtattccaagtaatttaattccgaggtaccgtgccactaatttagaagctatatctatcgactgcaacgttagcaccagatgtaattccggtattttgacagataatgatggtacagtaagaggtttatggcttccatttttaggcgaaagattagaaaataaagaaaaggtttatttgatgggattagatataatggactgtagggaagttatagatatcttaaaaaatggcggtaaaccaagagtaagtatagttgatgctgggttcggttcaatttccgttctgcaagccagaattagaggtgtgcccgaagaatggatcatgcgtatggaacatgaatcaaataacaggctacagtttatcactgtttctagagtttcttatacagaagacaagattcatttagagaccggtgacgtcattttatctgtgaacggaaaattagtcactgaaatgaatgatttgaatggagttgtaagctcagctgatggtattttgccatcagccatgttagattttaaagttgttcgtgatggtaatattgttgatttgaaaattaaaaccgtggaagttcaggaaaccgaccgttttgtaatatttgcaggtagtatcttacaaaagccgcatcatgctgttttgcaagctatggttgatgttccaaagggtgtctactgtacattcaggggagaatcgtcaccggcgctccagtacggtatatctgccacaaacttcataactcatgtcaatgaaattgaaacacctgatctagatacatttttgaaagttgtcaaaacaatccctgataatagttattgtaaaatgaggttaatgactttcgacaatgtgcccttcgctatttcactgaaaacgaattatcattacttccctactgcagaattgaagagggacaacatcacgcacaaatggattgaaaaggaatttaccggcaacagccaaagtgaaaaataggccagatttgataaaacatttatatatgtatgtatgtatgtatacatcaaagtcttccataaagaacagtttttttatagactatcacaggagcgttaagatttacaagtttttcaatcattttgaggggttaggattatgatgtcgagatggttgcaagcgcctgacgaaatagtatttaattacttcaacgcttgaattctctaaggtattatcgattgtataaatttatggttattgtttcatacttatttatatacatgaagaccgaaagcaaatactcaaacaattgatttggggttaacggtgcgtttggtttagaggagaacataattattccaccttcaatgatagggtaataaccgctttagatgctttgaataagctggatgggcaattttccttccggttaaggcttttaatgatctatgggaccagcctatattgccatgttttcttccagctatgcctcttttaaaagtattaccggtacgcctccacctctttgctgtacctttatgagttttcattaaagttcttattgttattgtagaaacgttattgaatagaaagccgttgagcttcactttgaaactatttgaacctttaagtagtggtttgagtacattgaaaacagacatgttttggttttggtctcctcgttgccgtttgttatgcaagctaattttcatgatagatatatatactatcttttttgtatttgaccagatttttttaggctccgcaaattggcgagggcttcaaggttgaaaaaattggttgtggtttatacgcactgctaattatttacagaatgaaagagaaaaagaaaaagatatatatatatatattagaacatgcatacgtgtatattgaaacaaaaatgaaaacaaaaattttcaaagtgagatgtcaatgtcattgctgctcttcctttgtcatttagtctactttgttacttagtttttgtcttctcctaaaagtttttaagtttatgtttactgtttacattaaaccctgttcgcgtaatttagctaaagtttcttgaatctttttagccaatactggatcagacctaattctttgttgaactttagcggcttcagcaaaagtaatggcttgtaatttctcttccatagttctagccaaatcagcggattcttcgaataatgtaatagcttcatcgatatcttcctgctgcaatttcatttgagctaaaccgattttagcttgctcacttcttgggtctagtttggacgctttttctaataaattcgtggcttcaataaaattttctactgttggatttcttgtcaacaaagtggctttaccgaccaaaggcgcaattccaacataaataccatccaacttgttttctaattcaatagccaaatcgtactgcttcaaagccttgtcaaaatcgttcttgtctgttaaaatttcagcaaagaaatttggaacttctggtgcctctggaaattttctcttagcttcactaaacaaagtttcacagtcatcaaacttgttttcacggtacgctagacatgctaattgaatataagggaagatattctctgggtctaattccttagctttatcaaaatcttttcctgcttgatcatagttttgtaaaatgaaattcatttggccgcggtgatagtaaacagaagaattgtttgagtccagtttcagcgctttatcgaagtagttataatattcagtcgagtcatttctatcagccatgattaatgccatgtagatatatgaattgactcttgggaacaattcaatagctttcttgatgtcttcgtgagctcccaatggatcgtttttcaagaacttgaaaatacctgtgtgttctaatgagatggccaatttttcctttaacttttcatcctcattgttcttgtccaattgttcttcaaataaccttgcagctttcgtgaaagactcatcagccttgtcgtaactttcgggagatcttttgtacaaattacttaaaccgttcattaactctttatcagcttcattggattcatcataattggcaaaagtcaactcgggtttgaaaataccaaagaaagaggccatggatgtaactgaaggcaagttttcctgcttgtctttgcgttctttagctggttgggtggataattcagttggagtagcagtagcggtgtcaatatcgccaaacttttctttcaatttagacatagcttgcttattcaagttcctctccaacattggttcaatagaggcgtcattgaagtcaccatttagagacaatacagacaaatcgaacatcgcatccgcaaattttcctagcccttcgttagcagaagctcttctcagtaaaacttttgagtagtctggttttaattcaagagccttagtactcatttcaacaacttttttcaagtcacccacagaaacatagcaagccgataaattcgagtagaaaactgggtcttctttcaattctaatgcccaattatagtacttaatagcatcgtcatattttttatttctaaagaactggttacctttgtcctttaacgctaatgcatatttatccttttcttcagcggtgaaatttgccttattggaaaaatctggttcgccattactagaaaccgggtagataggaggatttgatggggctgtagatttcttagcaccttcagtctccttttgagagtcctttgtgtcctttttttcatctttgttgatcgtgttcttttttcctcgttgttgttgttgttgcaattggttgtaataatagtaggcaccgatggcagtacctgtagcagcaacggttgccaaaatggctgtcttgttccttgtaatgaagctcttcattggcaattgagaacctagatgtgagctgtaatttcacttccgaatcttgcttctcttttatggtgagtggtggagttcctcttaattcctttaagatcttttccactggtcgtccaaacacaaaaggtggtttaacgccatcttattcatcgtatacagtgatattgtatattttaaactaatggcaatgaaactctttctttccttccacttaatccttgaatgtttgtttctgaaatgatataacactgttgaaccttatggaaacatttgaagttgcctgcacagtgtttctttcaataaagtcatctttattatttttgaatagttgacttaattacatcatcattatctacgtattatggagtttttttcagttacgcagtgaaaaactgttatagtaccgatgagatgagtgagacgagcataaaattaacttcggtttctgtatttgctattgtccatccctatcctagttttaaaaatataattctatcaagttatggagtgccagaggtgccctgcatctgccagaaatccagcgacagttgagtctagaaaggaaaagttttgcgatgaatgtttcatcaagtttgttagtactaaacaaaggaaacaaatgatgaaggatgaatatttcaggaacctatttaaagttatatacccatttgaaaaagaaggatccgtctctaagattctgctccccttatcacattctgattcaggatctctggttatgttagatattgtgcacgacttgctattggaacaaactaagcaacacaataatcgtacaggctttaccgtcgatgtactcacggtattcaccgaggaaaatgtttctgttatcaaagaacgtatggaatccttgattaatgaaaaaatgtcacaactgaataaaatatccaacatatttaatgtccattttattgatgttaacgaatttttcaacaatgcatcggaagtatcgacttttatcattgacaatgaaaattttgagattttcagcaagtcaaagtcagtagatgatagcaatatattaacattaaaagaaatattaggcaaatactgtctcaataattcatccaggtctgatttaatatcgattataaaaactcaattgatcaagcattttgcatacgaaaatggttataatgccataatgtggggacattccatgacaaagctatctgaagtaattatttctcttgtggtaaaaggtaaaggttctcaaatagcgacgtttctagactcggaatcatttgatactttgaataataaaccatgtaagtataaaaacctatatcctatgaaagatctattatccgtcgagattgaaagttttttacaaatcagaaatctggcacagttcctcattaacgttgaagaaactaatgtgaagcctaattgcttgatcgccagaaaatcactgccgtcacttggtcaacaaaaattggtaaaaaatatgacaatcaacgaaattaccaacaaatactttcaggatattcagaacgattattcaaatataatatcgacagttttaagaaccgcagataaattgacgcaacctaaatcaagtatggctaagccgtcacaatgtcaaatatgtcaatctaaaatatacacaaatccatccaattggttaaataggatcacagttacttcgccttatcctgtggagaccactgaagaaaagtatttatttaaacagtggcaagattcaaaattagggcaatctcacacacattatgttgaattgttgaatgaaatcaaacagggtgccagtaatagcctcgatgttgaagacggtgatgtcaaattgtgttatggttgtttaatcttattgaataccagtatcaaggataagaatttggtttggccaaaagtcgataccatggatattacggcaaatgcgaccaataaaaacaaagaattgagccaaatattggatcagttcgagattaattccgatggggaggaataatgaaatgtcaaaggcttcgctattccaatggttatgtatttatttatttatttagcaatgtattttactttacatcgcttcggctgccttcatttacagtgtgtctataaaacgtataacacttattctttcacttcctatgcaaaatgcttaataattcattagaccctgaagttccattcgaacggacgtcgaagttgggctcatttattgcactagacctgttttgcagcatatttagtagtttatttgaggaattttcgttgttatcagatgccaaggaatatccgtcagttgcatatacattattattgaaggcgctgctgtttttattaccatgcaatatattcagtaattcatgagaactgtccttatttgaaatattctcatacccatcattaagaggcttgggctttaagtagtttaataactctgttgaattcttatctaattcttgattatttgtagcgtcgttgcgtttcattgacgttgacatttcacttgacggtccaccctcagtgcgagggtacccggtagagtcgttctttttcaaaatattcaacaatcctttagctgaatttttctgcgagtatgagtcaacattatagggctgttttggtgctgtaatgtctttttccttttgttttaacattcccaaaagttcgcttgcattcgcatcgtttatacttgaagttgatgcattttcttcgctattttgaggttttgacacagaattcctcttcaacatcatcatgatttcttcatccccacttagatgttgagattttggtgattgctgatttgaagatacagtagaggaaattgggtttcttagcatctgtaataaatcttttgatgaagacacattggagcttgaatcaaaagcttttttatcattcgccagactggcaaaggtttcacctcgttttagtattttaactttgggtaccttttttacagtatttgttgttgatgataacccgacagtttcgtttatagatttattactttcagtgggcatatctctatgaggcacttcaccgtcttggaaattgttctcttttaaaatatcttggctaattaatttggagttgtcttgagtttgttccagttcttccaatttttttccatcttcttcgtcagaactgctttcgaagacttcatatgcatcactatcaccaatgtgaatttcttgacgatatttattctgcattcctactgatgaattctgtttactctgagtcgagggtgaagatttaccaggcccccattctacactattagattctgcagaagcgttcaagtttgttttgcttgcgtcgttccttggtttttccttttgacttcttcggctgtctttttcgcttggcataacgttcaccccaatatctacattcaatgaatttctttcatctctagctgtctccacctcttcatctgaactactctcgaaatcttcatattctgcatcttgtataccagatacggagtcatttggtaaaaaggaagtatctggtttggaagcgtgtatcttctgcgatgatgttggttttttcaacaaatctagcaaagcttgagagtttgaatgagcagtttcatcattattgttttgcttgattgaattcaagtccgttcctctctgtaagattttaagctttggctttttgcttgattgcacgttgctgtcaggctttttcgaatttagtatatctaacaactgcccaggggaggagctgctgtaaccagagtccctcggtaaaggagcaggaggcaaggaaaacggttgagatactgctggtccagaaaggttatgcatgtttggaacaccaaaagccatcggattcggaggagcattaaaattaggggggaccggagttggaatagggttagcgctattactattgttagttaatggtaacataaatgggaaaggtgcaaaaggctggccattcattgtcgcaaacaattgaggatttgacatgaatacgttagccattggcatagtaggtggtataacattcttattgttagcaaacggttcagaaagagatggaaatattgaaggttgttgttgagaagaaaacgatgactgctgatccttctgttggttgtgttctcctgattgctctttcaaatgctgaagctcttggctcgagggtacctgtccgttggagaccgcattattattactgttagcttgcactgcagtatgtaacatattcagcaactctctaccgggatcaatctgctcctccttagtgatacccaacaacaatttcaattgttcttccgcataggatttcaattgatcttcattttttatttgcctctgatgccttaaccacattgataagggtctcatcatggaattaatcagataatacttgatatttgatttgtacattgttttagaaattttcttaaaatcgaaccattctatcttatcaatttcatttctaacttgaggtttaaaattgaagacttctgaaacaccagatatcaaaaatattttgtaatttttaccttgaatatttctttcaatgaattggttgtcgtcaatatagtccgtcaaatcgaaaccaatttcttctttcacttctctaatgcaacaatctatgtcattttcatctttagatatcttcccccttgggaatgaccaagaatccgattcagtaccctgtaccaataaaattttactcaggttctcgttaaatatggcagcgcccctcaccggtatacttttcttatacttggagaattgctggagtgcctcatccactcttatgtcccatttccaaaccagaggacatagttttatgatcaattgagcaaatgatttaatctttagggagggtaaagttggattcatcaatttgatgaaatccgtgtaaaaccatgaggcttcttcaaaatgaaataactctctctcgacactcgataaatcttcattcggacaatttataataaaacgtactaataagtcctctaaaattctatcaacagaagtaacgttctccaatgcgtgtcgtagcggcagtgacattgtctaatgcgaaggtacttttatttttttcagattcaaagcaatattatttagacaattgatactaagtgagcttaaggaggattaaacaactgtggaatccttcacaaggattcaatatttgtttttcctggttattttgccatcattcaactttcctcagacgtaaaattcgtgcttagtgatgtctcaatattcccgcagggtaataaaattcaataactatcactatatacgcaacagtattaccctacattgctatcggctcaatggaaatccccatatcatagcttccattgggccgatgaagttagtcgacggatagaagcggttgtcccctttcccggcgagccggcagtcgggccgaggttcggataaattttgtattgtgttttgattctgtcatgagtattacttatgttctctttaggtaaccccaggttaatcaatcacagtttcataccggctagtattcaaattatgacttttcttctgcagtgtcagccttacgacgattatctatgagctttgaatatagtttgccgtgattcgtatctttaattggataataaaatgcgaaggatcgatgacccttattattatttttctacactggctaccgatttaactcatcttcttgaaagtatataagtaacagtaaaatataccgtacttctgctaatgttatttgtcccttatttttcttttcttgtcttatgctatagtacctaagaataacgactattgttttgaactaaacaaagtagtaaaagcacataaaagaattaagaaaatggttaaggtcagtttggataacgtcaaattactggtggatgttgataaggagcctttctttaaaccatctagtactacagtgggagatattcttaccaaggatgctctagagttcattgttcttttacacagaactttcaacaacaagagaaaacaattattggaaaacagacaagttgttcagaagaaattagactcgggctcctatcatctggatttcctgcctgaaactgcaaatattagaaatgatcccacttggcaaggtccaattttggcaccggggttaattaataggtcaacggaaatcacagggcctccattgagaaatatgctgatcaacgctttgaatgctcctgtgaacacctatatgactgattttgaagattcagcttcacctacttggaacaacatggtttacggtcaagttaatctctacgacgcgatcagaaatcaaatcgattttgacacaccaagaaaatcgtacaaattgaatggaaatgtggccaacttgcccactattatcgtgagaccccgtggttggcacatggtggaaaagcacctttatgtagatgatgaaccaatcagcgcttccatctttgattttggtttatatttctaccataatgccaaagaattaatcaaattgggcaaaggtccttacttctatttgccaaagatggagcaccacttggaagctaaactatggaacgacgtcttctgtgtagctcaagattacattgggatcccaaggggtacaatcagagctactgtgttgattgaaactttgcctgctgctttccaaatggaagagatcatctatcaattaagacaacattctagtgggttgaattgcggacgttgggactatattttctctacaatcaagagattaagaaatgatcctaatcacattttgcccaatagaaatcaagtgactatgacttccccattcatggatgcatacgtgaaaagattaatcaatacctgtcatcggaggggtgttcatgccatgggtggtatggctgcgcaaatccctatcaaagacgacccggcagccaatgaaaaggccatgactaaagtccgtaatgataagattagagagctgacaaatggacatgatgggtcatgggttgcacacccagcactggcccctatttgtaatgaagttttcattaatatgggaacaccaaaccaaatctatttcattcctgaaaacgttgtaacggctgctaatctgctggaaaccaaaattccaaatggtgagattactaccgagggaattgtacaaaacttggatatcgggttgcagtacatggaagcttggctcagaggctctggatgtgtgcccatcaacaacttgatggaagacgccgccactgctgaagtgtctcgttgtcaattgtatcaatgggtgaaacacggtgttactctaaaggacacgggagaaaaggtcaccccagaattaaccgaaaagattctaaaagaacaagtggaaagactgtctaaggcaagtccattgggtgacaagaacaaattcgcgctggccgctaagtatttcttgccagaaatcagaggcgagaaattcagtgaatttttgactacattgttgtacgacgaaattgtgtccactaaggcgacgcccactgatttgagcaaattgtgatctcccttgccccagtgtacacatatataaaaatatattcatgcctatatgattatgtatcggaatccaaaaacttatctttatattgcttcgtttcgtagttagcaatgaatcatcttatcatgattcctttttttgttttggccagattaatgtatcacggtcgacggcgaaggcatcaaccattgttgtggaatttcaaacacaatacttgatgactccaaacgtgggcatatattttgatttgaaaagaagtcgagaaagtatagcaacgcattgtatacgtttgaagctttcagcaaaggatataccgtggaaatgtacacgcctatccctgctaatacccctgctcccactgcaccaacttcatcgatgacgtccaactcttcatccgcatcaaatgccaacaccactagcagtagtggcataaacccaaggaacagagccagtggtactccatccaatgagcgggctcgtccggcgtcgggtatcagttcgtttttgaataccttcggaattaggcaaaatagccagacagcttcttcttctgcggctcctgatcagcgtctattcggcacaaccccatctaactcacatatgagtgtggccatggaaagtatcgataccgctccgcaacagcaggaaccacgtctgcatcatcctatacaaatgcctctgtcggcccagttccacgttcatcgcaactatcaactccccatctccatatctctcactgcccctacaaccacagaccaccagcaatcatctgcgcataatttcgaaggcaacaatgttggtaacgttcaagagtctttgaatcagcggcagcctaacggtactaacaataccacaacctcgataatttccatggcgccagcggctacaacgagaaatatagtcggtggtgcagatggatctactattgttaacaacagtcaggaaatgtataagaatttacgtcacttgatatatgctgcaaaccagccaaatgggaccgaaattttacatttggatttacctgcaacaagtgcagaggagtcaaacaatatgttcaatgtagatgaggtcactttgaagcaaaggaaagataagcatggtctttttagtataagactaaccccatttattgatagttcgtccacgacaaatcaaggtttattctttgaaccgattataagaaaggctggccctggatcccaattggttattggccgctatactgagcgtgttcgcgatgcaatttctaaaatacctgaacaatatcatccagttgtatttaaatccaaagttgtttcaaggacacatggttgttttaaagttgactctcaaggtaactggtatataaaggatgtgaaatcatctagtggaactttcttaaatcaccaaaggctctcacccgcttcctctttatcgaaagatacccctcttcgtgatggtgatattttacagttaggaatggattttagaggtggcacggaagaaatctatcgttgtgtaaggatgaggattgagctaaatagatcatggaaactaaaggcaaattcgttcaacaaagaagctttacagcgtttgcagaatttacaaaaattaactacaggtattgaagaagaagattgttcgatttgcctatgtaagatcaaaccgtgtcaagcaattttcatatcaccatgcgcacatagctggcatttccgttgtgtaagaagattggtcatgctctcatatccgcaatttgtttgccccaactgtagatcaagttgtgatttggaggcctcctttgaaagtagtgacgaggaagatgaaagtgatgtggaaagtgaaggtgatcaactggtggatcaacttagcgtcttaatggaaacttcaaaggatgttgatagccatccttaaggtcaaagaaaatacacagtttgaaaaataaagaaaaaccaccgaactccacatctcgtaccttaatattattttaattattctcttagtatttatatatttgcgccgtttacatatttgacttattgttttcaggaatacaatacctccatcgttggcagtcaattttgctttcacatataaaactaaaaaaaaagtaaagaactcggttaatcctcggttagtttgccaagctcacctattaatcttaataggacttcttgagtttgttgtttgcccagaccatacttatatatttcatgcccaccttcaactattttccattcttgagtcttgtgagaaattttggtcaaatctctttgccaatcgccccataatgccgacttcttcaccatttccttagagctaacgatgcttgtcttcacattttgcaaagattctgcattgtttgtcacatctctgtaacttagaattgaactcgtcacgctttccaaaaacttggaacgcaagaaacgtccttgatatttcatatcacgcccatatatacgttctttagacccatgatgagctagtaaccatgaagtctgtaatctccatcctaaactcgaccaaatgcctttccaccataatctaaattcgttatgcctttctatctccgaaggtaaccaagtcttatcatggttgcggccatccccatcattaccattgccatcgtcgccatcgtcgccatcaccacggcctggaggtagtaatctttgaatgtagttttttaacaatagttcttcatgccatgattcaacaagcatcatgctatccacaatatcgacattcttggcggtaaatactcttgtaaatagcccgccaaggtcgtatcctactgtagtgaagggacctttaatttttgcatctttgatcaatgcgtaccttaaagattccgcaaccatcgcaatagagattggggcgggaggagaatcgctcaacccgtaccctggtctatcgtatagacaatatctttgaattttgtctaaatgatatagttcctcaatccaggtggcagaaaggtaaccagtatcataacctccgtgttcaaacaagatgataggttgcttcttattttcagacaaatctgtgttgttttcttgatcaaatacgtcaccataacaagttatatgcaactgataggttttagcggcatctacgtaatggaacgcctcgtacgagggcgactgaacggttattggtaatttgtgagtcaatctgtaggtatccaatgtcgttaaaagtgtattcagggtgaataaagcgaagaatattaaaattaaaaacttaatagtattcctgaacccaatggatacccattctgtcaatgtatgtttgttttggaccagctgcgagcggtgggtgggggttggcgacccagagccatattggcttctgtccctgttttcggtactatttgtatggttttcgttgaaagtactaatattagcatcatcaattctgcgttcctccaatggctcatttattgagttgttgtaaaacaagagataccaatctaatattgccccaataaaaaatgaaaacgaagtccacaaatatgtaaacgtgcccacaaagccgattctttgcctagtgtatttaattagataggtcaatgctagattgaacaacgtcaaaacacagagagttacatttaagctgtaatctaaagctgagtacagtcccagcttattaaaccagagattgaaagaattagctatgatcgagatgaatattaaagtcaagtcgttaaaacttgcgtacctgttactgaatccgaaaagaatattgatattgaaaaagaaatctgaaatcaaagtggtgactagccagatggtgttaattagaattaggatatttaatatccatttggagttatgaataaagattctataacctttgcgaatttgaaagagactatctttgatgaacccatcggattcaatgtcacgaccttcattaactgctgggccattcgcggatcctgcaccaagggtccggtggttgttgttcagcaacggttgcgcttctgggtgttcactatctatatctgttctttccattcccgtccttgccggatcattatctaaaccattagccttcatgatctgttcgctctgatgcctacagttctttcttcaatggctttcctttcctttcctccttatagaatatagcaaggcatctaacttttagtttttctctcatccctttaaactgcacgatggttaaaattaggggtccgaatagccttgcaaggaatagattaaagaacactatatatgcatagccacttcaaaacgtgctgagaacatgccatcaaggttgaccaatacgattgctgattcgacaacttctacattacataggcatatacatatcagaaaaacgtgctttataggtacattttttaattccttaaacataacttgcttctattttgggatagttccttttctttgaactacgttttttgggcagaaatataaaaaaaaaccgaaaaaaacggcacgcaagaaagcttattcaaaaagacgcaacaatatcatagattattctaagtaccaacaacgtgataaactttgttctaataaagctacatcttatctcttctgtacagctttattggggtgaatcatatttacttcaatccgggtaatggtaaacgtaacaagtgatagaaatattcacctgcgatgagctggaaaaaaaaaaaatttcaaaagaaaaccatactaatgctgaggtataaagtaacgaattggggaaaggccatcaatccaaagtcggaaaaattgaacttcacataaagtaccaggcaaatgactgaagacatcgaacaaaaaaagaccgctacagaggtaacaccacaagaaccaaagcacatccaagaagaagaagaacaggatgttgatatgactggcgatgaagaacaggaagaggaaccagacagggaaaaaattaagcttctcacacaggcaacatctgaagatggaactagtgcctcttttcaaattgtagaggaggatcacacgcttggaaatgcccttcgttacgttataatgaaaaatccagacgtagaattttgtggttactcgatacctcatccttctgaaaacctattaaatatcagaattcaaacctacggtgaaacgaccgcggtggatgctcttcaaaaagggctaaaggacttgatggatttatgtgacgttgtagaatctaagtttactgaaaaaatcaagagcatgtagatgttacggatcgactcaaagaccctctgtcactctgaaatttctaataattatgcacaccacgctagtatagatacagcttgatttgtgtatcccgtttatagtcgtgctatttaaaatctatgtataatataaccagataaaaatacaccttcgtacaaggtgctaataatgttgagaattcgaaattcctttttaaaggcgtattccgtattgaatgattgaaaaatttatttctttttttatttcttttttttttttttttttttttttttacgccgatgctcatcgcagaaaatttttccttcagtttatttgtcttataaaaagactgtcctacgctcaaataacttatacttttctgtatctcattcaaattattttcttgtcaacaacctgtaacagaattaagcactattaaggcaaatttagagcaaatatgacttacggtggtagagatcagcaatataacaagactaactacaagtctagaggtggcgacttccgcggtggaagaaactctgatagaaactcttacaatgacagaccacaaggcggtaactaccgtggtggtttcggtggtcgttccaattacaaccaaccccaggaattgatcaaaccaaactgggatgaagaattacccaaattgccaactttcgaaaagaatttctatgttgaacacgaaagtgttcgcgacagatcggacagtgagattgctcagttcagaaaggaaaatgaaatgactatttccggacacgatattccaaagccaatcaccactttcgatgaagctggtttcccagactacgttttgaatgaagtgaaggctgaaggatttgacaaaccaactggcattcaatgtcagggttggccaatggctttatctggtagggacatggttggtattgctgccactggttccggtaagactttgtcttattgtttaccaggtattgttcatatcaacgctcaaccattattggctccaggcgatggaccaattgttttggttttggctccaactagagaattggctgttcaaattcaaacagaatgttccaagtttggtcatagttccagaatcagaaatacctgtgtctacggtggtgttccaaaaagtcaacaaatcagagatttatctcgtggctctgaaattgttattgctactccaggtcgactaattgatatgctagagattggtaagactaatttgaagagagtcacttacctggttcttgatgaagctgatagaatgttagatatgggttttgaacctcaaatcagaaagattgttgatcaaatcagacctgatagacaaaccttgatgtggtctgccacttggccaaaggaggtgaagcaactagccgctgattacttgaatgatccaattcaagttcaagttggttctctagaactatctgcctcccataatattactcagatcgtcgaagttgtttctgatttcgaaaagagagatcgtttgaacaagtacttagaaacagcctctcaagacaacgaatacaagacattaatctttgcttctacgaaaagaatgtgcgatgatatcaccaagtatctaagagaagatggatggcccgccttggctattcatggtgacaaagaccaaagagaacgtgactgggttctacaagagtttagaaacggtagatccccaattatggttgctactgatgtggccgccagaggtatcggtatgttaaaattttctccatttttttattgattttatttttttttgttacccctaacgatattacagctatttcctaatggcttttaatgacattaatgactttatgacaaccatgatagtacagaagagagaccttttttcttttttttttttttttcttttttttttttttttctttttttcttttttttttttttgagccttttcgaatctagactctatgtgagtctattctcgatggggagtatcggaaattgaattttaattcgaatgacttctaatgcatcactacagaaaactaatattgggaggatgagaaaaattgactttaattagtcgttttgagagacgggaaattataaactcggagaagtgtatttgtgttcatgatttgcacttcatgtcaaaagaaatttcgctttttgacatcggcgcaaataaacaaggaattggcttttcagcttatttctagaacgcatacatacgcttcgttgatcgttgtttttttcaatgcttggcatttgtacaagggtagattgttttattggaaaaataatagtatattctactttgaaatgccgtcatccttcttgactattgttattctcattttgtgtagtttatgcattttgtagttatattgagatactgttgcatcccaagttcgaattattaagaagtgctgataaaaatggaaaataacaaaataaaaggatttcaaccatattcagaaatcatttactttgttttcctttttttaagtgctagctttcattcagtttgaataaggattctggagtattgatgattaaatatttcgaattctttaataaaaatataatttctgataatcttcaagccagggggaaatttgagacaatgttgggagtccaaacatgaatttgtggggggcatgaaaataaagttcatatacagaataacgaaccaaattactaacagtatgctttgtaaacgtttgtttacttctttattttttcagatgtcaaaggtatcaattacgttatcaactacgatatgccaggtaacattgaagattatgttcacagaatcggtagaactggtagagcaggtgctactggtactgctatatctttcttcaccgaacaaaacaaaggtttaggtgctaaattaatctctatcatgagagaagctaatcaaaatattcctcccgaattattgaaatacgacaggagatcttatggtggcggtcacccaagatacggtggtggtcgtggtggtcgtggtggctatggccgtagaggtggttacggtggtggccgtggtggttacggcggtaacaggcagagagatggtggctggggtaacagaggtcgttcaaactattgaagtcaaagtgattcaattcattcatctctattaataataattatataagttgactgcaccttatttcttcaatgcatgataaaattttatttgctgtatactacatttttaatattttaaagctcttcgtcacactttttctttaatactcctaagtttttgggtgaacggtggcaactggattgaagttatttcgcataacgcttagtgtgccgtaaaataataggacagacacttttctttgttctcgtacaaccctggggccgatgttaaacgaatgattttcaaaaaaacagtagacttacaaagaagtcgtgcactagcgcttatgggtcattttagaatgagcgaaatgcacgacaaccaggttgatcgtattgaagtaagagcagagctttatttgccttttttttttttatctaagacgatgatttttagccatacacaaagataagtatatacatattaatttataataattctatctgccaggcagattctatgatacagtgacatacttctatgcgatatagtagcataagttaatgttgtaagacattaatttggccttgattgcttgtaaataaataatttaataaactgaaacgaaaaattcaattgagtttggagaagagtgtgggctattctggaagaaaaattattcgttcaacaaataataagcaacacctagcattaaaatggccaatatgacaaccaatgtaccactacctttactttggttttcagaggtagataccttttccacagaaacgcgctcactggtcttgtcaacgtcaccaatgtataaacctttcagtagtctcaatgcttcgtcagaatgaccgatatcgacaaagctttctgtagcatcttgtccacccaaatccattataatttcatcaccacctggatgttcatctttgaattgagaaacatcgtaaactttgtcatcgatgataatccagaaattttctgggccattgtgttcggcaacttcttggtaactgtaaactttaggcatgattgtttgatattttatgttgtagttgattgattttctttactatgaagaaaatgaaaatcgaatttaaatattaacgaggaagcctgaacgaaaatttttgagaaagtttcaaaagcttcttgttctttatatagttattggaaaaaggacaatatatatatttgttatttattgatataataacaatgcttctcaaatatcgctttttggccacgaatgcgacaaaaattttctcgttatgctaacctctctcactatctcgatctcgtatagctttcttttttgcagctattgttctttttctgggccgttaaatttttcatccggaaactccaggctattacccgctccgtgattttggtcgttgaatcttcgtaaaagcaatcatgtaaatatcattgaatacggacaaacggaactatattgctggaattaatgatataaatggtttcccaagtttgctatatctcctattctatcttacaaaacccttttctcagggtggatgagaagtgacaagtcaccatttgaattcgatacctgacttggctaatttttttatcctttcttcatgtttttgcttcatgttatcctttagctgttttactggtttggtgatacctttctctactagaactctcttcttgtatttgtacaatttctcgattttagctccttttggtaatacacgcacttgtagtagatgacccatcaacaagtaattgttcatagattcttgggcgatcattgcatcctctttattaacgaattctaagaagccataatgtctggaatttccagttttcttattacgtgctaatctcacttcttttaaatcaccgaattgagcaaaatatttacttaattccttttcgtggaacccatgtggcagtctactcacataaataatcccagaatactcttcaagtgtctttttatctttcgactttttttcattagcctgcttcttaggattcaatcttttaatcttgtgtgtaccgctctgctcatcatcagaagcggctaaaccttcaatttcatcttcatctttttcgtcttcttcatctgaactgctagacgatgtttctagagccaactcttctttctcctgtataggtttttcttcggtgggttgtttggttactgtttccttggtggaagttttgcttgttgactttaccatatcgatctctttcctctgttattttatctctagaacttaaccctatagaaaaggtagttaatgaagttaaaagtaatggtaatcgtcttcaaattaagtgatgagatgagatgcgatgcactacttcattttttcttatggcggaaaatttttcatagtgaaaagaaacaggcaaaatctggggggtaaccgcatacgtctctgctatgccgtctgtaatgaggatgctaaagttgcaatagctgctatgcacattagaaagggtttagcaggataatgagttttcagagatagcacaaaactcgaaaggtttcggtactactacctagacagctcatctttcaatcgttgaaccttgaattttgaagtttagggatattaaaagatactgttaattctatcaatttacactagactttgacatatgtatatatatatatatattcacacagcttcatcatgaaataaaaatcaaatgcagaagtgtataatgagaagtacagaattcaagactcactttagttttcactccatttttagttttccgctctcagctgctcttctcgctttgatatcagcgtctgaaccagcctcaaaggcattcataaacgtccaattcatttcttccccattagttaaaaaggaggtgttgccattcattgtaagtttccactctctctcttcaaatggtatactttcattttctcctttcaccagctcaaatttatcaatagcacaacttccatttcttataaaggtgcctttgttatcaatgggctctttggcactggagaatttcaacaagttcataccaagagcggatttagtggctgcgtgggtaactatcataatggtctttacatttggaaattttctctccactctgtcaataaagacaggccagaatttatggcacctctcaaaaatatcttcttctgtttcacccttattactaggaataatactaggttcccagtctggagagatcatgcttggaaaaaacttactcataacttcatgagtagcaggctccgggataatgggtctatcaggcttataccattctcctacaccacgatcgacatataatggaatctttaaagcctccactgtgggtttactagtttctaaacagcggtaaaatggggaggagaaaatcatttctggtttgacatctaatttagagatatagttcgccagttcatgtgcctgttcaacaccgtgttccgaaagcgggacatcgttatcaataccggtgggcggtggtggatatggtccctttggtagccagtttgacctgtaaccatgtctggcaatgtatatattttcgatagccataatttatagcactattttaacctcttgtacaactaattgaacgtcttacatattgaacgaaactgctttacttctaggattgttttcaaagcttttttataaatttcgaaatatccgctattcggatgacgtgatgacgcttcggcaccattgattatttttccagagtttagatgtcttctatgtgcaactgaacaagtagccttcgaaagctagagggatagatacattacttgtgaccacctatttacggcatcacaaagaaagcgagatggctccgacaataagcaaaaggataaaaactctctccgtgagcagaccaataatatatggcaatacggctaaaaagatgggtagcgttaaaccaccaaatgctcctgccgaacatactcatttatggacaatttttgtcaggggcccacaaaatgaagatatatcgtactttatcaagaaagtcgtttttaaacttcatgacacctacccaaaccctgtgagatccatagaagcgcctccgtttgaactgactgaaacagggtggggtgaatttgatataaatattaaggtttattttgtagaagaggccaatgaaaaagtgttgaatttttaccatagattacgacttcatccttatgctaatcctgtaccgaattccgacaatggaaatgagcagaatacaacagaccataatagtaaagatgcagaagttagttctgtgtattttgatgaaattgtattcaatgagccaaatgaagagtttttcaaaattttaatgagccgaccaggaaatttgttaccttcaaacaaaactgatgattgtgtatactccaagcaattagaacaggaagaaattgacagaatagagatcggcatagaaaaggttgacaaggaaattgacgaattgaagcagaaactggaaaacttggtaaaacaagaagccattaacggaagttaggatcactgcacccggaacaacggtattttcataacagccatagtaatacagatcatggtttgaaaggtcggcgctcacaaaaccgaaatgtgtgcagagtcatataaacatctaaacaacagttatgatacatattctataaatgcgtaattttagtaacacaatttaattggggtcgcaaggcttcaatggatgaacgcttagcttctctagttcagggttcttcgcaggaacttttggtttagactttttcttgcaagggagttcctcttcagattttgaattcgacggggaaacttttattgagtgttcttgagaggtgttaagcttgttagcagcaacacttaaataatgcggttttttgacaactggtggcttctcaggttttgtggaggcctttgctggctcaggatcttctgtagtggacacacctgaatttttggtagatgtagagatttcgtccggggcagtactgctcttccttctaataggaggacaaggtcgaggaacaattttcccattatctatggtctctttagcatgctgtaattctgaagaacttttctgtaaagagactggcttagataaagataaagcgggcactggcggcagtggtttgggtgtactgtgtctctctaaggcaggaagattgctctcacctttacgcggcgatacgctgacaatggaaatctctttggtaggggaaagaagtttagaagatggttccttattgtgcctcgaggtaggaggaggcggaggaagcacattgagcttacttttatcgggtgatacgttactgagtcctccagggccaacaacagacggttggggactgggaccagaaagtagaggcgaaacgcacgaggaagtatcatctaggtcaattagttttatgcccgctgattgaacggttgcatctaagggtatactttccttttgtttttccattcttgcatgagaaagttcgtcaggacctgtagttagtgcttcgggatgcgtattcttatattctgcatacagcttctcaactaggttaagcttctctttttcgtcaacaaatttcacatttgccctatatgcagcataaactggtttatgatcgcttatttttaaaggtgcgtccgaatatgccaatggatgcaggttttcacctttatatatgattctatcagtccaagacggagttctcgccttttcagaagtatcataattatctgtgccataatcatatttataggtcggacggaattggagggtcggttctttaaagccctgaaataccactccttcatttatttcttgagtcaactgatcatattgaagcaatctatcaatatagccatccttttgagcccttaattctcttctaacttcatcatttgtcaaagttatcctgtagttaaggtcacccaaccaaaacaacgaatcatggtgtggaattgtctttgatcttggaaaggttatgttcctgtagatattgttgtagtcattgcgacgttcgtcaatgttactcgcacctgctgataaatgtgtattaacgaaacagaatgaagttgccccataatcgaatctaatggctactgcacctttgtttccagtaataccaccaaacccagtctttttggtagacccacctacctcttttatgttataggctctatctgatcttgcaaaaaatagtatcaaaagagaggacatctgttccactctaagtaaaagatatttttcttcgtattgattcaaacagtcagtaaccatagtttcccaaaaagaacttttcgtataatctgcattcaagatagaccctgcggtcaactctataacttcctgcaaccctaacacaacgacatcaggtttgaatttatcgccgattggaaataaccattttgacaaatctgctcttcgagagtttccgttaacattgaatgtaccgacaaacaaatttatgttagaatgagtggtgaatttttcctctgactctaacagcctttcattgacgtattcgcagattggatcataaagttcaacaacttgctggtgcggtagtttgcccaaaagtgtgtcaatattttgctgttttcctttatctacaaaattgttgatgtacattctactaacggacttcgtcgcatcagaaagggcgccagaaaaagacattttacctttccttgaataggacgatttcagagcatttgtcccagtgtaaatttgtgatatctgatctccgttgtcggcccataaagcattcaccttttgcacaaattcattatcgtcgatgaaactactgggttttaccaatcggaagtcttccaaaaatagtttgaaaacggccagtgaaatcgtctgttggatcaaatttgttctatctaaacaatccaagcaattggttctaaagacaccgtcttgttcggatattaatcgcccttcttttacatcgtatgaaaagtaaccggcgtccaaaattgtgtttcttattttagggataatcctacttgcagctgcaaacccatcttgcgaagtttctctatggaaatcaaagcttgttaggaacacatctctaccgattttcattttctcagaatttttcaactgttccttgtatcgcctcgataattgaatttctgaagatttagtagacagcaggttgattatatgaactggcccatacttcttaaatagtcttataaaatgttcatcaaacgtgggctgtgttgcttcaacagatctggtaatttgaatctttggactaatcaaagatgtatcctgctcccaaaaaattggaaggcttcctcttatctgcgtgaaagcataacaatactgagaagagtacataatcatttctgtttcaacaaaatttgcgacatggccatcatcatctataccacgtgcattaaaccttgtgcctgctcttttccaactttgcctggaaataatggtaagtcctactttcaacctattaatatagctaaaaattgtttcagcaaaccctcggattacggtcgtgaggaatcctcgttgatccaatagttctttggccgttacatctagtctgtctctgtatgtgatgatttcgtccataagaaacgagttccacataaactcccggtcaaaatcatcaaaactcaaagagtgttccgtgaatccacgtttctgcaatgtacaagttaaatcaaaatcggtgctgtaataaaaagatccatttgataatagctttcttagttcatgacatggatgcttgggagcttgttcttgagcattcaaactcctagaggaagaagaacgtagcgatgatctagaagaatgtgtggaaatactaggaggcgagcttattgcaaaatctccatcattagtaacaatcggataaccggatgaatcgatgtccatgaaatcccatttagaattatttaagcaaaaaaaatccacagcatatattttgttaaccgttttgtttgggatcggctgggccaccttagatttacctgttatggttgctatgaacataaggccttcaatttctatgagaccaataaaaccgtatatttcatggttagatagtcttctgaaaccattaccatttaattcagctttcggaaccaattccacggcacatgtagatctgcgagagttcttactgtttattggcctaaataccagtccatgtgtttctgaaactattgctatctttctagtttgctgtttcgataggagtattttcatagctactgagtatttgtttttgattctgctgcctttgcgtggcctttgtcaccaattctgcgaacaaaaatatgttgagactatatgaagcgagtacttattgtcctttatgcctagttttccagttaaatctctcttaataactccaggtttgtttcaatttcgtcactaaccgccaaacaagtttcgggtcaccccacacgtatttggttcaagaatatactaaaaaaagaaaaacaagcactagccctagatatggaaaaaaagatattaaaacgtaattctaatttagacatccgtgcttctagtaattatatggttaaaaaaaaaggaaaggaagtaaataaataagtatagaaataaatagaagcgaataagtcctgaaatacagaaaagttcttatgcagagccagatgccgcagcattcttaccttcgacctcggccaaagatggaatggacacatcaccagaatggataatattgttaatggtggcaaagatggctctcactgaagaatcaccgacatcttcggagacacctacaccccatttgtaggccttttcgttgtcggcattacgcctatacgatagatggatgtaagaagcagcttgcgtagaagaaccagaacctagagaatgctctgtgtagtttgctacggcaaatctcacgttcaacaagtttgatagggcgtcgaccaaagaagagattggaccattacctgtaccttcaatatcgacgatctggtcgcctactttgacttgaccagtgaacactctacgttcagtgccgaatttttcaacattataattgactaaactaatagcttggtactgttcgtcattgtagttgtaagcctctttgaataacttggaaatctcatctgattttagttctctacccaaggagtcagcatggtcttgaacggcgctagaaaattcgatttgcatgtttcttggtagatccaaacccaaagatctcaaaataacccaagcggcaccacctttaccagactgagagttgactctgatgacagcttcgtaatcacggccaatgtcctttggatccaatggcaagtatgggattctccattgagtttcaccttgagcacgcttcttgttttgtaagttgaaacccttcttaatggcgtcttggtgagaaccggaaaaggcacaaacgaccaagtcaccgccgtatggtgctctttgcgatactgggatcttattacaacgctcaaccacatctaggacagaggtcaagtcagagaaatccaaattaggagaaacaccttgggtatacatattcatagcaacagtaaccaagtccacattacctgtacgttcaccattaccaaagagacatccttctacacggtcggcacctgcaagcatacctaactctgtggcggcgacaccgcaaccacggtcattgtgacaatgtgtagagatgcaaaccttctcacgctcagtaatatgggtagcgaagtattcaatctgatcagcataaacatttggagaggcaacttctacggtagcaggtaagttgaaaatgattggattttcctcggtaggttcccaagccttcttaacagcttcgcaaatttctacagcaaattcacctggagtatcactgaaacattcgggggaaaactcataggaccaacgagtggcttgttgggaagggtcatccttagttagtttcctaactagtttggtggcctctactgccttggaaatagcttcctctctagacatattaaaaacaatttcacggaacatatcacttgttgccaagtaagtatgtatagtagcctttttagcacctgttaatgcttccaccgttctcttaatcaagtgttctctagattggacaagacattgaatactaacatcgtctggggcgttttctacagcatatctagtgaagtcgaaatctgtttgagatgcagaggggaaggaaacctcgatttctttgaacccaatattgaccagcttgtgaaagtattctttcttttgttccactgacatgggatccggcagagattggttaccatctctcaaatctgttgataaccaacgaggagccctcgtgatccggttatccggccactttctattagatagctttggagcgttaaatggcttgtacttggaggaagggtccttaagcatatttttataggctagcttcactggaggaataactcttgaggctctggaggccgcatgctcagcaagagcaataatactctctttaaccatgattgttccttgtctttttgtaaggaaaaagtctacagtaaacttctagtgtgagaatccttttttttcttcaaaaaataccctttgaaagaactgagtcacttacacgtaagtttctttttactggtcaagttgaaaaataaccaataaatgattatggaaagaacgttgaaagaggagagaggctgacccaagaggagaaaacatcgaacctacgcgactccatagcgcacatctcccatgcgcccgtgcttatatatatataaatatacatacacacatacatgcacgcacatacatgcacgcgcatgacagtgactggccgttactgtacaattttttcagccaagtatgacacacattcaactcagcttttctgaggccttctttcttttcctgcgcgtcggtagagcgatgactaacctactactgtctcagagccggtcccgctccggtagcaatcctggggctggtcataacagccgagtggaagtgtcaaagcggagaacagaagcataagctcaatcgctggacatacggatgcttatatacgtcttattgtcgttgaaaaatatcgaattttttacttcatttatcgaggcttcttcgagcacttttccgctatggctttttccccgtttccttttaatcacgtgcgcgggtagcacccggcacacagctggtgtctcgtcgcacatgctattgtgtgtcatcgggccacacaagcatattgcttgaattttctttcatcgttcaacttaaatccacccaatctagatgtagccgtagcatgtaataacgtatatccttgtttacatgcatctgtgccaggtgaaacggtctgtttgaacgcacatcatttcatatattagtcaactcctgaaggtcttcttgcctgtccgtcaactgtttagacagactctcgtcaataaagcgcacttctgataagcacttttattcctttttttccactgtgaacgatgaagcaggagcagtcccacgaaggcgactcatacagcacggaattcataaatctctttggcaaagataccgcaacacaccctagcagcaacaacggtgctaataataatggcatggggagcacgaactcgttggaccagtttgtggcaacagcctcatcgtcatcttctctggtgaccagcagcgagaataggcgccccctaataggtgacgttaccaataggggcaacactaacctatatgaccacgctgtcacgccagaaatactcttagaacagttggcctacgtggataacttcataccatctctggataacgagttctctaatgtggattggaatgtgaataccacccataataatgcaaacaataatggcgcggacactttcagcagcataaatgcaaatccttttgacttggatgaacaactagccattgagttgagtgcgtttgccgacgattctttcatcttcccagacgaggataagccgagcaataacaataacaacagcaataatggtaatgacgaccatagcaaccacgacgtattgcatgaggacccttctaccaataatagacaaagaaatcctcacttcttgactcaaagaaggaatactttcctaacttcccaatacgaccaatcaaagtctcgattttcgtccaaaaacaaaagaaatggcaataacggcgaaacaaacaactttggcgacaatatgcaaaataaccatccttttgagccaaactttatgggaagcccttctcagtttcccgctgacgcaactaatatgacatcaatcgaccatggcggcttcacaaatgttgacattacatcaactgagaacaatactaccggtgacaatggagtggatgcgctatcaaatctactacataggacaacacacacaccgaaccgctcctcccccctaagcaatgtcacttctgctcaaaattcctcttcacaacaacgaaaacattcggaaagcaaagtcgatagtaacagcgataataacagctccaacaaagcccccaatataactgttcctgactattcaattataccaacctctgttttagtaactctattaccgagggtcaacgtgcccaacggcgcatataactcgttgatcagcgcgggatttgacaatgatcaaatagatgctatagccgcaataatggcgtatcatcatcaaaaaaagattagggaaaataacagtaataataataaaaacatcaacaccaatgacagtcaagaggcacccattctaaaaaacatcaacgaacttttaagtgtcttaataccaccctctccggctgaaactcgtgggccaactaccttatcaacgtcgccttcgttcaatgagcacggtgtagtagcagaggcttcttttctaagctccattttggaactgggcataaagcatccaaaaagtaataatattcacaatcaacgacaaccttcacgaaacgatcataaaatatcaagagagagtgacggtaacaatggaaacgataatgtccatcataataacgctgttattaagtcaagtacgacgcgtggagacgaaattgccaagatacgatccgagccaactttaaatgcaagttcttctgatcacaaggaaaatagtttaaaaagatcacactccggagatttgaaaaataaaaaagtacccgtcgaccgcaagtattctgataatgaagacgatgaatatgacgatgcagatttacacggctttgaaaagaagcaactgatcaagaaagagttaggggacgacgatgaagatttattgatacagtcgaaaaaatctcatcaaaaaaaaaaactaaaggaaaaggagttagaatcatcgatacatgaactgaccgaaattgcagcatccttacaaaaacggatacatacgttagaaacggaaaacaagcttttaaagaatttagttctgagtagcggtgaaacggaaggaataaaaaaagctgaaagcttaaagaagcaaatttttgagaaggttcagaaagaataaaataacagactatacagtttaattatatatatatatatatatacgtgcatttttcttaaagaaatataacttttttcttgtactgcctgcaatctctattcttcattcatcacacatctattcaaacgcgttaaaatttttttgttagcctataagtaaaacgcgtcgcgtgtatccaattttactgaattaaattctttactcattggatgatatatatcttcttggtctagacaacgaacacataccaattcagactcacgagaaaaaaaactgtcttcactctgctattagaaaccaaatagtatcaaggcataaaataaacagtggaaaatgtcttctaaaagtgaaaaattagaaaaattgagaaagctgcaagccgctcgaaatggtacatccatcgatgattacgaaggtgacgaatcagatggtgacagaatatacgacgaaatcgacgaaaaagaatacagggccagaaagcgccaggaattgctgcatgacgattttgttgtagatgacgatggtgtaggctacgtcgatcgtggtgtcgaagaagattggagggaagttgataacagttcaagtgatgaagacactggaaaccttgctagcaaggattctaaaaggaagaagaatataaaaagggagaaagaccaccagattacagatatgctgcgaactcaacattccaaatcaacactgctagcacatgcaaaaaaatcccaaaaaaaaagtatccccatcgataattttgatgacattcttggtgagtttgaatctggtgaagtagaaaaacccaatattttactgccatccaaattaagggaaaatttaaattcttcgccgactagtgaatttaaatcgtcaataaagagagttaacggaaacgatgagtcaagtcatgatgccggtatttctaaaaaagtcaagattgatccagattcaagtactgataaatatttagaaatcgaatcatcaccgttaaaattacaaagcaggaaactgcgctacgcaaatgatgtacaggatttattggatgatgtggaaaattccccagtagtagccacaaagagacagaatgtacttcaagatacgttactagcaaatccaccatccgctcaaagtttggctgatgaagaagatgatgaagatagtgatgaagatattattctgaaaagaagaactatgagaagtgtgacaacaactagacgcgtgaatatagactcaagaagtaacccttcaacttcaccgtttgtcacagcacccggaacgccaatcggtattaaaggactaactccaagtaaatctttgcagagcaacaccgatgttgctacacttgcggttaatgtcaaaaaggaagatgtggtagatccggaaactgatactttccaaatgttttggttggattactgtgaagtgaacaacactttgattttatttggtaaggttaaactaaaggatgataattgtgtgtcagccatggttcaaatcaacggtctctgtagagagctatttttccttccaagagagggtaaaacacctaccgatatacacgaggaaataattccgttactgatggataaatatggactggataatatccgcgctaaacctcaaaaaatgaaatattcgtttgagcttcctgacattccatctgaaagtgattatttgaaagtcttacttccataccaaacaccgaagtccagtcgagacaccattccatcggatttatctagcgataccttttatcatgtttttggtgggaattccaatatttttgaaagttttgttattcaaaataggattatgggaccatgctggttagatataaagggagcagatttcaattcaattcgtaatgcttctcactgtgcggttgaagtttcggtagataagcctcagaatatcacgcctactacaacaaagacaatgcctaatctgagatgtctatctttatcgattcagacgttaatgaatcccaaggaaaataagcaagagattgtttcgataacgttatcagcatatagaaatatctcgttggattcaccgatacctgaaaatataaaaccagacgacttgtgtactttagtaaggccgcctcagtcaactagtttcccattaggtttagctgcactggcaaaacagaaactacccggtagagtcaggttgttcaacaacgaaaaggccatgctatcttgtttttgtgctatgttaaaagtggaagacccagatgttatcataggccatcgtttgcaaaatgtctacttagatgttttagctcatagaatgcatgatctcaacattccaacgttcagctctattggccgtcgtttaagaaggacttggcctgaaaaattcggtagaggaaattcgaatatgaaccatttttttattagtgacatttgctctggtaggctgatatgtgatatcgccaatgaaatgggtcaatcattaacacccaaatgtcaaagttgggatctttcagagatgtatcaagttacatgtgaaaaggagcataagccgttagatattgattatcaaaatccacaataccaaaatgatgtaaatagtatgacaatggccctacaagagaatattactaattgtatgatttctgctgaggtgtcttatagaattcaattattaaccttgactaaacagttgacaaatttggctggtaatgcatgggcccaaacgctaggcggtacaagagctggtagaaatgagtatatcttactacatgaattttcaagaaatggttttattgttcctgacaaagaaggcaatagaagtagagctcagaaacaaagacaaaatgaagaaaatgctgatgcaccagttaattctaaaaaggcaaaatatcagggtggtttagtttttgaacctgagaaaggtcttcataagaattacgttttagtcatggactttaattctttgtatccatctattatccaggaatttaatatatgttttaccaccgttgatagaaataaggaagatatcgatgagttaccaagcgtacctccttcagaggtggatcagggtgttttaccaaggttattagctaatctggtggatcgtcgacgtgaagttaagaaggtgatgaaaactgaaactgatccccataagcgagttcaatgtgatattcgtcaacaagctctaaaattgactgccaattctatgtatggttgtttgggttatgttaacagtagattttacgcaaagccgctcgccatgttagtcactaataagggtcgtgagattttaatgaatacaagacaactagctgaaagtatgaatcttcttgtagtttatggtgatacagattcggtcatgatagataccggttgtgataattatgcggatgcaattaaaattggcttgggatttaaaaggctagtaaatgagcgctatagattattggagattgatattgataatgtttttaagaagttactattacatgccaagaaaaagtacgctgctttgactgtaaatttggacaaaaatggtaatggaactactgttctagaagttaaagggttggacatgaagcgtcgtgaattttgtccactttcgagggacgtttctatacatgttttaaacaccatcctgtcagataaggacccagaagaagcattgcaagaagtgtatgattacttagaagacatcagaataaaagtggaaaccaataacattagaattgataaatataagatcaatatgaagctttcaaaagatcccaaggcctacccaggtggtaaaaacatgcctgcagtccaagtagctctaagaatgcgtaaggctggtagagttgttaaagctggctctgtcatcacttttgtgatcacaaagcaggatgaaatagacaatgcagcggatacgccggctctttctgtggctgaacgtgcccatgcattgaatgaggtaatgattaaaagtaacaatttgatacctgatccacaatattatctcgagaaacaaatattcgcgccggtagaaaggttgttagaaagaattgatagcttcaacgtggtgcgtttgagtgaagcgcttggtttagatagtaaaaagtattttagaagagagggcggtaataacaatggagaagatattaataatttgcaacccttagaaacaacaattacagacgttgaaaggtttaaggatactgtaacattagaattaagttgcccatcatgcgataaaaggtttccatttggtggtattgtatcttcaaattactatcgcgtgtcatataatggtttacagtgcaagcattgtgagcaactttttactcctcttcaattaactagccaaatagagcattctataagggcacacatttccttatattacgcagggtggttacagtgtgatgacagcacatgcggtatagttacaagacaagtctccgtttttggtaagcgttgtttgaatgacggctgcacgggtgtcatgagatacaaatacagtgacaagcaattgtacaatcaacttttatatttcgattctttattcgattgtgaaaaaaataaaaagcaagaattgaagccaatatatctacccgatgatctcgactaccccaaggaacagctgacagaatcatctattaaggctttaacagaacaaaacagagaactaatggaaaccggccggagcgttgttcaaaaatatttgaacgattgtggacgtcgctacgttgatatgactagcatatttgatttcatgctaaattaggtaagtattttgtatgtgttgtgtgatctcatgaatattctatatagtaagaaaagaatacaactgtacatacgcatcctactagatacctaatgtacagacatcggaaggagcgctaggaagcttttattattgaaggttttcagcgatattctgagaatgttttttcggctctggtgatcagttctcacatgcatcatcctttaataaacccatgcattaagattcgccttatcagcaagatcagataagcgaacagcttcatcaatgaaatagaatgcttaaatcttgtgaagcactgtcataagccagtttgataaaagcaatacccacaatatagttggatatcatttaccttgatctgctcttgctttcgaggtgacatagcatttttagccatctgattccttaggttcaaaggcactcatcattcctcctctaaaacacatttcaacgtcattcataatctggaatcaacataacaatatcctagaacacatcatcaatggtcactaacaatggagatggtgagcaccttgggatccgaagaaacggaaatttaaggcatccttccaataatatgaaaattcccagaagggctcaatcaacagttctcaattcaaacccattttatagtaggaagtattctatgtctaccttaacgccgagggatatatgtcgaagcgttgattctagagtatttgtggatatgtcttctcccaattttcagactctggaggatccccacagagatgagattataaacagtgtacggcttaactacttgaacagtagcaaaagaagttccgtctctcatggaaatgaagcaatccctagggttaatccgactaagaattcttcagcaagtaccatagctgcagcaaatgttgatagtgatgacgatgagactaacctgagtagcgctggaggcgacataacgcatgatatttacaagttggttaaagcagaggatcctaaacggctcagacgccctcggtccatggaaaatgtaacacctaaaattgagcaccatactaaattgtcatcagcaagtggtttaaatgtccccggtggcttcagaagggaatttattgtcaacaaaaaaaggcaagaacatcaattaaatgattccgctagctcagacttcacttcgcatgaaagcgattcgattaaccagtcatctccatcttctaaccaagatatcgataaggtcccctttttaacaagaaactttttggaatttctatacgtgtttggacattttgctggtgaatccttcgaggatgattttatccctgatagctcaaacatgatgatacgcggagaagatgaaaggagtgcattgctgtctcggcctgaccatatgaaagtattaccttcagccaaaggtacgacttcgacaaagaaggtttttttgatattgcttaaatctttcattggaactggcgttttatttttacctaatgcctttcataatggtggtttgtttttctcagtaagtatgctggccttttttggaatttattcatactggtgttactacatattggtgcaggccaaatcttcatgcggtgtatcctcctttggtgatattggtttaaaactgtatggaccttggatgagaataataattcttttctccctagtaataactcaagttggattctctggagcttatatgatatttactgcaaaaaatttacaagcttttcttgataacgtattccatgtgggcgtcctacctttatcttacctgatggtctttcaaacgatcatttttattccactttcgtttattagaaacatttcgaaattgtcactaccatctttactagcaaattttttcatcatggctggtttagtcattgtcattatttttacagccaaaaggttgttttttgacctgatggggaccccagcaatgggtgtcgtctatggcttaaatgcagaccgttggacgctgtttatcgggacggcaatatttgctttcgaaggaatcgggttaattattcctgttcaagactcaatgagaaatcctgaaaaatttcctttagtacttgctttggtgattctaacggcaaccatacttttcatttccatagctacattgggatatttggcatacggctcaaatgttcaaacggttatactgttgaacttacctcaaagtaacatttttgtaaacttaatccagctgttctattccatcgcaattatgttgtccacacctttgcagttgtttccagctattaaaattattgaaaataagttttttccaaagttcactaaaatatatgtcaagcacgatgatctaacaacaagagtcgaattacgtcctaattcaggaaagctgaactggaaaattaaatggctgaagaactttattcgttctataatcgtaatcattgttgtatcaattgcttactttgggtctgataatttagacaagttcgtttcagttataggatccctcgcctgtattcctttggtatatatatacccatcgatgctgcatttacggggcaatagccttccagagactaaaggggaattttggagattcaaaccaatgttagataccattttaattttcttcggtattgcaagcatgctttatacgtcttaccagagtatattcggtgtctagacgatatatgttgttgcttcataaagaatttatttggaatcgaggaacactattttgccattgtcgccattgacagcttgcagttgcaaacgtcttcttaattcactttatataaacaaggaccgccaggtcacagtattattcgcacgaaattatgtagtaggtaaaaaacactaaaagcattacccctatattgttatttaatgttccatctacgattagtaggtggtgagcatgtctgaatatacacaatttcatatttattatcaagttcaagattgccagaattttatttttttttccaatctgcgaataagcttgatccgattactccgcttaatgccccgacaacctgagaacttttaaacatatcaaggagtagagtgggattaatgacaatgtgatagtttcataattaaagtaagcagtcaaagacagaagcagcacaccatttaccaatacagcttccaaaatggtaaatttttatgatgacgtggatgagtcgaaatcacacggtgaattcccattaatacccgttgtgcttcaaaattcatcagagctatcagtcagaactatacctaccgggaatgaaatcattgagtcagtgcacctgaccaaatggttacggaaatatagaaacgcacttgccagtcaactagatcgttatgagaaggggtggcaatccaagatagccaactttaggctccaggtccaacatgttatcaattattcgagaaagaatattttcaatgttgattctgaaaataaacatactgtggtcccggggtcattaatagcgttaggtgccttttttgctggaagcatagctgtgaacaggtctaattggggagctaaaaggttgatatttggtcacaaatctagtatcctcgagaaactatgtacgtcattgccatctaggatattgttaccatgggtattggcagcagctacattcaagtattgggctccacagacatcacagaatttggtcaatgccactgaaaatgatttactgccagctgatttcgtcaagtcatatcacaatacttggaaacgaatttatgaggaaggatatgttgccaagaaatgtgatttaaaacgtcaaatcgatcagacattacaaaaaaatataaggtatgcaagggaacagctttatgaaaagttggagcaagcatgatatcaagcggatatctttttttgttcattatcatgtccatagtaagtatgtccatatataaatcggataattaatattctataaaattacccattaaataaatttcatttattttgaatttcatttcgtgtgatctttagaagttggttcgcgaatgggccgtgcatcctgaaacatttcaaactttaggtaaatggtcataaagctcagtgctttttctttatcttttgcattttttttttcttgcctctactccaaagctgtcagtaaccaacttggtgctttatttttgtctatttttactaaattagtgtcgaaagcttctataagcaactctacaagaattctaccacctctgctaccagtaaagcgtctatattcttcggatacactggctaagttccaacccattattcttctgagacatccaatgactgtcccagtcctatgtcttcccataccacagcacactagcaagggataattctcttgagtgacgatcgtttgtagtacattaattatagaatgttcagtgagaccgtcccatggattatcgtcctcaccggcatccgggttgatggctgcgaattgtaagtttattctatgagtatcacaaaactctaggagggtatcttgaggttcttcgttagacagccatataattgttttcagttttaggtttagtaaaaaggggaaattcacaggtgaaggctgaccagatctatagaggtatctttcaacgggacagaaattcaaaggtggaacgatacgttcttgtggggcatgtgataccaagaccttttcgcgaccagattctgtttcttcattgatatatatatgatcatcatcgtcgtcttcttcctcgtcttcgtcttctacttcttcttcaggtacggatacgttctcttctgtgaggcgggactcatcctctggaacgtcctcatattcaccaactttagatgtcattctaaggggaaagagaagcttgttattccaggtggaacacctctttcttgtgaaaatggatgtgattgatgactctctgcaatgtccaattttatgttatagcgatgttgtttgttttttcctttacccggcaaccatatgatattgcccaaagtttccaatgttaacaagaatgaaacggaaatagcaaatggcaataagcaatataaaaacagtcacttttttatttacttttgtatatatttataaatgtgtgtactcgtttcaactttatagagttcttttcgtcttagcgtttctacaactatttcctttttattaacttataatacaacagccacccgatccgctcttggaggcttcactggtgttaccgccgggtgcagcttgctgcttcctagcctgtttagcatttgaaacttgaccggccttactattattatttacacgattattaaccgtattagcgctttgagcgttggcctgaccagcttggcccgtggaattgtctatattggtgcgatcagtttgtgtcttaccatttgtcgcctggttgcctgccaaccctgtcttactctctatgcttgcattcctggcattcacgacagttgtgctactgttcacatttttaccgttggcagcattgctcatcttcctgtggccaccgctatttctaggcacagagttggcaccgctcccttttgtatcttgagaagtttgcttggagttgtcattttccgtcaaagtcttgttgtacttgccgccttcgtctctaactaaacgtgctagagtgtaaaacgcctcttccacgttgattgcttgcttagcagatgtctccaagaaaggagcgttcatttgctttgccatgttcaacccgtcctggtaagagacctgtttttcgttttctaaatcagatttgttaccaacaaccacaattggaacatagtcggtatctttgactctcaatatctgttgatagtaagtcataagctcatcaagagacgacttggacgttatagagtaaaccaataggaatccttcgccgttgcgcatgtattgttccctcatagcagagtattcttcctgccctgcagtatccaaaatgtccaatatagacacttcatcatcaatcaccacttgcttcctgtatgaatcctcaattgtgggatcgtattcatctacaaagtgcgattgggtcaattgtatggtcaaagcagatttaccaacaccaccaccaccaacgacgactagcttgtactctcttatgttcgacttgttcaaaggcatttttttttctgtatatctcctttcaattcgaaaacggttaacttggtttttttatccgtaattctctcgtatctttctgctcaagtaattttctcctagttgattaatatagtgcagaagagtcagataaagagtggatgaataaaatggaaaaaaaacaaaagccggattgcgttacgcttgaaatgagcgattctaggcgataagagaagacaacggctaaaacttaagatgttggggtactataaatgtttacccagattttcggtagaaatgtttgctgatgtgaaccttgtttcccgttttcccagatccccttattccagctttgtttcgtctttgctgtcatgttccgtttaatttctgaaggcctgcctagcttcaccgtcctaaatgtcacgctccaggcagagacatggcgcaggggcgaggccaggggcaaaggggtcaggcaggaacctccaaggggggcgaggtgaatgaaaaggtccttctgaataaaaagcctaagcgattagccacaccacccactgtacggcgattagactgagctgctggcgctgctacgccgtgacaagtcatttcatcatttattacgttttatcgtgccgtcatcaccatcgatttgaatattttatctagaccggtagggcccaagtatcttgcagatccattgatacggccacgcccgttaaaacgctaagatatatatatatgtagctaagatatatatatatgtatatattcggtatttagtagatatttccttaaggcgatattcgcccgagagctatttcacagtttttttttgcagtcgtcgcaataccacttgcccttaggtagagtttcgagtccaatacatggcaaatggaaccattctagctcacagtctgcgccatcacaccccaccatttccccgtatgccacttggttacagtagcagtagagcggttcgccgtagtcgttggtttttggtcttgatatcctgctgttgttgctgtttccgacgctgctaactcccctggacgctgtagatgtacctatcctgccattattgacggcagttgccgtgctgatagtgcttggtgaaacggctgtggtggcaactctcctcttgcgttttttggtctctggatcggcgttgttggtattggcagcgttggctctttttcttgagtttgtgttgttaccagtgtggtcttggctctcgtgcctgctgcctccgtagtttgcgtcgttctttgagtcgtcttgttggtgtgtgctggcggagtaatgttcgccctgcctcctgttggcagccatggcttctcttcttgattcgctcttcagtgcctgcgacgatttgctgtttgatttgctctctattttttccattagttcatgatggaggtgcattgctggatggttgtccacacccagtcttaaacctctaggaatttctgtgttcttgattgcgacttcatacgccaattctaaccgggacgtcaatctgtctagattatccagcataatggatgagacatgcattttctcctccagcgatggcatcagttcttcataaatcttgttgatattattgagcagtcttacttgtgtttggtgatctttattgaagtctttcttcaagaacttatctatcctctcgttcaaattcggcatagaatgcacacattttgcatctatttcgtgtagtaatgttaaatatctggaggtggccagtgggaattcctccagcacgtcagttatgtcgtttaatccagggaataggttcgctggtgaactcatttgtacgtatttcagactatgaacgtggttgctgtttgtgatactgcaagactacaaacttttctccttccgggttcgtcctgttgtaaacgcctaactcttttccttaggctcctttttcgttttttccctagctctttctttcttcttcatgtgcatgcactctttcctacatatttttttttcaagggcatttttaactttcttcggaaatcgtctaagaattgtaaactataattgcaaatacgcgattagctctatctagaataccgaaaaaaaggtttgccactcacaattggacgtgcctcaattatttcaagtatacgtcatttgggcttttgacttgtaaaatatactcaaatgaaattctgattatacaaagttgaaacacgtaacacgccatgtcaaggtacgcgtagaggtaagcagataatgcatggacaatgtgctgggcgaagaggcggatctaattacacatacttgggatcatctaagatttcagatggttatgttaatgctcacttgttccacgcctttttcctttccttcagataagtaatccgcatatcaatgtgaaagaactaacggttgttgatggacgtatcgttgtctagcgataaataatgctttttcttcaacaaataagtggttgtttggccgagcggtctaaggcgcctgattcaagaaatatcttgaccgcagttaactgtgggaatactcaggtatcgtaagatgcaagagttcgaatctcttagcaaccattattttttttcctttttatctgattgcagcgagaacttgggaaatcaacccaatatgtattccaaaatgtcaaaacaccaattaaagcatctctatattgacagatacaaaatatatttaagtatacattcataattattttactcgaattaaaaaagcccactttttggaaacctccttttgtattctcataactatgtttctttttttattattttttcttaatattattttctttaagtatgacaaatgatgagaatgatagttatctcactatttagttggtctggcttggaatttcaaaaacaatttgtttgccagtcaacttgttgtagacagcttggaaagattccaacttgtagtcgatttgttgaacatccttggagtctaacaaaaccttttggatcttgttaccaccaaccaaatatctaactcttttaccgacaatttcagttgggaaaaccatgtcttccaaaaccttgtcgtgaacagcagtcaaagttctggatcttggtctcttttggacttgtctagatgttctagatggttttggcaagattcttctttcagccaagaaaataacatgacggtcagggaatttcttttccaattcacgggtcaatttggtttggaccttatggtatgcagacaaagctggaactgggacaaaaaggactagtgctttcttaccaccggtgacatcaatctaaacaataagaatcaagcagcgttgaaataaagttagtaactgaattggttcattcataacaaaaaagggtttgtgattcttctccttggggtaaggtctttttcgcgtgcttctattttattcatcgatattggtactgaccaaggaggcctttatagttcaaaggctcatcgcaacgttcatggtattgacagctctcggaattactatttttctcgaacacatgaaaatttcatacagatactgctcaaaatcactcttttttgaaaaaattactgcaaagaacccctttagaagaaatcacaatgttgctgcttccaaattatataacttttaacatacttctctgatagatttgatttgcaatggtctcaagtcagcctttagttctggagaggagctttctagatcgatgaaggtcttggcgacttgtaattccaactcacttggagcttgggataagatcttggattggacagaggacattggtcagttatgtgtctagtctttagtgtgttggtttctcttctgtttgtatatacaaagtcaaataacacatattttaaccataatcaatagcatttggtatttccccctccgcgtattatgaacgcctagtgagcccattcttccctaaagccaggctggaaacccaaactgtgtggaacgtgactgaattgcatttggtgagttaccaagcaaaggctcgcaggcttgaaccacattttaccagggcgctcgctttttccgaaatattgaaattaagcaaaacaataatgtacggatttaaagaggtacggatggagaccgtagaaaattgactttttttttttttttgttattttctgtgcctttcgtaactactactatgcagaatgacaggtagttgttgtttcgaattgctactttcacgcattcaacttgatcaacatttctctctgatgaaaggttgtggaaagtttggtcgtgtctataagtaggtgttttttattagttctatataaaaatggagaatgttaattttaacccaccctaaaacagtgattaggagtggtaataattttttgtttaatggattaaaactaaaggttcatctgtactttcagaaagtaagacactaaaaatggcaagctaacaaccattagcgggtattgcagcattaagaaaaatgaaacacactccatttggattggcgcagttgtttctggcggcgtaaaactggcggtgaaatatataagggtagtcatcgttggcaagttccagctgattgctataacaaatagtagcattctatcatcttgccaattaacccatccagctttcactaaccgatcacaccataggacaccaaaaattggcatgacacattgtctcaaaatgacgagtgtcacagcggctttccaaaatccaggataaaggttgccaatctttaatcttcctaaagttgctcctaataatatcaacccaaatggaacacatgcggcaccgacataacctgtaaaatccatgaaaaagcttaatggtggtgcattgtcaggagcttggcttatgtgaggagtattagcggtagtcacgaacaaagccttgacccatgggataaatgcaacagttagggcgatgatcacggccatagagcacggtctcaaacaattctttaggaaaaacacaagtaatggagttaatgaaaattttctcatccactgtggtaatgattcgccggatgtttcaatatcctttttacttacagtggcatctgatgttaagatcctggttaggttagcagtttttatagtctgtaaagtggaatttgagctaattgaatgcacatcattcatatcagcgccgcgtaaactggaattcctcctttgatgaccatactggtcaacgttggagtactctctgataagatggtgtatattttgagaaggtaatgcacgcatatcaatggagcggataggttccaatgccgccatagacatattttttgggcatttttcatctaaacagttctcttctaggagtgtggtagtattgtaagctctcggctggctcgcggttctacgtgctctcatagtatctatgctactctcataactctctgacgtattataagaatgtattgttgaagcagatgattggctatctaatggatttgaaccacgagttgcctgtgactcttcgctttgagtgcacgcaatagtatttcttgccttcacctgaactggttttgtaatctttgaattcgaagaagtgtctggtagtgacaggggagctatactatttgttgatctccttgaaattggtggtacgtctgcgttttcaccctttgtacctatagcttcagtgagactatcgcgagcggtgtacttattgttgaaaagctgttgttcgtttgagaagaaacgctcgctagtatctgtattagttgtgtttgcacttactgcgggctgtgtctttgtcgtttctgaaaccctaacggcgctttcatcgtcgttgtactcgaaatcgctttcaatcagtcgaaacccccccaaattgaaaatgcaaattagaaacattgtcagaaatataatgacgttagccacacctttgttaccttcttcttccgaaaatacaagcccttggtccatagattgtaaatatgcaattggtaaatcacttatatttggaaacataccaccggcaagaataccaccgtaccattgtttaggaacaggcaggaatagcctaacaacgtatgcaaaaaagaacccagaaccaaatattaggagggcagacagacagataattcccacagatttgatgtctttatcttcaatattagcgacaatcttgttgaatgacagagagggtagtaaaactgttagcacgatatcagaaataattcttgttgcttcaaccgtaagaattcccattttagccatcagaaagccgactcctataatcaaataaatcttgattatcggcttaactgacacccatatcgcttgacccagagtaatgtgcaccatctgatgaaaatttgaggtttcaatccctttctctgtttgattctataacttctccaaaaaaattgcgctgacgctaattagtcactgtttatatcttttttagcgatgatttgtaacaatatgccataaaagcgttctctaactgcggaagtgatgagaattgaatagttttattcagaaggcaatatatcctaatatggcacaaaaaggcaacttgtatgcacaaaatgagcataagagttcaggcagaacgttgtgctcttgatccaaaggttaaaagtcatcgagtaggaagatattgtaaccttcgcgcaaaccgcagccgcagcgggtcacgtggtcgcgcaaatgatgatgagggcgcggtctaactttccaaacgaggttaccaacaattctcggacagataaagcattagaatagggtggcaacgcctttacggttagcttgttcattgtgattggtttgtgtatcttttcttggctttttatgcccacgagacataaagtatacgaagctgttatactattcgtgatccagggcaaaaatttagcatcattaaggcatatatatcgcaaatagtgggttgcacaaggctttcaataaacagtgtcatatgtttctctagctctgtcggtttgttggctataaagagtttgtctagtaatcgccgtcttttcttgggaccattaacacagacaaggacattgaaacttggctataagttccgtcaaagggggaaaaaattgctttggagaaggaataaaaagatgaatagtcaaggttacgatgaaagctcttcctctactgctgctactagcggtcctacttctggagacccacgaatgggtaagaaacaacggtttatgaatctcataagaaccacaaaggatgtttatattcctaacctgacgtcatccatttctcaaaagacaatggatggcatcaggagcactacgaattccttcgaaggttataatgacttgcctatggaattgccacataataccacgataacatattttccaacgtataccacaactaatttggttgaccctgacggtttgagtgcgcctcggaaagattttgaaactactgtcagatgtgctgtttcttatccaggaaatcctacaagcaggagaaataggtggttgctttctctttgtaaacaatatcttagaactggaacggcggaggccgatgttgcacctgttgttccccctcatctcgaagaggattctggagatttaaacgactcccaatcaagtatagaaagttctttgtcttcaaagagcgaaaataggtattcacatatgggcatccaagaggaagatgttctgaatgagagaattcaaggattcctgtccaaaaaagttcctaatactccagtggtggttgacctattgcccaaagataagctcagaggggatacggcttccttttttggtaccacggactcttatggtaatttactaatcaaggcagaaacagattttttaccgtccaagattaatattacattagatacccctatagaaggccatgcagatcccatatctgaaacatttccggccaattatgtctcgccctacggtattggtttaatcagtgatattgacgacaccatcaagcatactggcgttacgggtgacaggagatcgatgtttcgtaatgttttcatccatgatgttcaatcgtgggtaatagatggtgttcctctttggtacaaaactttacatgatgtcgcagacgttgatttcttttatgtttctaattcacccatccaaacttttactcttttgaaacaatatatttgcgccaattttcctccgggtccaatttttttgaaacaatactctggtaatttcttttccactatcatgacttcaagtgcgaatagaaaaattcagccgattgcaaatatcttaaaggattttcccaaaaaaaaatttattttggtcggtgattctggtgaacatgacttagaagcgtataccactacggctttacaatttccgaaccagattctggctatttatataagatgttgctctaattccatgagtgatgtcccatcgcatgatgaagaagttatgaatgaagtgaacaatatcatcgaattacaacaacggcccatgcaaatgaccaagtctaccgtacgtaccaggagaagaccaccaccacctcccattccttccactcaaaagccatcgttgacagaagagcaaaccgaaagtataagaatgtcacgccgtaataaagatgagaacaatgctaaaagagttgccccaccaccgttgccgaacagacagttacctaacttagacgctaatacttactatgtaccatcctcacaaaatgactatggcatgtatggtgctttcatggataaaaaagcagatgaatggaagagaagagtaatggactcaattcaaaaattgagcaatcaagacaccacattgatgttcttttcggatccggcattaagtttggaagacagtattcgcagaattagggagaagtattcaaactaaatacactgttatttatatacatcgggagggagtttaaaaattgtatacactaaagtgaccttatgaattggagccattttcaacgttttagagtgatgttgcatccttttcatcagatcgggaaattaaaaaaacggttatagaagggctaaatgtaaatatgtaaattttatgaagtcaagagtaaagaaaatcttcggttgccgatcaaatacactcttacaaaataccctaaactcagtttatctttccattccaactgattatcgcgtacgccttggtgaccaaccataccctaaaatgtcaatttccggggcggaaggggtccttaaactgcaaagcctcttcccatgtaaataaaataaatccgtagaatttattaaatattgtcatattataagtcgggaaaggccttctgaatgcacgtatattgaccaaatagagttagattcaaattatttattacattttttcagcatcgaagttaagtagaatggataaacatacagcagctattccaacattaactatcaaagtagtcttactcggagaatctgctgtcgggaagtcctcaatagtcctcaggtttgtatctgacgattttaaagagagcaaagaacctactattggtgccgcatttttaacaaagagaattacaagggatggcaaggtcattaaatttgaaatatgggatacggcaggccaggagagatttgctcctttagcgcctatgtactacagaaatgctcaagctgctttggtagtttttgatgttactaatgaagggtctttttataaggctcaaaactgggtcgaagaactacacgagaaggtaggacatgatatcgttattgccttggtggggaacaaaatggatttgctgaataatgatgacgagaatgaaaatagggctatgaaagcaccagctgtacaaaatctctgtgaaagagagaacctcttatatttcgaagcaagcgctaagactggtgagaatatttaccagatatttcaaacattaggcgaaaaagtaccatgtcctgaacaaaatacacgacaaagctctactcatgatcgcacaattaccgataatcaacgaatcgatctcgaatcaacgactgtagaaagtactagggagactgggggttgtaactgctaaactgcaagcaaaacaacagcaaacgcggcatattcagcgtcttagcgaagcttgccattgaaaagaacagttcgtaacaacagctggaagaatagtactggaaattttcaattacttttgcaaaacaagcacttttttgtttcacttccattagccgcaagaaatacactttttttaggggcgggaattttcatcgccagatcgagaatcacaaggcctttacgtactatagtttgtaatttatacaaaatcagctactgttattttggtgtaccagcggcaaaaattggtgaggatctgaaaattaattagaggtgaacacatatcagtaattttgactatggacgagaatgaatttgataatcaaagggagaataaagctgtagctcgagtgatcatatcatttcttaagtatgaagagtatgccctaaaggaaatctacaatttgagagtgaaaaaatgggcatcgatctcagatcgtcaaaaagacatggtaccaaactatacaaaatatttagctaatctgaaagccgcaattatagaaaatggcaagttctttagaagtgtcgccgaatatgccctgcaatcaataagttttgagccaggagaaatcgtacaaccaaacgatttagatatgagtaaaacatgctctttacttacgcaagtttatagggagtggtccgcagaggccatttctgaacgtaattgcttaaattcgaggcttgtaccgtttttgaagaccctatcacccccaaaagccgacattttgataccgggttgcggcacaggacgccttctcgtggatcttagcagaatgggctataattgtgaaggtaacgaattttcatatcacatgctgcttgtatctcaatacatgttgaatgcaggattactccaaaaccaaattattatctatcccttcatacactgtttctcccactggaaaaaaattgaagatcagttgtctcccattaaggtgccggacatagaagcgtggtcttcaaataaaggtatggggtccatgtcgatatgtgctggctcgtttgttgattgttatggtcgtaatcaaggcacaaaaatctcgtcacattatacattttcgcgaaggatgcaactaagtagagcaaaagctgaaaactccaaagacgttgtagtaacaaacttttttatagatacgggatccaacatcttggattatttggatactattggccacgtcttgaagccaggcggaatctggtgcaatttcggcccattgctttatcattttgaaaatgaccatggggttgaaactacctacgaagttaacccttactctgggtttcaagataaaatcaatgactatacaccactgatgggtttagagctttctagcgatgatatcataagcattgccacaaatcatctggactttgaattaatacggagagagtcaggaatactttgtgggtatggccgctacgcgggtccagaaagttgcgccatgcctggatacatgtgccactattggatcctgaagtcgaaccccaccaatgaatcataagcttacacaataatctaattgcactatatagaagttgctgacacagccgttttagagaactcagaatgttacccgcgcggaaaattctttttgctccctctcgctatgttctgtttaccatattgacagtactggttatcagcctagatccagtaatacataaagccctcaatttgaactatatatcaaagctagaagaagagtgatttgtcataattgattcactttataagctcctttatcgtttcagtttccaggtgcatttatcgcttaaggccattactttcaacaataagcaatctttataagtgaaaaattggggaaattgccaaagatgcccccaaactccaagagtaagagaagaaagaacaaatccaagcaacacaacaagaaaaatggcaactctgatcctgaacaaagtataaatcctacacagctagtacctcgaatggagccagagttgtatcatacagaatcggattacccaacttcaagagtaataaaaagagcgcccaatggcgatgtcatcgtggaaccaataaatacagacgatgataagaaagaacgtacggcgaacttgactcataataaggatagtatggattctgcttcttccttagcttttactctagattctcactgggaatcattatcgccagaagaaaagaaaactattctacgaatcgaaaaggaggaagtatttaatgtcataaggaattaccaggacgatcatagttgtagttgctctgtttgtggacgccgccatttagcaatggatcaagaaatggagcgtatatacaatacactttatgccatggataaggataaagaccctgaaaccaatcctatcaaattccacttaggcataataaaggagctacagatttccaaaaatcaacagcaaaatgatttatcttctacaaagggcgaagttgtaaaaaatttcctttcgtcaagtacagttggctctttgaaagaggaagtgctgcatttcaaacaaaagcaactttcaaaacaagaacaagcgcataatgaaacggcggataatacctcattacttgaagaaaatttgaacaatatacacatcaacaaaacttctagtgaaatttccgcaaatttcaattctgtgagcgatgaagagttgcaacaaaaatattccaacttcacaaaaacgtttatttcatcacatcccaaaatagcagaggagtatgtacaaaaaatgatgatgtatccgaatattagagcactgactgatgacttaatgaatagtaacgggcaaggatttcttaatgcaatcgaagactttgtgcgagatggccagatacaagcatcgaaaaaagacgacagcatcactgaagatgaagcatctagtacagatttgactgatccaaaggagtttaccacaatgctgcatagtggaaaaccacttacagaagatgagtatgccgacctccagcgcaacattgctgaaaggatgactaatgcgtacgataccgcaagtaagaaattcaaagatgtgtcacaattagagaaggagctatttacacgattcatgtcggggagagacaaaaaatctttcagagagttgataattcaatcctttaaaaataaatttgatggggaattaggtccatccgttctagcagccactttaagctcgtgcttttcatctcaatcgaaggatacttcgttagatactgattctatatatgaagatgaagatgaggaagactatgatgactattcagaatatgctgaagatagcgaagaggtttctgagtatgaaggaatagaggcagtcgaaaaaccagagcatgatgaaaaaagcaacgggatacgtgaaacattacatttaagttatgaccacgatcataaacgacagaaccaccctcaccatcactaccatagtaccagtacccacagcgaagatgaactgagtgaagaagagtatatttccgatatagaattaccgcatgatcctcataagcactttcaccgcgatgatgatatattagatggggatgaagatgagccagaggaagaggatgaaaatgaaggcgatgacgaagaagatacttatgacagcggtcttgatgaaactgaccgtttagaagaaggtcggaaattgattcagatagccattacaaagttgcttcaaagtcgaataatggcttcttatcatgagaaacaggcagataataacagactaaaacttctacaagaactagaagaagaaaaaagaaagaaaagagagaaggaagaaaaaaagcagaaaaaaagagaaaaagagaaagaaaagaagaggctgcaacagttagctaaagaggaagaaaaacgaaaaagggaagaagagaaagaaaggctaaagaaggaattagaagagcgtgaaatgagaagacgagaggctcaaaggaaaaaggttgaagaagccaaacggaagaaagacgaggagagaaagcgtagattggaagagcagcagcggagagaagaaatgcaagaaaaacaacggaaacagaaagaggaactaaaacgcaagagggaagaagaaaagaaacgtattagagaacagaaaaggctagaacaagaaaagctacagaaagaaaaagaagaagaagagagacaaagattaattgcagaggatgcgctaagaaaacagaaattaaacgaagaacaaacatctgcgaacatactttccgccaaaccttttactgagaatggagttggcaaccctgtttcatctcaatcacatcccaacatgactaactaccaagaggataatagttgcagtatcaacgatgaaatacttaaaatggttaatagcgtggctgcatccaaaccagtttcacccacaggctttaacgttcatgatctacttcttccttcaactaacaaccagatgcctgctatggaacaatcacacttgccacagccaggtaatcaaaacaaccattttggaactacaactattccgaatgcgttagacttggctacaaaatcttctttacagactgaaaacaactatttaatgaactcacaaactctggaaaatacaagtctattgatgcataataattcatcgccaactaagctattgccaaatgactttggtttatcatcttggggtggtctgacaaatacaatgtccataaatcctacatgtaaaccaccggttattcaaacttcagaaatggaatcacaagcccataaatctagtcctcaagctacaatgccatcttttggactacctaatggtggtactcaccgtaaatcgtttaccgacgagttgaacactttaactagcatgctttcttcttccgggttcgcagatacatcactttcatcatcaggattccccccatcacagcgttctgtgtggaatgatcaaaaaagctcattttcgggaccgtcgactgcaggaaactttaacaacagcagtatacaaagcggtatgctgctcgcacctacattaggaagcgttgaatcgtttccaaatcgaacttctatctgggacagcagcaccactccgatgatgaataaatccgagctttccggtcgcaatataactagtactgcgcaagatagccctgcgttcatggcatcaaatatctggtctagtaacagtcaatacaattcaccatatttgactagcaacgtccttcaatcccctcaaatttcgagtggagtggatgaaagccacattctggatagcatctacaatacttatttagctatttccccacaagatagtttaaacccctacattgctatcgggacactattccaaaatttagtaggacttaacttggattactcgacgtttatcaacaaattgataagcatgcaaggagcctacaattgcgaattctttactgataacaatggatccattacccacgttcgatttgcgagacaaactcccgctggccactcaaaggggttgctgaatcaactctttagtggattgaacgatccaactgctacaccatttacgtcaaggcctcatacctccacaagggctagttttccaattgcctcttcaactacgcaaacgtcttaaatttgctccggtacgcagggccaaaaatatttacatacatacataattcgacgaaatttcagaagagacactaaacaatcgtacatctctctactcgatgtgagccacgcgtcggtttttcttaccgtcgtggctttagaggtgaggctgcgacaccccatacatcttacccggcatttaatttccatttttcgcaggaatgtgaatatgataatagacttcggtacactcttttttaggtataacatatatcaattgttcaacaacaattattcaaagcgcaactctccaaaggtagttattctgataatttgaaccaaaagtccccagattaagtcttaattaaactgcccttgcataccgctgtaaacgatttgtgtgcagacatcaattgctgaaacgttctgctttggttgtgcttttgatcccgtactatgtctgaaaaggccgttagaaggaaacttgttattattggtgatggtgcttgtggcaagacctctttactatatgtatttacattaggaaaattccctgaacaatatcatccgacagtgttcgagaattatgtcactgattgcagagttgacggaataaaagtgtccttaacgctctgggatacagcgggacaagaggaatatgaacgtttacgtccattctcatattcaaaagcagatataatattaattgggtttgctgtagacaattttgaatcactaattaacgcaaggacgaaatgggcggatgaggcattacgatattgtcctgacgcaccaatcgttcttgtaggcttgaaaaaagatttgaggcaagaagcccattttaaagagaatgctaccgatgaaatggttcccattgaagatgcaaaacaagttgcaagggccattggggccaagaaatacatggaatgtagtgcactgactggtgagggtgtggatgatgtctttgaagtagctacaagaaccagtttgcttatgaagaaggaaccaggggctaactgttgcataattttataaaaaaaacttacactgaaatgatacattatctttttagcaagggagggaaaaacaataccgtattataattttaatcaaatttcatagatataatggaataagttaaaaaggcttatcgatagtgcatgtataaaacacaaacccattcgatatgtttgttcgttaatgtcctacagattcttattcgagagcctttaccagaagcaaaatttccgacggatataagaaaatggcacatcaaaccatagctcaaggtactgcgccgatgagctaaacggaactgcctagtttgattatttttcgtttatatacttatttacttatttacgctatttgtattcgaattccttacgaggcgatgagtgaaagacgcgccagtaggacgcgtcttttttttttcagtataatgtaaacatattattgaattgccgaaggagacaaaaagaaaagaaaagaggagatcatctttcatataatccaaccacgtcgtagagcaaaccacgacaattttaactttctgtttcagttaaaggagtttataacgaccagcacggctaaccatgtcaactgaaccggtaagcgcctctgataaatatcagaaaatttctcaactggaacatatcttaaaaagaccagacacttatatcggttctgttgaaactcaagagcagctgcaatggatatacgatgaagagaccgattgcatgattgaaaaaaatgtcacaattgtaccagggttgttcaaaatctttgatgaaatcttagtcaatgcggcagataataaagttcgtgatccatcgatgaaacgaatcgatgtaaacatacatgctgaggaacatactatagaagtgaaaaatgatggaaaaggtattcccatagagattcataacaaggagaatatttatattcctgaaatgatatttggtcatttgttgacatcatccaattatgatgatgatgagaagaaagtcactggtggtagaaacggttatggtgctaagctttgtaatatattttccactgaattcatattagaaactgcagatctaaatgttggccagaaatatgttcaaaaatgggaaaataacatgagcatttgccaccccccaaaaataacatcttacaagaagggtccatcatatacaaaggtgacatttaagccggatttaaccagattcggaatgaaagagctagataatgatatcttaggagtgatgcgaagaagagtttatgatatcaatggttctgttcgtgacattaatgtctatctgaatggcaagtccttaaagataagaaatttcaaaaattatgttgaactctacttgaaatcactcgaaaaaaaaagacaactagataacggtgaggacggtgccgctaagtctgatatcccgactattctttatgagagaataaacaacagatgggaagttgcttttgcggtttctgatatctcttttcaacaaatttcttttgtgaattccattgcaactaccatgggtggtacccatgtcaattacataacagaccaaattgtaaaaaaaatttcagaaattttgaagaaaaagaagaaaaaaagtgtgaagtcttttcagattaaaaataatatgttcattttcattaattgtttgattgagaatcctgcatttacctcacaaacaaaagagcaactgacaacaagagtcaaagattttgggtcccgttgtgagattcctcttgaatatattaataagattatgaaaactgatttggctacaagaatgtttgaaattgccgacgcaaatgaagaaaatgcgctaaagaagtctgatggtacaaggaaaagcagaattactaattaccctaaactggaagatgccaacaaagccggtacaaaagaaggctataaatgtactttagttctgacagaaggggattccgccttgtcattagctgttgcaggtttagctgttgttggtagagattattatggttgttatccacttcgtggtaaaatgctgaatgttagagaagctagtgctgatcagatactaaaaaacgcggaaattcaagccattaaaaaaattatggggttacaacatcgcaagaaatatgaagatacaaaatctttaagatatgggcatcttatgatcatgaccgatcaagatcatgatggttcgcatattaaaggtttaattataaactttttagaaagctcatttcctggtcttttggatatccaaggtttcttacttgaattcataactccgatcatcaaagtttccatcactaaaccaacaaaaaacactattgcattctacaatatgccggactatgaaaaatggagagaggaagaatcgcacaaatttacttggaagcagaagtattataaaggattagggacttctctagcacaagaagtccgagaatatttttcgaacttggacagacatttgaaaatattccattctttgcagggtaatgataaagattacattgatttagctttctccaagaaaaaggcagatgaccgtaaagaatggctgagacaatacgaacctggtactgttttagaccctactttaaaagagattccaattagcgacttcattaataaggaattaatccttttttctttggccgataatatacggtcgattcccaatgttttagatggatttaaacctggccaaagaaaagttctttatggttgtttcaaaaaaaatttaaagtcggaactgaaagtagctcaacttgcaccatacgtgagcgaatgtacggcatatcaccatggtgagcagtcattggcacaaactattattgggctagcccaaaactttgttgggtccaacaatatttacttgctattacctaacggtgctttcggtacaagagccactggtggtaaagatgcagcggcagcgagatatatctacacagaattgaacaaattaactcgtaagatatttcaccctgctgatgatccattatacaaatatatacaagaagatgagaaaacagtggagccagagtggtatttaccaattcttcctatgattcttgttaacggtgctgagggtattggcactggctggagtacttacattcctccattcaacccattggaaattataaagaatataagacatttaatgaacgacgaggagcttgagcaaatgcatccgtggtttaggggatggaccggtactattgaagaaattgagcctctgcgttacagaatgtacggtaggattgaacaaattggagataacgtcttagaaataactgagttgccagccagaacttggacatcgactataaaggagtacttacttttaggtttaagcggtaacgataaaataaaaccctggatcaaagatatggaggagcagcacgatgataacatcaaattcataatcacgctatcacctgaggaaatggctaaaacaaggaaaataggtttttatgaaagatttaaactaatttcgcctataagtttgatgaatatggtcgcatttgatcctcacgggaaaatcaagaagtacaattccgtgaatgaaatattaagcgaattttactacgtcagactagaatactatcaaaaaagaaaagaccatatgagcgaaaggttacagtgggaggtagagaaatactctttccaagtaaaatttattaaaatgattattgaaaaggagttaacagtcaccaataagcctaggaacgctattatccaagaacttgagaatttagggttccccagatttaataaggaaggtaaaccatattatggaagtcctaacgatgagatagctgaacaaattaacgacgtaaaaggcgcaacttctgatgaagaagatgaagaaagttcacacgaagatactgaaaatgttataaatggtcctgaagaactatatggcacatatgaatatttattaggaatgagaatatggtcattgaccaaggaaagatatcaaaagctgttgaaacaaaaacaagaaaaggagacagagttggaaaacttgttaaaactttccgcgaaagatatatggaacactgacttgaaggcttttgaggtgggatatcaagaatttttgcaacgagatgcagaagctcgcggtggtaatgttcccaataaagggagcaaaacgaaaggtaaaggaaaaagaaagcttgttgacgacgaagactacgacccatcaaaaaaaaacaagaaaagtactgctagaaagggcaaaaaaattaagttagaggataagaattttgaaaggattttgttagaacaaaaactagtaaccaaaagcaaggcgcctacaaagattaaaaaagagaaaacgccttctgtttcagaaacaaaaacagaagaagaagagaatgctccttcttccacgagttcttcttctattttcgacataaagaaagaagataaagatgagggcgaactgagtaagatttcgaacaagtttaaaaaaattagcacgatttttgacaaaatgggttctacttccgctacatcgaaggaaaatacaccagaacaggacgatgtagccactaaaaaaaatcaaacaaccgctaaaaaaacagctgtaaaacctaaattggccaagaagccagtcaggaaacaacaaaaagttgtggaactatctggtgaaagcgacctagaaattttagattcatacactgatcgggaagatagcaataaagatgaagatgatgctataccacaacgatcaaggagacaaagatcgtcgagagctgcgtcggttcctaagaaatcttacgttgaaactttagaattatctgacgacagtttcatcgaagatgatgaagaggaaaaccaaggatcagatgtttcgttcaatgaagaggattgaataatatttatccagagaaagcgccattctttttatatgtttatatcagaaacaaatagaagtcgatcgtaatgactagattatataatcagaaatagcctttggtgatcacttccattttagtcagcataatagaaagtttaattacgcgcttttttacattccgacaaagatctgcccgagaaaattcttcgagaagacaacaacaacaaaaaaaataaagcctgggcgaaaaacatcgtgcgtttacataatatcttgaaaagcaaacagatatataaaccgctattgaaattacctttttaagtattcgcctagaagccttgtttcaagtagcatcaacaacaggtgttaggttaaactgctttgactttttgttctttaacgaatatcattaaaaaaaaaggacatctataaagaatgtctccaaactcgtcgaaaactcgaacggaccagataagctccatgcctggtattaatgaagccacgaaggtggaaagtaagaatgttgtgaaggatgctgttccaataaaatctgaagttgaaaccaatggtacatcaatagtaagagaaaaacaagatccatcgtacgttggttggaaacaagttggtggttgggaggaaaaggacgagttaacttccgaagaccttttagtggacgtaaacaaggacacttttttggggaaccttttaccagataaattctatggtgattggtatcatgaagtcgctattctcatcatcgctggtttatgttcctttgtgctgggctattttaaattctctctcgcgtccgtccttatcgtgatgctaaccacaggaatgttatatagaacttcgtccaaaaaatatagggaatcgttaagggatttagcccagaaagaacaaactgtagagaaaattactagtgattatgaatctgtcgaatggttaaacacctttttagataaatactggcccattatcgaaccttctgtctcccaacaaattgtcgatggtacaaatactgcattatctgaaaatgtggcaattccaaagtttataaaagccatctggctggatcaatttacgttaggtgtgaagcctccaagaattgatgccataaagacattccaaaatacaaaatctgatgtcgtagtcatggacgtatgtctatcattcactccacacgacatgtctgatcttgatgcaaaacaatgcaggaattacgtaaattccaatgtcgtattaaaggcaaagatattcggaatggacatacctgtttcagttgctgatattttttttcaagtttttgttagatttcgtttccaattgatgacaactttgcctcttgttgaaactataaatattcagttattggaagttcctgaagttgattttattagtcgtttattgggtaactccgtctttaattgggaaatcctggctattccaggcttaatgagattgattcaaaaaatggcatttaaatacttgagccctgttttactcccacctttctctttgcaacttaatataccacaacttctttccaagactggcttacctataggtgttttggaaatcaaagtcaaaaatgcccatggattaagaaaacttgtgggcatgatcaagaaaacagttgacccatacttgacatttgagctctctggtaaaatagtcggtaaaactaaggtttttaaaaattctgctaatcctgtttggaatgaatccatttacattctgttgcaatcttttactgatccacttacaatagccgtatatgacaaacgcgaaaccttaagcgacaaaaaaatgggtacagtaattttcaacttgaataagttacatgcaaatcactatcacaaaaatgaaaaggtacatttcctaagaaattctaaacctgtcggtgagttgacatttgatttgcgatttttccccactattgaaccaaaaaaattactgaacggtgatgaggagcctttaccggatatgaatacaggtatcaccaaaattactattcgcgaactcaagggactggatgaactaagtgacaaaaaattcgtctttgcagagttgtatgtcaatgcagaattggtgatgaccacaaagaaagagaaaagaactgcccatttgaaatggaactcagattattattctgtggtaacagaccgtagaaagactatctgtagatttgttttgaaggatcagagtggtaaagtaatttcatcttcggtacaaccattaaatcatttgatagatagaacagaagtcaataaagaatggattcctttaaggaatggaaagggagaattaaaagtcaccacttactggaggccggtagatatcgacctcggattgaaaagtgtaggatatactactcctatcggtatgttgagagtgtttatcaataaggctgaaaacttgagaaatccagatagcttaggaaagataagtccatacgccaaagtatccgtcaatggtgtggcaagaggtaggacaaatgaaagaatagagacattgaatcctatctggaaccaatcaatttatgtgtctgtcacatctcccttacaaaaagtctcaattgactgtttcggtatagatacaaatggcgatgatcataatctcgggagccttaatattcaaactcagaatatatatcataaagacaatgacgataaatataccatttttattgacaacgctccaagaactggcaacttaattggaaagaagggtgtaaaggggaccgttacgtattatttatcattttatccagttgttcctgttttaagcttggaagaggcgaaggaagttgacgagattaatgagaaaaaagataagctagaaaagcagaaaagtacactggatgacaaaaacatctcaaaggaggagaaagaaagaattaaaaaggaagagttcaggctcaccgaaaaatatgacatgtatagttacaaaatgaagcttgacctcgatgaattgctgcaatacaatgctggtgtactaggtgttactgtattaggcggggaactaccccagcctgggctctatgttcaaacattttttgattcctgtggttacgcagcgataactagtgcaaaaaatgctattaggaccattaaaacaggctggtcgggcgatttcatgataaaagagctggaatggtccgtgactacatttagggtaacaaagactaaagacgcgaataaggcggaaaattttatttgcgaagtcaacattccaacaattgaattggtgaggaactgttattacaaaccttccgtattaaatctaatagggaaaaagagtgccaaactattagttcaagtgtcatggttccccgtaactgccacggaattgcctcaatcagacttgataactaactctggtgatttgaaaatcaccgctaaaagtgctgaaaatctaattggtgttaataagaatggttattccgatccatatgtcgaattctttttgaatgaaaagagcacatcacccttctttaaaaccgcagttcaaaaaaagacactaaatcctacctggaacgaaagcaaaactatcgaagtttcaaatcgtgtcaatgactacttgacaattaacgtgaaagactacgaatccactaactccaataggagtattggaaaagccgttgttccattatctactattgatccagagagcgataccacctttaatataccgttagtgggaccaaagggagaagatggcggtgtgctacatcttgaatttgagtttgaaccccgctatactaccaatgtagtcaaacgtgaagccgggcttggaaattttgccacgaaaggattaggtacaggcatcaaagctggttctacagttttcgccttaggaaccaatgttgtaagcaccggattaggaacaattgataaagtaaaggccggagtctttggtggcaagaagtctacaaccactggggacaaaaaatccgaagagaagcaataattctatcgatggtaaagagtatgtgtcacgaaatcatcttgatgccgcaatgtacgagcaaaaaaagaaaagagaaatcaatcttaacaactcaaccatgccgagtgctactatagtacttttctttattactacgtatgtaaattgtaacaaatgtgtacttttatgtgtgttcttaaatgggaaactacttagcgttttgttcatttccagtgttaagtaggaagaatgactgagcgaaaaaaaccgtagaagtagaacttaaaataagaacggaggctaaaccaccaaaacagctcatcaacagttaaaacaccaccaatatttccagaaaaaagaactgtagatatagtctcattagtatttagaagaaagaggattttgcaatggcaggggatagtataagcgctgacggcactggcgtccatccagttgaactgtcggtgtattcagtattgtccaccgatttagacggactgtatcaatcgatcaatgaattacgcgagtcgcaagcactactcatccttatgcttcggaaggttcgcgataaacttcgaagagaaggtcaagtcctttatgacccagaaccattcaaaccaaccatggataaactggctgacttatctgcccgtgtgcgcattctctcacaaagatacgaggagcttcaggggaatgctagagccctcaacaactaagtaaacatacacatgtatagcataatcttcgattccttttacccattcgtagatggcatcgacagtgtacttataatactaccgtgagaaacgatattaagaacaagacgaaaaatggtggaaaatctggaaagcaagaacgtagcacgctagagttattctagcttgtcagctcgactgtttaattattattgttattatattaacattaacgtaataaccattgaactacattaaagaaataactgtctcgcttatatctggtctattttttgttttttgcctttccttttaaattctttataaccttgaaaacaaaaaatcacattggtaaattacaatcatttattaccaaatttgtccattaactattttagcgtgactgactgataaagactgtttcactctctttatttattcataacaaaaattcagatattttgaactataaagtactaaaggcagaaaaattaatagcaaattaagcgatggcaatcaagtcattggaatcgttccttttcgaaagaggtctagtaggatcctatgccattgaggctctgaataattgtaccctggatatagacgtcaaccattatgtttccagattgttgaccaataaaagagaacagtatttggatgccattggtggtttccctaccagtttaaaaatgtatttggaaagcgacttaaagatattcaaggatttcaatattacccctatttttgtctttaatggtggtttgacttacaaccaattagaggcatcgggccattttactgcagcatctgcttctgcgtcgatttcgtcaaccactacttccagcagcggtaccaatgccacaacaagatccaacacggaatccgttcttttgcagagaagtagaggctggacacaatggaacaacttgattagttcgaatcagaattcctatattgaccagcctattcaaccccaagagccattcagacataacaccacaattgactccaaagcttaccaaaacgatttgatcgcttattttattgagcatgggtatatgtaccaagtggctccttactcctcttggtttcaactagcatatttattgaatagcgcttatattgatgcgatctacggcccaactgattgtttgatgctagattgtgttgataggttcattttgggtatggaatttccaaataaagaatttcgattcattgacaggtcaagagtgatgaaggatttaggttgtacccatgaagagtttatcgatattgctatggctgtaggtaatgatttgcaaccaacaactttaccaccattgcaaatttatccagttcctcagctgtttgatattgctctagaaatggttttgaatacaggtacaaacttctatgcctatcaactatctacaaccttacaaaatgactccaaagagaatattcaaaactaccaaagaggtatttctgcattaagatacatgccagtcttgaaagatacaggtaaagttgaattatttgttcaagagatcgttgtttcagaggaggacagtgaaaagaataacaaggatggaaaaaagagtaatctttcctcaccatcttctgcgtcatctagtgcttctcctgctaccaccgtgactaagaacgctagtgaaaagttaacttatgaaaaatccagcactaaagaggttagaaaaccaagagatattcctaatgatgttcatgattttatcggccaaatgttacctcatgaatactatttctatagatccataggactggttactggaaaattatttgacgcaattgtcacaggagtttatcctgaagagcctccattgggcggaggatcttctacatcctacaagaaactggtttccaagtccgttgaaatcttcaagaataaagaaatcaatttattaactcaaccaattaacagatactatcagattaaacaaattaaacaagtcaagtggtatgcggcaaatgagcctaccactttgaccaacaggatgtcaccttctatgtttgaaactatcaaccacttaattgttaaaacagaaacgtctgatgaaaaggaattttctatctctgagttcattacaacaataaatggttctagcaatatggcgaaagattttatatctgaaaaagtcattttcccaaactccgtaccaatcgaatccaaattaaactcaccatttaatttattgtcgaccaatttcttaagattactagtactattggagttcttcacttttgatttcaaggaaaaactgctagagcctacgagatggggtgaggtattcttaaaattaaatgagctcaatattgacagtaagtatcacgaatcagttattatctttttggtatttttgaaatgcgatgtcttaaaacttgacgaagaagttcaaccaccggctccctcagccctatctcaagccactcttcgttcatatcctgaagaatcattgtacgtcctattgattacgcgtgtattaactttatttcaagtggaccaaaagccatcaaattaccacggaccaattgataagaaaactttgatctttagagatcatctttctttcataaaggaaaatttaaatgaactttttgaagccgttttgatctcatctttaacttctggcgagtttaatagattatcacttgataactttggttgggcaagaaagattgttagatatttaccgttcaaattagattccccaaatactataatggctatgatgtgggagtttttcttacaaaaatatcttcacaatggtaatgccaagaatgatgcattgtctttagttgctactgaattcaacacttacaaatccacaccaaatcttgatgaacagtttgtcgaatcccatagatttcttcttgaaatttcaaaagtcatgcaggagctaaatgctgcgaaattaatcgatgaaaacgtgtttaaattattcactaaagcagttgagtttactacaacagctctatctagctgaagcgtgagaatgagtatgatggaaatagtggaactatttaaaaagcacccaataaagaaagatagttactgtaaagaggtatattatcattattcagagggttcaagtaccatcatcaagatttaacacaagcacagtgaatagcaacaattaaagaaaaaactaatcaaaatcacggtagaaataggagaaaaaaagtaaaacagaaactaagtcactgtttctttatatgacatattctattatataaatatgtaaagaacgctgaacagtaaaaattttatgaaattccggcagagaagaaaaggaaaaaataagtatacaccacaccgttactggatagattgaagttcaaatcaaaaaagtttacaagtgaaataacaaacagtaaatattacacattcatgtacataaaattaattatcggtgtcaattgatttctgcttgtaatgcttgcaattcgtgtctcttattgttcaagtaattctccaatacttcaacctgctgttcaatgttatccaagtcatcagttatcgacctgatgttaatccgcttagaaagttttgagcctccttgagttttttcactctttttgtagttcaaaaggccttctaattgttctctcatgttcgcaacttgatcatctgtcagagaagcatatttttgctttatactgtcttcatttgaaagcacgttactgccactgctatcggaactcgagttctgcccattgtcacgcagattgtccacttcgttagcttcttcttttctctttgtaggaggttgagaggaccgtaaatcatagctcagttgttttttattgcacacctccgccagagaatttggtaaacttgctggaatttcagcacccaaatcatttctttgtcttaaacagtgaataaaataaaaagtaggatctctatcaattgatggcaaattttgtgggttaattaaactccaaaccttatttaaatctgtcttactgatgttaaaaaattttgtggaaagttttgttgacagttcgttgaatgtaatagtaccatcggttagttttgcacagctattataaattttttcatattgattcaaatcatctggagacatgtaccaatctactttgatttccttctttggaggcaagtctgcgttttctatttgcttgcgcttctttctttctttgattagattcaccttactccctggaatcaaccaatcaggcaattcatctggaacagagctaatgtttttattaaccatatcaaatattaatctcatgcaaattacaaattcctcaaagtctaaattgtcgtcgtcatcaatatcagctaaaaaccaaatcttgtttagaaccgatgaatctaatttggaattataaagaattggtaaaacctggtcatggtttaccttattctctattggtttcaaacccgagaagatttgccagtatttttttatttcaaattgttccaacttgggcatttttcagagatccctgttatctttaccggcctttccaatacccactaactctatggttatattacaatcgtctgattataacaggcaattaaccttgtgtttctgacgttcttttcattcattcttgatatgttaaatcataggggtcctacacgatcgtcaaatatgatatttaaaaagtaataaataaaaatgcagcttttttattagcgatgggaaatattgaatatttgaaggggcaaataacgtttaattcaatcgaatgacggtctaaatgctgctgaaaaattgcgagacggacaagcagcgagatatacggtatgcgtgtttgttcaaggaacttgatgttaagggaaatggtcaagttactctagataatctgataagtgcttttgagaagaacgaccatccgctcaagggaaatgatgaggcaatcaaaatgctgtttactgcaatggatgttaacaaggactctgtagttgatttaagcgatttcaagaagtatgcttccaatgccgaatctcaaatttggaacggcttccagaggatagatttagatcatgacggtaagattggcattaacgaaataaataggtatttgtcagacctcgacaaccagagcatatgtaataatgaacttaatcatgaactttcaaatgaaaaggtgaacaaattctcgaggttttttgaatgggcgtttccaaagagaaaagccaacattgcgctacgaggccaggctagccacaaaaagaatactgataatgatcggtcaaagaaaaccaccgactcagatttatacgttacatatgatcaatggagagactttttgctgctggtaccgagaaagcagggttcgagacttcatactgcttattcctatttttacctattcaacgaagatgtcgatctgtcctcagagggagatgttactctcataaacgatttcattcgcgggttcgggttttttattgctggtggtatttcaggtgttatttcaaggacttgtaccgcgccatttgatagactgaaagtgtttctcatcgcaagaacggatctatcctcgatcttgttaaattcaaaaacagatctccttgctaaaaaccccaatgctgacataaacaagatatcatctccattagcaaaggctgtcaaaagcttatataggcaaggcgggataaaggctttttatgttgggaacggtttaaacgtcatcaaagtttttccagaaagttcgataaagtttggttctttcgaggtcaccaagaaaataatgaccaaattagaaggctgccgcgacacaaaagatctttcaaagttctctacttacattgctggtggtttagctggtatggcagctcagttttccgtttatcctatagatactttgaaattcagggtgcagtgcgctcctttggacacaaagttgaaggggaataatttgctctttcagactgcaaaagatatgtttcgagagggggggggtcagattattttacagaggtgtcacagtcggtatagtgggcatatttccctatgctgcattagatttggggactttttctgccttaaaaaaatggtatattgccaaacaggcaaagaccctgaacctaccacaagatcaggtcactctaagcaacctggttgtacttccaatgggtgcattcagtggaactgtaggagcttctgttgtttatccaatcaatcttttaagaacaagactacaagcccaaggaacatatgcacatccttatgtgtataacggctttaaagatgttttgttaaagacgctagaaagggaaggttatcaaggtctatttaaaggtctagtaccaactttagcaaaagtatgtccagcagtttccatcagctatttatgttacgaaaatctgaaaaaattcatgaatctggagtagtgataataacatatgcatatgtatcaactagtgaattctatttaattataaaccgctgctgcggtttgtgggcgtactgtcagccaagctttcgttataatatatattcttttcaacatgtacatagctagaactctagaaagcacagattaataccgattctaatacagattttaatgacctcaatagttaattgatatttgataaaatattataaaaatcgtctataacagaacgcgaaaagaaaagacgcgtctctcttaataatcattatgcgataaaatgtttcaccacatcgaaaacttattaattgagacagaaaaaaggtgtaagcaaaaggaacagaggtatatccctgtgaaatatttatttagcatgacacaaattcatcagataaacgatatagatgttcatcgaattacatctggacaagttatcaccgacttaacaactgcagtgaaagaactcgttgataatagtatagatgcgaacgcaaaccagatcgaaataatctttaaagattatggtcttgaatctatcgaatgttctgataatggtgatggcatagacccttcaaattatgagttcttagctttaaaacattacacatcaaaaattgcgaaatttcaagatgttgctaaagtacagacgttagggtttagaggggaggccctatcttctttatgtggcatagctaaactaagtgtgataacaacaacttcaccaccaaaagcggataagttggagtatgatatggtcggtcacattacttcaaagacaacgacatcaagaaataaagggacgaccgtgttagtttcgcagttatttcataacttgcccgttagacagaaagaatttagcaaaacttttaagcgccagtttaccaaatgtctcacagttatacaaggttatgcaatcataaatgctgccattaaattttcagtttggaatatcacaccaaagggtaaaaaaaatctaattctatcaacaatgagaaattcaagtatgagaaagaatatatcctcagtattcggtgcaggtggtatgcgtgggcttgaagaggttgatttagtgcttgatttaaatcccttcaagaatagaatgcttgggaaatacaccgatgatcctgatttcttagacctcgattataaaattcgagtgaagggctatatatcacagaattcgtttggttgtggtagaaatagtaaggataggcaattcatttatgtgaataaaaggccagtggaatactctacgcttttaaaatgctgcaatgaggtttacaaaacgttcaataatgttcaatttccggctgtatttctcaatcttgaattacccatgagcttaattgatgtaaacgtcactccagacaaaagagtgatactgttgcacaacgaacgggccgtcattgatattttcaaaacaactctcagtgattattacaatagacaagaattagctcttcccaaaagaatgtgctcacaatcagaacaacaagctcagaaaagacttaaaacggaagtctttgatgatagaagcacaacacacgaatccgataatgaaaactatcataccgccagaagcgaaagtaatcaatccaatcatgcacattttaatagtactactggcgtaatagacaaaagtaatggtacagaactaacttctgtgatggacggtaattatactaatgtcactgatgtcatcggttcggagtgtgaagtttcggttgattcatcagttgtattggatgagggcaactcaagtacaccgactaagaagctgccaagtatcaaaacagattctcaaaacctaagtgatctgaacctgaataatttttccaatcctgaatttcaaaatataactagtccagataaagcacgtagcttggaaaaagttgttgaagaaccagtttattttgatattgatggtgaaaagttccaagaaaaagcggttctatcacaagcagatggtttagtttttgtagataatgaatgtcatgagcatacaaatgactgctgtcatcaagaaagaagaggaagtactgacacagaacaagatgatgaagctgactctatatacgcagagattgagccagttgaaatcaatgtgagaactcctctaaagaactcacgtaaatcgatttccaaagataattataggtcattgagtgatggattgacgcatcgcaaattcgaagatgagatattggagtacaatttaagcacaaaaaattttaaagaaataagtaaaaatggcaaacaaatgagtagcatcataagtaaaagaaaatcagaagctcaagaaaacattatcaaaaataaggacgaactagaggatttcgaacaaggagaaaagtatctgacgttaacagtttcaaaaaatgattttaaaaaaatggaggttgttggacaatttaatttaggatttatcatagtgaccagaaaagttgataacaaatatgatctgtttattgtcgatcagcatgcaagtgatgaaaagtataatttcgaaacactgcaggccgtgacagtttttaaatcgcagaaattgataatacctcagccggtagaattaagtgtcattgatgaacttgtggtgctggacaatttaccagtttttgaaaagaatggattcaaattgaaaattgacgaagaagaagagtttggctccagagttaagctgttaagcttacctacttccaaacaaaccctttttgatttgggtgattttaatgaactgatacatttgatcaaagaagacggtgggttacgaagagacaacatcagatgttccaagattcgttctatgtttgctatgagagcatgtagaagtagtataatgataggtaaaccgctgaataagaagactatgaccagagtcgttcataatctcagtgaacttgataagccttggaattgtccccatggacgtccaacaatgagacatttaatggaattacgtgattggagctcattttcgaaggattacgaaatatgatctagctttgatattcattcattatataattaacaaatacattatatacagggagtgacaacacaaaatatactcgtgcattgaagatgcttgatggatatatgtattacgacataaagcttagccattaagaatatgaacgtggctttaatttgtttatatgtggagagtataatcacttgccaaagatacaagaccaaagggacggattatgttgtacttttgcttgagaaaatgtgtgaattccacgtctatcgattttattaagcttccttgcagttttcgcgttgtttcttgtatgctggcccctaactggcagatgcaatgtatgtctcataccgctataactcccaatttttctttttagagctatattgtcttttacgattgctctagcgtctccttcaatcgtcattgtcgacagttcactagctatactcatgatttggggttctgatagttggtgcatcctcatccaagggtagaaccctaacttcgagcatatcttttcggctgttgttttacctatgccgtaaaatttagaggccagtgcgattttaatgacctctttacctttgaaacctttacccaagatgtgaacgaccatggttttgatggaagacccgacttgatttgctcttgaatcgtctcttctattttgaagtaacaacgtatcctagcctgatatatgaaggagtttttttaaccttaaagaacaaatatatttcatttctataatgagcgccatgtcgtcaatagggatattgtatcttcagctgtcatgtaacatattaacttccaggaatcttaattgaatgattatgtagggatgatcttgtagcgtaaatatagatacatagttagagctgttgcagcatatacatatacatatatattatatatttttcttttatttttttcatgcggggggatgcatttcatgcagtattctttctaattgctctacatccaatctttggatgaacaggtttcgcagtaaacctaacatggtgataaaactagctagtcccacagggacgacacaaagaaccgtgattttatatagatctatcgttcgcttagtggtaaaattgaatgctttttttggatattttttgggtcttttagggctttgtgaatgagagactgagggcctgttaacaggaaacaatccgccatcactgttatcggagagactgtcgttggaaggaacatctactgtactttcgtcggctaccacaacatgtgagtcttcatcagcgtcatcttcaccatcctcatagtcttctgtttcttctggaacattagtatcctcttgtacttcgccttcctggttcctgatatacctcagatccgaggtaagataactttgccaaatgtacactgctgttagtacacaactaatgagtatccatgtatgcaaaaaatagtcgagttccggagacaaagacgacaaaagaaggagttctaaggtgacaatgatcaatgacatggaaaacattcttaaaatggcggccacagtagagtacttgacgatccatcggaccatcaaagagtcgagaatggcatacgagaggtataaagacaccaggcaccaaagtgagcaaaggagatattcagacgctcttgctgtagtgagtgcggataataggagtgaatccttaccgtcgccattcacagccttttgcgaagctccttcaaatgatgagttattgtcgtaagcgctattgagtttttgccagaaataagtgaacgcatctcttagtgattgtggctcgtaaagcgttatgctggtgcgcatggagactctccaagccttccgcagagatgtgaagatgtaagttaacggcggtaaaagggatatgtccctgcataaggccatcagcatatgctgcttggcagttaaatgattcaaagacagcgttttcatagaactgtacgtctttttaaaggtcgctcgctcatgcttggcatacttgtcctcatgagggcccataccagtacttagtatccacgtcatctggttttttaaaaccctgaagaatcaaataagattatttgaccaaaggaagggaagggaagagaaaaaaaacttaaagaaaaaagaaatgagaaaccctggtgtgttcacgtagatgcacagacggtgggcaacccaaaacttagtcttccgataaacttttcaggttcttgtacacgtggaaacgcccgatatatatcacatgtagctgtgtaatatgagaatgcctttgtccatgtgataaaccgtgcaaaacttaacatgggagcaggcacaagtgtgagtcccacgaacaaaacgccgctcgggtaataacgcccaatgtaaaaacatcataaatcagcacgcaaacggtaaagaacaaaaacatcttcaagggaaaagtatacagatgtatagtctaagctattgtatttgtataaatggttcttattttagtttcgtttgcccatgagcgtttgatttgctcaagaacaaggaacaaagaccagcgtgttggggaaaagaaaaagaaaacaaaaaacaaaagtagatcacaagttttccagagatgcagcaatttcgtccagttccttctttgcgtcttcgtacttgacggtcaattcctcgttctttctttcccattcttctctttgttcttccaaggcagctactcttctttccaattgatctgccttcaagtcggactctctcaatttctcagtggtttcctttagcttggtgtcgctttcctccaagtcttcttccaattgctggttcttcttggagaaattgtcgttgttggactgcaagtggtgagagtcctcggacaattgcttggattcagccaattctgcttccaacttctcgatctcttcctccaattggtggttcttcaccgtcaaggacttgatctgattttctttttcaacgttatcctgttctgtttgcttagagtcagaaagtcccgcttccagcttctcgatctcatcctccaattgctggtttttgacggttaaagacttgatctgattctccttttcgacgttctcttgctccaagtccttgttcttctctttcaactcctcgtacttctcctgccatgattcggcttccaacttcaagttgcttagcttttctctgattttgtccattgttgccttttttgtgtgtatggggtgtgagttctactatgtagatttcttctaccaacctaatcttttacagtatcagaagggaaaaacgaaccttcttcttgccaagtatgcagtatgtgatctctaacacttttccgtttctcgtagatcgtgctatggtgtgctgattttttattttaatggttacccgacttctttacccggctctccgtcgggtaagatatatgtgctagcgccacgcgatggctggtttgtctttttaagttcttaatatttatttttatattttgattttttttttttttttttttttccattagtgaatgacagcaatgtattaagctgctgccgcgcatacaaaatgtactgcgttaaattagattagcttaaattagtgcttggtaaaggaggagtggtttcaagtccggtgtgcgccccactttattcgggtatcttctacgtttttacatccatgtttcaggtactgttgaaaatagttaagatcgttcgtatttcttaattcatgtatttttccctgttcctaactcgcaaacatcagttttcttgcagatacgtcttgaaatacaaccatacagacaatggagacatacgagactagcattgggactcagtcttatcccccgactttgttcccacctcccctgggtaccggtgggtttaccacttcaggttatatacatgcgcttgtggattctacatcgaactcgaactcgaactcgaacacaaattcgaacacaaattcgaacacaaattcaaattcagataccaagattcctatagtgcaaatatcggatgactctcatataacacacgacagcttcaaaccatatatggagtaccacgatgcttcgcacttgaggaaccgtaacataagcaaagcggaccaggttgaaagcactgaagtgatggaacagtttacgcaatggtcgaattataagatgaggtctcgctctcctaccataaacgcaaagccaattcgacacacttcacaacgaagaacagactttaccagcaaaaatgaactctccaagttcagcaagaatcataatttcatttttcacaaagggtttttgaagaggcaacactccatacgcagggaagacaggcaagcaaaggtacggtcaagattcaggagcaagaaggagctgacatccgttttgaactatatagaactggaacaaatggatattgcaaatgtcctggcttcgcaaccggtaaacttacacgctatcagaaatctcactagcagggaccctgcggtaactcctatcccatttttaagaagccagatgtatgcaaccagtagtcgtccaccgtatctaaggaaccgctccataagtaggaaactacccaaatcacaaccaggtagtctcccgacgactatgcctgcgacggcgacgaaaacaattaaacagaattcaacgaccccaaccacaagatctgtttataacaagaatgtggggcggtccaatacttcccctagtgtgttgtaccacccaaaaagaagaggaaaattgaacaccaaatcgcatgcaagaaaggagcaactgctgttggaactgtggagagaatacttaatgctggttataacacagaggacgcaactgcgcctgactttgctttgctctccgggttcagcatcgaatgaaagctctgtctgctcttctaacgccagcgacttagacatgtcccttttatctactccttcaagtctcttccagatggcaggtgagaccaaaagcaatcctataattatacccgacagtcaagacgatagtatacttagtagcgaccccttttaagtaggtaaccccccctggattgcatagccattgcatagccttagacatcaaactttatttaatcacattatccttctatgtatctttttcccccgctcgatttcttctagaacattacggaaaataaaggaaaaaaatgactggagcatcgaatctgtagactaaaaaggtaatgacgcgttcttcgttcccacaagtatgtgaaatcgtttgaacgcttttatatactgataggaatagattataatagtattcaacattcatcaaacagtttatatcggtaataaaccaacctcacgatacagtgattatttctctaaacaacacgagccgtactgtacctacgataaagtaaaacacatttttcttttgctaccagtggacacaagataacggagaatgcaacaaaacacgtctttatatgactctttgaacgttactgccgctgcatccacatctgagattaagaaagcttacaggaacgctgcattaaaatatcatcctgataaaaacaatcatacagaagaatccaagcgaaagtttcaagagatatgccaggcatacgaaatacttaaagacaatcgtttaagagctttgtatgaccagtacggtaccacagatgaagtcctgattcaagagcagcaggcgcaggcgcaacgccaacaagccgggccgttcagttcatcctcaaatttcgatacggaagcaatgtcattcccggatctatctccaggtgatcttttcgcgcagttttttaatagttctgctaccccctcttctaatggctccaaaagcagttttaattttagcttcaataatagctctacgccgagcttctcctttgttaatggcagtggcgtgaacaatctgtactcctcgtcagcaaaatacaactccaacgatgaggaccatcatttggatagaggccctgatatcaaacataatctaaagtgcacattgaaggaactctacatgggtaagactgcaaagttgggtttgaataggacaaggatttgcagtgtttgtgatgggcacggtggtctaaagaaatgcacttgtaaaacatgcaaagggcaaggtattcaaacccaaactaggcgtatgggacctctagtacaaagttggtctcaaacttgtgcagattgcgggggtgccggggtttttgtcaaaaataaagatatttgccaacagtgccaaggtcttggcttcattaaggagaggaagattctacaagtcaccgttcaaccgggatcgtgtcataaccaacttatagtacttacgggcgaaggtgacgaagttattagtactaagggaggcggtcacgaaaaggtaatacctggtgacgtcgttatcaccattttacgtttaaaagatccgaatttccaggttatcaactactccaatttgatatgtaagaagtgcaaaatcgacttcatgaccagtttatgtggaggcgtagtttatattgaagggcaccctagcggtaagttgatcaaacttgatattatacctggcgagatactgaagcctggttgtttcaagactgttgaggacatggggatgcccaagtttatcaacggtgttcggagcggtttcggtcatctatatgtcaaattcgatgtgacgtatccagagagactggaacctgaaaatgctaagaaaatacaaaatattctggctaatgataaatacattaaagcagaacgttccaccatggaaaccgcagattcagactgctattgcgatttggagaagtcatatgacagtgtggaagagcatgtgttaagtagctttgaggcccctaatttaaacaatgaagttattgaagacgacgaccttggtgatttgattaatgaaagagattctcggaaaaggaacaaccgtcgattcgacgaaagtaatattaataataataatgaaacgaaacgaaataaatattcttcaccggtaagcggtttttatgaccatgatattaatggatattgaaggttatatagtcatgcagtaatgttatacattttctatttttattttttgtatcagtactctatctataaggacattcctttttttaagcaatgcggaaagatacgctattcttcctgtggatggtttaccgcggtttgggtggtaatatcattgcagccctagtcctttagcagtttttttagcgtgtaatacattgttattcatctttttcttagtgcctgccaagagatcgtgggaggttacttaacagaaaagcaaaaaaaaaaaccgattagaatgtgcatgccgttgttacagagaagcaagggaagttcaccactgatcatatttctaagttcatcaaaatatcgttttggtttcagcagtagggatctttaacccaagtgttcattttctttcctttttgctttttatttgaatgatctgaacaaaaggagaaacatatactgtactattgcgtgaaaacgaacagagcacaaccctcaagaaaaaagagaactaccccttagttccatctcatttacttaagcaacacttcctaattattctctaatcctaataaaaaaaaagaactgatgtcgcgggaggcatttgatgtaccgaatataggtactaacaagtttttaaaagtcacacctaatttatttaccccagagcgattgaatttatttgatgatgtcgaactatatcttacgttaataaaagcatccaaatgtgtcgagcagggagaaaggctgcacaatataagttggagaattctgaataaagctgttctaaaggagcataatattaatcgatctaaaaaaagagacggcgtgaagaacatatattatgtgttaaatccaaacaacaaacagccaataaagccaaagcaggcagcagtaaagcagccaccattacaaaaggccaatttgcctcccacaacggcaaaacagaacgttttaactcggccaatgacatcaccagctatcgcacagggtgctcacgatagatccttggataatcctaattctacaaacaatgatgtgaaaaatgacgttgctccaaacagacaattctccaaatctactacgtcagggttgttttcaaattttgcagacaaatatcaaaaaatgaaaaatgtgaaccatgttgctaataaggaagaaccacaaactattatcactggttttgatacaagcactgttataaccaagaaacctttacaatcaagacgctcaagatcacctttccagcatataggagacatgaacatgaactgcattgataatgagacttccaagagtaccagtcctactcttgaaaatatgggaagtagaaaatcctcttttcctcagaaggaatctttattcggaaggccaaggtcttacaagaatgaccaaaatggtcaactgtcactttcgaaaacatcctctagaaaaggaaaaaacaagatatttttcagcagtgaagatgaagattccgattgggacagcgtttcgaatgattcagaattctacgctgatgaagatgatgaagagtacgatgattataatgaggaagaagcagatcagtactatagaagacaatgggacaagcttttatttgccaaaaatcaacagaatcttgactcaacgaaatcatctgtttcatcagcgaacacaatcaactcaaacacatcccatgatcccgtacgaaaaagtttactcagtggactattccttagtgaggcaaatagcaacagtaataaccacaatactgcacatagtgaatacgcttctaaacacgtttcgccgactcctcagtcctctcatagtaatatcggtcctcaaccgcagcaaaatccaccgagcgctaatggtataaaacaacaaaaaccttctttgaaaacaagcaacgtgacagctctagcatcgctatctcccccgcaaccatccaacaatgagcggttatcgatggatatacaaaaggacttcaaaactgataatgagtccaatcatttatatgaatctaatgctccgctaactgctcaaactatactgcccaccgccttatctactcacatgtttttgccaaataacattcaccaacaacgaatggcgattgccactggtagtaatacgcgacatcgtttttcgaggcggcagtcgatggatatcccatccaagaacaggaatactgggtttttgaagaccagaatggagatctctgaggaagaaaagatggtacgtacaatatcacggcttgacaatacgagtattgcaaacagtaatggaaatggtaatgatgacacctctaatcagagaacggaagcactggggcgtaagacgagtaatggagggcgaatatgattactaagttaaataaatcagatacagtatttaaagttctttcaaaaaaagataatgtcatatattttactatctacgcagtgaaagagttccttctaatgacacactattcacttcgggtaacggatattgtgtactgaaaaatataaaaaattttatcccggaaatgcgatgagatgaaaatgcatgaagtagcgtatatattgattgcatgaggttggacttgaaagggcatatatactcggttttatcattgattcaagtgttcccataaataataaaacagttaaatcgaaatgctaagaagacaagcccgtgaaaggagagaatatctatacagaaaagcgcaagaattacaagattctcaactgcaacaaaaacgtcaaataattaaacaagcgctagctcaggggaagccattgccaaaggaactagcagaagatgagagtttacaaaaggatttcagatatgaccaaagtttaaaggagagcgaagaagcagatgatctacaggttgatgatgaatatgctgccacaagtggtataatggatccaagaatcatcgtcacaacatctcgtgacccaagcactcgtctctcgcaatttgccaaagaaattaaactgctatttccaaatgctgtcaggctgaacagaggtaattatgtgatgccaaatctagtggatgcttgtaaaaaatccggtactacagatttggtggtattacatgaacatagaggtgttccaacttctttgaccatatcacattttccacatggacccactgcacagtttagtttacacaatgttgttatgagacatgatattataaatgctggtaaccaaagcgaagtgaatccacatctaatatttgataactttactaccgctttagggaaaagagtagtctgtattttaaagcacttgttcaatgcggggcccaaaaaagattccgaaagagtaatcacttttgcgaataggggtgatttcattagcgttagacagcatgtatatgtgagaacaagagagggagtagagattgccgaagttggtcctagatttgagatgaggttgtttgaactgaggttgggaactttagaaaataaggacgctgatgttgagtggcagttgagaagattcataaggactgccaataaaaaagactatttgtgaatttttttatagatttgtaaaggttaaaatagaaggccgatgaggccttatgtaagtctaatatggtattcttaaaaaaaaaaaaaaaaaaaaagcgtcttagagggaatataagagaaaagaagagatagcataacacatgatttatttttatttttgcgttttttttttttcttaattgtttatcaatgtatctgtgagagtatctacataaaaaaaataaccatatgaagacataaatttaaaagaacaaaacgaacgaagggaagaggtgcagaaaggaaatttatgtatcacaactattaaattcagttgaaaatccaccatttgaaacttttttcttaagcacttcactgactttttcaactcttaactcatgttcggaggataacgtattagaagaagacacgtaagaaggatctgttgataaaggcatgggcttgcctattgctgtatatgacgaagatgtcgataaaggcgtctgggttgctaattcgggattacttgccaagtttgcacttgaacgcaaagacgaacttaacggaaaggaaggatctagcatgtccatggttaaatcttcttcttcgctgtcacttgattctatttggaacttgggattcttgtgcatgtttgcaacagggtcaacgtttgataaaatggattgtctttgaaatagtatcgaagatgaccggttttttggggattttgcattgttattagcattatttgaatattgtctcgcagattgctgcggagatacataaggcgaagtagctggtaattctgtagttttgatgaaggggttggaaaatgtcgttgttgctgacgatgaagaataggcttgtggtggggacctcttgaggatgaaagggcatgagtacgcttgggatttcataggtggtctagatgtaggcgtattattggcctgtgcaagtttttcatcattcaacatatcgacgtaagagtagaatcttagtattctggagtttggttcgccatttgaagttgtggtggtcatcccggtgttattgatgttattcaaggtgggacgtgtagccgcagaatgcgaatgagatctcgaaagtttaagatctggcgatgctggcgaagattctgatgagggaagagtggcactattcgttctagccaacagggccatgtttaggctcacagcagaggaaggtcttcttgaataaaccatatcgacatcgctcaggtcagtgttctcatcgttcactattgagcaactagcatctaaagctggagccaccgagttttctaacgtacgacggcgatggtgatgattttgcatgttgcaaatggggttcaagatgtactcttgatgtgctagcgagcttgtggtggagttcgacgccgacctagacgttggtatgacgttatctagcggagaggaaacattattggagttcttcctcaacgatggagttctaacctcgctaccagagataggtatcggagaaatggtctgcaagttgtaaaaactattagatcttgagctatgagatgtgttggaggcggaaaccggaggttgaagaaataaatcgtttgaacttgcctcttgcacggttctttcgaagataaaagaagggttgctgttgttcgaatttgacttgtacacgcacataccgtcttttttggcagtttcctttgacagcacttagattctcctcaagctctttttaccgtacctgttcctatttgaaatatttagatctgtgaaaggattagtcttttattcgtgataaaagcgaaaatctaatcccctgggcgccgcggagtgctcttcgccgagataaatatactaaaagagaggctttaattagtacccgaaatgacggtgaatagtgggatacttttataatggtgttatgttacatgattgccgatgaatgtgctgttaaaaagacgcagtttaacgtttgcaccgagatggctgtggtgcaagtgtcgaagtagcaggagcaggccgtattctctggcacacgcggtcgacacaagtaagatggaggcaaccaggaggaacggtcagattgtgaaggacctgggtagatactatccgtcaatgtcagaatcagcactccacgatctttgccaggagtataaagaagtcactatcgcagactttaatgagagattcttgggcaacccagccacattacaccatgaggataatcctaatttgttacttagtattaatggcaggattaaaagcattaggttttcaggccagaagattgtttttatagatctttacaacggcagtagcggattgaagaatgatacgcaactgcagttgatcgtaaactacaataaaattggtgggagtagtgaggataaggcgaatttctcagaatatatgaactttttgaagaaaggagattatattaaggcgctcggttatcccgggttttcccaatccagagtcaagatgctgtccttgatatgtaataagctacctatagtattgtctgtttcgcaactgccgttaccttccagactgaatgatgaaaccaagatcaaatctaatagagttgttgactaccaattaaacggcactcagacactgctagtaagggcgcgtatcatcaaacttttgaggaagtttctcgacgacagaaacttcgttgaggttgaaacgcctatactgtcatcaaagtccaacggtgccatggcgaagccctttataacgtcgtccaaggacttcgaccatttggagttgcgtattgcaccagaattatggctgaagaggcttataattagtggtttacaaaaagtatacgaaataggaaaggtctttcgaaacgaaggcattgattccacgcataatgctgagttttccactttagaattctatgaaacttacatgtcaatggacgatatagtcacaaggactgaagatttgttcaaatttttgattactaacttgcaaaagttctttcaagatacccgtctgcctgtccctaagacgtttagtgaattacatctggcactatccgagaataattggaagtttagaaaagtcgaattcctgcccactttgaacaaagagcttggcattgatctaatgaactctggattggatatcaataagccgagcgaacttttgaaggctttaccgaaagacattgcgaagaagtattttccttctgcagataacactgggcaattatcttcgctgcaaatcctaaataaactatcggacgtgttcctcgagcagcgccattgtcaatcaaccttgcctacggtaatataccatcaacctgcaatattatcgcccttagccaagacggatccgcaaaataagcaagtcacgaagagattcgaagtcttcatcaaaggtaaggaatacatcaatgcttacgaagaggaaaattgcccccaattacaactgcagaagtttctacaacaaaagcagattaacgaattgacaggaaacaaaactgagaccttatcgcctgttattgactaccagtatgttgagacgatgaaatacggtatgcctccagtaggtggctttggccttggcatagatagattgtgcatgctattttgcgacaagaagaggatagaagaggttctgccctttggctgtgtggatgatgtaaacaggcagtaaattttgcgacgcctgccaatgcttttgtaaataaatcagacatatactgtaaataattagaatggcatttaattttttttttttctctacaccaataaactacgctacgcgaaaaatccaatataaatattcagttatagctaatgagagtgtcgaaaaaccttgaaaacaactactgcacaccaaattgatacgattaaatggtaccccccacggtagaagcatccttggagtctccttacactaagtcgtacttttcacctgtcccaagcgcgctcttggaacagaatgactctccaataataatgggtatcgatgaagctggcagagggcccgtattagggccaatggtctacgcagtagcctattctacacagaaatatcaggacgaaactataatccctaactacgagtttgacgactctaaaaaacttacagatcccatcagaagaatgctgttttccaagatataccaggacaacgaagaactaacccagatcggctacgcaactacgtgcatcactccgttggatatctctagaggaatgagcaagttcccaccgacgagaaactataacttgaatgagcaggcgcacgatgtcacaatggcactcattgatggcgtgataaagcagaacgtgaagctcagtcacgtgtatgtggatactgttggaccaccagcgtcctatcagaagaaactggagcaacgatttcctggtgtcaagtttacggtcgccaagaaggcagactcgctctactgcatggtcagtgtggcgagtgtcgttgcaaaagtgaccagagatatactagtcgaatccttgaagagggatcccgatgagatcctgggttctggatacccctccgacccgaagacagtcgcatggctgaagcgcaaccagacaagtcttatgggctggcccgccaacatggtaagattctcatggcagacatgccagactctgttagatgacgccagtaagaatagtatccctatcaagtgggaagaacaatatatggacagcaggaagaacgccgcacaaaaaaccaagcaattgcagctccagatggtcgctaagcctgttagaaggaagaggctgagaaccctagataattggtaccggtgatcacctccagtttgcacatactatatatcttcatgtaatactacatatgtcataacttcaataactcatacaagtcatctgctactatgctttgccgtttctactatccgtgaagcgtgaccggcccttctcaccccccgtgttacgcaaagaacaacaagaggtcgagacaaccaaccggaacgactagaagagaggctgttacgtttcctgtttgttcacgctcaacatcttccattgctgtaaactgcatccagtaaaattaatagttattagcgtactatgtctgcctttgtcagggtggttccaagaatatccagaagttcagtactcaccagatcattgagactgcaattgagatgctacgcatcgtacccagagcacaccattattggtatgccggcactgtctcctacgatgacgcaaggtaatcttgctgcttggactaagaaggaaggtgaccaattgtctcccggtgaagttattgccgaaatagaaacagacaaggctcaaatggactttgagttccaagaagatggttacttagccaagattctagttcctgaaggtacaaaggacattcctgtcaacaagcctattgccgtctatgtggaggacaaagctgatgtgccagcttttaaggactttaagctggaggattcaggttctgattcaaagaccagtacgaaggctcagcctgccgaaccacaggcagaaaagaaacaagaagcgccagctgaagagaccaagacttctgcacctgaagctaagaaatctgacgttgctgctcctcaaggtaggatttttgcctctccacttgccaagactatcgccttggaaaagggtatttctttgaaggatgttcacggcactggaccccgcggtagaattaccaaggctgacattgagtcatatctagaaaagtcgtctaagcagtcttctcaaaccagtggtgctgccgccgccactcctgccgccgctacctcaagcactactgctggctctgctccatcgccttcttctacagcatcatatgaggatgttccaatttcaaccatgagaagcatcattggagaacgtttattgcaatctactcaaggcattccatcatacatcgtttcctccaagatatccatctccaaacttttgaaattgagacagtccttgaacgctacagcaaacgacaagtacaaactgtccattaatgacctattagtaaaagccatcactgttgcggctaagagggtgccagatgccaatgcctactggttacctaatgagaacgttatccgtaaattcaagaatgtcgatgtctcagtcgctgttgccacaccaacaggattattgacaccaattgtcaagaattgtgaggccaagggcttgtcgcaaatctctaacgaaatcaaggaactagtcaagcgtgccagaataaacaaattggcaccagaggaattccaaggtgggaccatttgcatatccaatatgggcatgaataatgctgttaacatgtttacttcgattatcaacccaccacagtctacaatcttggccatcgctactgttgaaagggtcgctgtggaagacgccgctgctgagaacggattctcctttgataaccaggttaccataacagggacctttgatcatagaaccattgatggcgccaaaggtgcagaattcatgaaggaattgaaaactgttattgaaaatcctttggaaatgctattgtgaggttagaatgaaaataaaattcgccagtaaatgcgtatcttggagaaaatatcaatttgttattttgtatatataaaaaattaaaaaaaaaaaaaaaaaaatactcaaatactcaaatacgtatacattatactgaaatacttcgcttgtcttcgaatctaaatcctctctctcttctgtctcaaaatgatataaataaatcacgtcaaacggtgcgtcaacatctttgttttttcacctcatgtggaattggttgaaattaacaaaggagtgggatataggatataacgcataaagtttagcatactactttcgtatattattgttcggtgaaagaaactagttccctcttatctctcaatatttgccaaaattagcttttaacaaataaaccatgagtttcctaccatcttttatcttaagcgatgaatctaaagaacgtatttccaaaattttaactttgactcataatgtagcacattatggctggatcccatttgttttgtatttgggctgggcacacacttctaatagaccaaactttttgaacttactgtctccgttaccaagtgtttaaaaacatcagttcgatacaacttgggtgagagaggaagcccatatttccaattttgaattacttgaccgttactgcaaataataaaaattgacatgtacataaagtatatatataataaaatataaaattcattttgcatattgttattctttcacgctttgttttgatatggtgaaaattcgaagtctctagaatgtcctttaggtacctttctttaagatgtggttcatattcaaaaaatctgatcaattagaatttataccagtgttttaatatgtttatttatctgttattgatattatttaaaatgtgaaacaaaataaataaaaataactaaaaatgtagggtggtttgttgttttgcaaaaaataaaagataagattgatcacaaattcatttcatgaaatttagtaaccgaaagaagccaattgcttagcaacatcggattcagaagcagcagcagaagcagaggagacctttttggtgaaagctctcttcttggcgtaatattcggcggatctgacctttctcttgtcttctaatttagcaacaacatcttcgtatttccaaccaacagaagtagacaacttacccaaagtggtgtactttctacctggtttcaatctcaaaactctcaaagcttgaggaacgacaactctcttctttttgtcgtatggaggtggaataccttcgaagatctttaaacgttccaaggcagccttaccacgggcggtcttgtgggaaaccataccacgaatagccttgtaaagaattctagatggagctctgaaatggaatggaccacgggtcttgttgaaagcagtagcctttctcaaaaagtcgtggtacttcaacttgtttctgaagaattcaccagaaatgttcaaagcttcagctctgacaacgacaatcttttgaccgttcaatacttgcttggcaatagtggaggccaaacgacccaacaaatgatccttagctataataaaaggagaaaaataaagttagtaaatgctaatcttggtattttttactgagtggattgaatatagttggagtcaaaatattgattagaagttaccattactttttggtgtgatggggcatatcgatgcatctcaggggtaacattggcatgatgctttcaaaccgccactttttaggcgtgatgcacggtattgcaaattcatgttttcaaatataacgcattcaattaagtatttggagtttcaagtattgcgtgttccgtttcttctatgaatcaatgagcatcctaattagctaatactattctttatagtaagcattttgcaacacatttcgcaggattattttttatttcaattactatattctgaaatggtctttgcaacgtcctccacctgcatactcaatcactcctgttagaattagaaattttttacgtaccatcaataacaacgactggttgagacatcttttatggttggttggttgtttaataccttaacaaaatgcacttagtggaatatctacatgtgttatagttttaagaatcagttttaccaatatcagaataattttccagaattcgaaattgcagcggtccgcagtgcgaatgtttagccggagggaccaagtgtctgcctaagaagagatcaccaccctcccaagctgatacaaggatcaaatggaaaatcacccacttggggacagcccaggagacgctttagcgggcagtttcaggttctaggagcgttctccgaaggaagtccttctgccgctgtttttcacccgttggccgaagcgttgagaaacagccaaattttctgattcataggaaatttttaaaggaggtttgggtgtgtatagtgtacggattgaatatgtcaaggatgcaaacacagcagcgaaaataaagttcagttgcataaattagagtgaacattgcggggtgttcaaaatcataaaggtcagatgatcaaacgcatgaggaagagtaaaatagggaatgcacggtgattaaatattatatatgaaagacagttatatatgtacttcgtgacatagattcggacgacaatagaatgaaaggaaagcagctcatatgactggctgcagcttagccatttctcattcatttctttagtcttagtgattcaccttgtttcttgtcttagttgttgataatactgatctttgcaccatccgtatctagtattagttccttggcattggcggtgctaccaccttggtttttcaaaggtgaagaattaatatctttagtttccagatcatttgagttagagtccgaatctttttctgaagtagcattctcgttttctttggctttaatgtccggatttatggaaaatcctctcttgttgcctccgctatctgcggcaggagtgttgtttgttgagctaaactgcaataaattccatacacctggagaacttttgacattctgcgatttacttgttgatggtgtcagccgtctattatcattgtttgattccatgcttttcaagacattagaatccaatactagacctgtttgtttgttttccattccgctagtctgtaaattagaattatttgcgccgttattattagtattgttgctattactatgaagaggtgacctagccctattagcgcttcctctttctggtgtatatgcttccatcgcagtaatatgaaatgccttagtaggagatcgtaatagcgtgtcatatggttgagaaaggcgtagactgttcgctgccaatgaggaagttgttgttccagtttgcggaactgagttagaattaccggaagacgtggtagttgtcggctccaaattaccattttcatcaagtgaagaagtagatatggcgggtagattcattttggtaccgccgttattgtttgtcgatttgtcggcgctatcgctgatgttgtttattattttggaattagcacatgcattagtgaacgagactagagcgttgtttggagattgcctattcatttgtgatattgatattgcaggcggatgaagtgactctttgtattctttcatattgttttgatttaagttagcatttgaattgggagcttgcaattgtggcgtcttgataggtcttgctaacgctatatttcgattttgggtatccgcgaaggtaaattgaatctcttgacgttgttcctgtggtggcggctgctgtgactgattttgatgtgacacagggggctgtgattgttgcgatgcaggaaggttacctttggatgggacatgttgtacgaacccttctatgatgttattgttggatggttctagcacattgtgagattgtagttgtcgtttagggggttgagccatgttaagcgataacctatagtccatttccatgggtaaactgttgaattttgccatatgtaactgtagttgccttgctactgaggatccccgcctgattttccccacttttccggtattccacttgtttagaaattcttgctgataagattcgctaattctccatttcatacctttgcccggctcattgggtcttctcggaaccttttcaaacgccttatttaatgataaattatgcctaatggagttttgccaaccggatttagcaaacctgtagtatgcataattggaagaaatatacttgtagatatcggctagtgaaataactccctccggcgacgacagtatggcctgtgttatcatagttgcgtatgaatgaggtggtttaacgttcctgttttcgtcatgggataggtccgaagtaaaatccaaagcttgaggataggcatttgatgacttgtatgaatctacaaaatttgcagcgatgatggtatttggaggaccctgtggagaagccgcttgtggattgatggtattgcttgttgttgtagatgctgtatagtttgggtttatggacgtaaagtagccattcttgttcttactattattattgttgttgaagatgccttgttcgctagggcccaagttcgctccgctaccaaaaggagcattgccaccacttccataaagcttaaaccctttgatttgttgattagaggttaattgcctttgcttagcataattagactgttttataatgtctcttagcagggggttgttgttgccttccaatccgaacatgtttattaaattaggcatcaggtgttctatacaaataggagcaacaaccgggtcactgtcgggcaggataaacatcatttgtgttcctcctatgtctagcagggttccggaagataatcgaatgggaggattgttgggtccattatgagtcctttgaaagtttactttagcgccgttacggcccaatatgtgcaattcccaaccgccgatattcatgttgtattttattatggcgtgctttctagaaacgactttggcaggtccgagatcaatattcactctatatgagttttttacaccatctgaattttcctgtagtgcactgtttaagggatcagtatttctaccaatagaaacttccaaatccttcacataataggtccagtttggtccggagagtttagcataagcttgtatttccgtcgccatgttcttgtcgttggaatattgtaatgatacggtagttggctgatctggggctgtcagtgaagagatgatggcatttattacaccttgatgatgctgagcggtatattttgtgctgccataatttgtttgagtcatatttagttcgttcatctcgttaaaattgctgctggacatttcttgcgcattgataaagtttcaataaaggaaacggagggagcacaccaatatttatgtgtatcgtactgttttttttttttttttctagcaatgatcacttatgcgagggaatcgggaagattggctttgaagtgtttttagccttttgttccttagtatgatcttgattattgagcggttcaattcagtggaaaaggactgctctatagtgttttaagttttacagaaatatagtgatcctatgaatgtcacttttttgtttacctttagaaatgcggaaccattggcattttttttctttatttactaatttacctagaaaatccaaatggcacagggcgagcgaattttttttccctcttttaatgagcgaaatcgaagattttcggtaatgttgtgcgaagggttctggggcggggtccggcataagtcatcatcaatgctaagggaacgattatatggcacagaaagagacaggaagaagaggccatcaaaatgttgcagcttaagggataagcataaagcgtaatcaataaaaaacagcctgtacccaacaggcagcaaatttttgaaagcctgttgcaagatacatatgacacaaattattaaaatatgttgaattaatattcagttcttacagttgacatgatccgactcaaatgttaatgttcttgaggttctatagtttcaaaatagctttttactttctgctattggacccttttggaccagccgaaggaagttttttttctttatgtttagctcttttttcatcacttctaattcgcaaatagaaggggaaggaggacagcaattatgtaaaaattaattagtatgtcagtaacaaaaagaagagataacagaggtagttcctctagacatttttaagacgactattgatgccaggcaaattttggatttactgctcctcttttaagaagacaagtgtgtgatatcgtagcggtaggaaccaattttgcaatcgatttacttacagccaagaaaatctattttcatgtttagcattgccatttcttctgtgtcacacgttgtgcttgccaggaactataggagagacgtatacaagcatcaatgttacgaatgtacgatcccgtttgcatctgatgtgtaaactcatgtggtgcactggtgttgtttccaagactgcactattaactgggaatttttttttttcttctagtgaatttttttttaaagcgacgcacaggaaaagtgaaaattatttaaacggacggcaaacatgaaaaaaaaaattaccaaccatatttctatttcctttccctttacctattctctttttgaaatagttcattttctctctctgaaacgacaataaaccaaactctagcctccaatagtcactaaagatgaagtacattcaaaccgaacaacaaattgaaatcccagaaggtgttactgtcagcattaagtccagaatcgtcaaggttgtcggtccaagaggtactttgaccaagaacttgaagcatattgatgttaccttcaccaaggtcaacaaccaattgatcaaggttgctgttcacaacggtgacagaaagcacgttgccgctttgagaaccgttaaatctttggttgacaacatgatcactggtgtcaccaagggttacaagtacaagatgagatacgtctacgcgcatttcccaatcaacgtcaacattgttgaaaaggatggtgctaaattcattgaagtcagaaactttttgggtgacaagaagatcagaaacgtcccagttagagatggtgttactatcgaattctctactaacgtaaaggacgaaatcgtcttatctggtaactctgttgaagacgtttcccaaaatgccgctgacttgcaacaaatctgtcgtgttagaaacaaggatatccgtaagtttttggatggtatctacgtttcccacaagggtttcattgtcgaagacatgtaaatggaacaaaaaagtgtctttgcgcttagaggcgcttaaatatgtacattattcctacttttttatttagtattatgtaaagactgaggttctttgtcattggatgtgcctcacttccaatgatgaattgacaggctctctagggaatgctgtcaaggggaaacgttgctagtgctcattgaaataaagagccactttacgttttctcaaattgcttttgttttttcttctattgatgctaattgcatattttttggtaaaggaaagaaacactaaaaaataaatattctctaatacgttacaaatgattttcttttttcttgagtcttgcaatcatacccgtagctttctcttgttcttcggctattgctttaaatcaaaatgatatctgggtgtaccagcaagtttcgaaatgaaaacataaaaatatggttacccgacatatatgctggtttaatactggttaaactgaacagaagcatctcttttctctattaggacgtaaacgacaacgtttttttttataggaaaagtaaacaaagcgcagtggaaggcagcgaaaggaacctgcacagcgcgaagtttataaacaatgacttttccagatctcggatttttttctcgcacgttcccttcagcatgaatcttatttaaacacttactttcgagaaaaataacagtagtttccccaaaaaaaatagtactatcacacgtattttaaatataatcgccgtattattcactatattcaatttcaactttatagcaagaaaaggaaagatcgattcgttcttttaccattatccaactactctacactcctttttcgccgaagaaaagaactcttccaactaattttcactcctttaagcattttttttttttacttttttacaagtcgtatgtttaatttaatgataagacctttcatgttactatattttgagtttgcaaattattccactgattacgaaattgctgtgcttttttcgcttcggtgcatcgtcatttttcgagaataaagcaaatttttacatgcccgttatttttccgtgcacaacttctttttggcttttttggccgtcggatttacggcgcgaaaataagtttctgacttctcgagatatagccattgtagaaactaaaacaatattgattgattcaattagcactaatcttagaaaatttgcaatcctactcttttcgcaatgattttatttactaacccatcccaaatttattttagtaatttgataaaatgaaactgtccgccaccactcttaccgcggcttcattgatcggttatagcacaatcgtttccgctttgccgtatgcggctgatattgacacaggatgtactactactgctcatggttcacaccagcataagagggccgttgcagttacatacgtttacgaaacagtcactgtcgataaaaatggtcagaccgtcactccaacctcaactgaagcctcttctacagttgcttccactactactctgatttccgaatcttcggtcaccaagtcttcttccaaagttgcttcttcttctgagagtactgaacaaatcgctaccacctcgtcttcggctcaaacaactctgacatcttcagaaacttctactagcgaatcctctgtgcctatttccacatctgggtcagcttccacatcttcagcagcttccagtgcaactggaagtatctacggtgatttggctgacttttcaggtccatatgaaaaatttgaagacggtaccattccttgcggccaatttccatctggtcaaggtgttatccccatcagctggttagatgaaggtggctggtctggtgttgaaaatactgacacttctacgggtggctcttgtaaagaagggtcttactgctcatacgcttgccaaccaggtatgtccaagacacaatggccttctgaccaaccatctgacggcagatccattggtggtttgctatgtaaggacggctacctgtaccgttcaaatacagatactgactatttatgcgaatggggcgttgatgccgcttacgtcgtctctgaattgagcaacgatgttgctatctgcaggaccgattacccgggtaccgaaaacatggtgattcctacatatgtgcaagcaggtgactctttacccttgactgtcgttgatcaggacacctactacacttggcaaggattgaagacatccgcgcaatactacgttaacaatgccggtatttctgtcgaagatgcttgtgtttggggttcttcaagttcaggcgtcggtaattgggctccattgaactttggcgctggttcttctgatggtgtcgcctacctttctttgattcccaacccaaacaacggtaacgcattgaatttcaatgtcaaaattgtcgccgctgatgactcttctacagtcaacggtgaatgtatctatgaaaacggtagcttcagcggtggctctgacggttgtaccgtttccgttactgctggcaaagctaagtttgttctatacaactaaacttaggcgcatcaacagttgagtaagttgattgtattattaccccattcttttctgcccgtccattttattgtctgtttaacatacactaaaacccacgccggattaatatcaatttttttttactttgtttctatttatcattcttccagacataaattattttgtaatattaaagacatttgaaaacctacatacatcgcacacctcttctttcattgtcctaaaaaccacccaaaaaaaaaaaaaagacatcaaatctcttttttttttttttgtagttctgttgccgtatgctatctactcctaaggcttttttctactacggcaatctattcacaatgtgcaattaggctaaatgctaaaaaaagaaaaaaaaatccggagcccctcgatgactcctgtttccgttttatactgtccagcgcagaccgcacttcctacgtatacttcttacggggaagggagcatacacgaaaacaaaaggacccgtaatgactcggaaactccatagatcggtaaataccggctcgttacccgtcctccatcggaaaatctctcaccgatttgttccggtatcggataatttatgaatcacccggcttgatggaaccgtttttgttccgtgaaatgcccggcctgcattgttttcttcagacgagaagccgttccaacgtttctttttctcgtcaccgggaagttgcgggcaccttagggcaaggaaaaagaaacttctctgccctcatcgaggatacagttgatcatactcaatattatataacgcttaacactgtcaaggttatacactttttactaactttttattgctaatattgtcgttctatataaaattatggatttttccaggcttacaaagttagcatttatacggagataaatttatttttttgagaatccaagctagattcagaaagtcgaatcagcaatgtcacgaagtaacagtatatacacagaagatattgagatgtatcctactcacaatgagcagcatctgacgagagaatacacaaaaccagatggtcaaacgaaaagtgaaaaactaaatttcgaaggcgcttatatcaacagtcacgggactctatccaagactaccacaagggaaatagaaggcgatttagactctgagacttcttctcactccagtgatgataaagttgatccaacccaacagataactgcagagacaaaagcgccatatactttactaagttacggtcagaagtggggaatggttgcaattctaacaatgtgtggcttttggtcttcattgggatcaccgatctattatcccgctttgaggcagttggaaaagcaatttaatgtggatgaaaatatggttaacgttactgtggttgtgtatctgttgtttcaaggtatatctcccacagttagcggtggtctggcggattgctttggacggagacctataattttagcaggtatgctgatatacgttattgcatccatcgggctagcatgtgctccatcatacggtgttattatcttcttgaggtgtattcagagtattggtatttcccccacaattgcaatcagttctggtgttgtcggggacttcactttgaagcatgaaagaggtacatttgttggcgccacctcagggtttgttttactgggtcaatgttttggtagtcttattggtgccgtcctgactgcaaggtgggattggagagctatcttttggtttttgaccattggttgtggaagttgttttctaattgcctttcttattttgccagaaacaaagcgaaccattgcaggtaacctttccattaagcctaaaagattcatcaacagagcgccgattttcctactgggcccagttagaaggagattcaagtacgataatcctgattatgagacattagatcccaccattccgaaactagatttgtcatccgccgggaagatccttgtattgccagaaattattctgtctttatttccatcagggctcttatttgctatgtggacgttaatgctttcctctatttcatccggtttatcagtggcgccatacaactatcatttggtcattattggtgtgtgttatctacccggtggtattggcggtttaatgggttccttcttcacaggtagaattattgacatgtatttcaagagaaagatcaagaaattcgagcaagacaaagctaacgggttgattccacaagacgcagagattaatatgttcaaagtccgtttagtttgtcttctgccccaaaatttcttggccgtcgtagcctatcttttatttggttggagtatagataagggctggaggatcgaatctattttaattacttcatttgtctgttcatactgtgctatgagtacattatcaacatcaactacgttattggtcgatttgtacccaacgaaatcatctacagcaagtagttgtttcaactttgttaggtgcagtttgagtaccatcttcatgggttgctttgccaaaatgaaagctgcgatgactgtaggtggtacttttacatttttatgtgcgctggtatttttcttcaacttcttaatgtttattccgatgaaatatggtatgaagtggagggaggatagattattgaaacaacaaagacagtcttggttaaacaccttggcagtcaaagccaaaaagggaacaaaaagagaccagaacgataatcataattaattggcattcttcaatttgatagacacttatcctgcatattttttttataaacagcttatagactttcatgtaaatttttcctaattaatgtattatttacttcgttaattttccgttgaattattgacatgttaaaggtgcactaaatatacctaatacaaaaaatggttttctgtggcaaatatatacagtggaaatttcagcatataatccctgctttactctttccttaagatttcgtcataattagaactttttttggtaaactgcattttctaccattattactttacatatgtatagctacaaaactgtattttgaagtgaaaagtatgatgaataaatgaatcgtgaataagttgatctttttttatcaagaaaatcattgagatgcacattgaacaccttcgccaccttgttcttcttcatcggaatcatagtttgcaccacccctggaggcccgtgttctgttgtatttggctgggtcaaagtctgcgagtacacattcgtccacagtagctttctttggaatggctgggacaattcttggaggcaaaatttcttctaacttcttcaagttttcttctgatgtgaaatggttttctgggaacttgatagtaaatttgatgattaaattaccatagccaccgtattttggaattggcatacctttaccttcgatgaccttacgcatacctggggcaataacttcacctggaacaataccgacctttaaccaatcaccagaaacatgttccaatgcaaattcaccaccagcgatagcagtcaatagatcaatttcagcctcatatactaaatcatcaccatctctcttgaagctcttgtgtggtctctcagaaactatgaagacaacatcacctggaatgacatctggggcttggtcagcttcacctttgaaaacgattctttgaccatctttcatacctggttcgacatggacttctaggatcttcctttcgttttcaactttcttaccgttacaagatttacaacgatccttaggatcaatgatatcaccagtaccgtgacagacatcacactctgtttggaatctttggatcattggacccatttgtcttgttacaaatttaataccttgaccattacagctggtacacttcttgacggcgcctttcttaccaccacgaccttcacattctttacataggatctgtttgttaagggctaacttagctgtcctacccttatataattcttcaagtgaggcagaaatttcatgcttgatatctttacctctttggggacctcttggtctttgtgcgccaccagcaccaaagaattgggaaaagatatcgtcaccaaaaccgaatccaccacctgggaatccgccagcgccaccagcaccacttagaccatcttcaccaaattggtcatatatatctctcttttcaggatctgataaaatttcataggctgctgaagcttctttgaacttttctgcagcttcctcacttggattcttatctggatggtattttaaggcgcattttctataagctttcttaatttcgacatcagtggcagttactggaacacctagaatatcgtaaaacttagtttctttaaccatctttggacgtttattattgttgttggaagatgtagaattcagtttggataatttttaattatgttctatcaaaagatatggtaacaaataacaaaaaaataaatacgtaacagttatcaaataagacgcttgttcgggcctaatatatatggggaaaaggactttttgtgactttgatttataaaaacgaactacacaccttatcaaacaagaactacctaaccaacatataaacgtagagcaagtttttacacgttttataagtacgtggattgatctgcaagttaaatactttccatacctgccgatgctctattgccttttcatttcttgaaaaagaaatgaaaaaattttctattttttcgatggccttctataattttgtacgaaatattataggtcaggtgtatatcacgtgctcaaaccagcgacttcacatcttattttataccaacatactcattataacaatgtattccatagttgaatacacacaactcaaacgtgtataaacgactttattttgccgactctctacggtcaatgtcttgttacgttttcaagtgcttttagaaactctgcactctcttccccttaactcgtagacaaggagcgatagttgaatggtaggaacgaaaaagaaacggttagaaagaacatatgcctcgaatatctacatcattgataagaaaagcttcgagaatacgacctggtttgcatcttttgcttccagaatgtaggactctcgagcaagcgaaactcgagtacaaatggctcaccgaagagctgcctccggataaatcaatccgctgggcttgcttacagagatacaaacacgtcccattgcagtacatcttaagatcgcaaccgtttggggccttggacatagtttgcaagcctggtgttcttataccaagatgggaaaccgaggaatgggtgatggccataataagagctctaaacaactctatgctttcaaggcatactataccactgcatatttgtgatacgtttacaggaacagggtgtattgctctcgctttgagtcatggtatagcaaattgcacgttcactgccattgacgtgtcaacaagagcaattaagttggttaaagaaaatatgctgaaaaacaaggtgagtggtggtaagctcgtgcaacataatatattgtcctcaaaagctagcgatgaatatccatcccatatagatatattaaccggtaaccccccctacattcgaaagcgtgacttcaatagagatgttaaaacttccgtaaagctgttcgaaccaaggctagcgctagtgggtgagcttgaatgctatataaatctagtaaattattggctgccgaagacagactccttcttttatgagattggagacgttgaacagtttaattacgtggagaggcgcattaaagaagattcatatctcagccgtatttggtctattggtttgaaatatgactcgaatgggaaagcaagagtcgtatatgggtttaaggccactcccaaagggcgaatactacaccagatttttgcatcctttgggactataagacatttagcaaccgcactcagtgggcacaaagctaattgcaactaagtatataaatgtaaatatatatattctcaggtttttttgttggaagttatcaaacggaacactctgtggacatttatattttttgtttcttagctccatgttcagcaagcttttcactggagtcagctgcagtcgcgttttccgatacaggttcaggagcagggatgactctgtgacaccacattagatatccaccaccacctttcatggtcatcagagggtgtagcttaccccttatactttggtacggcctacatctagtttccaaaattgatggtgctaaaaacctgaggtctgaatataaagtatgagctaattccaacaaagtttctttgaattgaccatagcatacaatcggccttgaaccatggattttttcggccaactttggcactagtgttggtaaatgtagtgtagtagccattacaagaccgtcatataggaattctcctgttagttctaaaatttgccattgtgtattgtaccatctgagttttcggtagtacgagtttttcttaccaccttttaatgcacgggcttcttctttaggtaatggtgtaaatctgctctgaatctcttgtagtgtaggcggttcaaaaaaatctaatagagaaatggtgtgtacatgctctttaataaatttctcagaataattagcaaacttcagcaaatccaagttggcatgttcattttcgtgaataactatgactttgcccttggatttgctttcattgtcaccgccaaacattctttccaacagaaagtaaaccaataacccacccgtttcatccatacagagatagttgccttctgattggatgttcgcaagatttaacagcatccccatcgattcctgagacatatccaataccctttggatatcgcctttgtcgattaagaattgtaaaaggttagagctacttaaatactcaacggtgaagtacttggcgaatttttgtttcttcctattcacatatttctcttgagaatatacggtcttgttgtgaaaacttttgtgagatttgataattttgtcgattatttctttactagataaagattcttgtttcattttttcaatttcttcaacggttaactcttgggccttgctgcccatgttaaccagattctgattcgtagcactgctgtcaatgctagacaattcaagagacacagatttttccttaatagataaaggaggctcgctttgaccatcgtctttatcattattgacatctttgatctcctgcgataatagccttactttcccgatgggaattttgttctttggtttcgaatctctattttcatcggatgaaacctcttcgccatcataatatatctcgaaagtcaacccgaaaggataaccaattatgtcattaacctcgaaagcaccgaattttcctaatgatacagaggtgttgggctttagttccactatcttgtaattttttgatggcagccggacgataacgtgctgattaaaatctatggttgtcaaagcattcattgtgcactaaattcaaagtttttttgtccaattcgtttgcaacaatgtgagtaggatccaacgtgccaaagaatttaaagttgaatattattattgttattatacacctcatcgactttttttttttttttgatgaaatttttcagattttacaaaaccgttacccagtttcacgttttctgaaaaaaattttcatctcatcgcagaataagtttaagatgagctgagctgcaaatacagttgtcgctaaggtatatagatttgtaattctggcggaattccccttgtgttggctaatattagaattacatatacatataataggaaatgggtagtagacgtcataagaacaagcaagccgccccaccaaccctggaggagtttcaggcaagaaaggaaaagaaggctaatagaaagctagaaaaaggaaagagaccttctaccacgcaaggggatgaagtttctgatagaaagaaaaagaagtcgaagccattcaagaaatctagaaaagaggaggaagaagttgttgaagaggataaggatttgccagaagttgatcttgaagaattatcaaaagccaggaaatctttatttgatgatgaagaagatgacgatgaagcaggattggtggatgaagaactaaaagatgaatttgacttggaacaagaatatgattacgatgaagatgaagataatgacgcccacccaattttttcagatgacgacgatgaggctgatcttgaagaactaaatgcacaaaacatggaagctctttctaagaaacttgatgaagaagaagctgaagaagctgaagaagccgaaatggagttagtggaagcggagaacatgcaaccaagagcagacatattgcccactgaggagcaggaagaaatgatggcacaagaaactcctaatttaacttccacaagaacaagaatgattgaaattgtaaaggttttggaaaattttaagactcttggtgcagaaggcagatcgagaggagaatacgttgacagacttttgaaagatatttgtgagtactttggttatacaccatttttggcggaaaagttattcaatctattctcaccagcagaggcgatggagtttttcgaagccaatgaaattgcaagaccaataaccatcagaaccaacaccttgaagaccagaaggagagacttagctcaaactcttgtgaatagaggtgttaatctacaacctattggttcttggactaaagttggtcttcaaatattcgattcccaagtcccaattggtgctacgccagaatatttggcaggtcactatattttacaagcggcatcatcttttctaccagttattgctctagatcctcatgaaaatgagcgtatcttggatatggcagctgctccaggtggtaagaccacttatatatcagctatgatgaaaaacacaggttgtgttttcgctaacgacgccaataaatctagaacaaaatctttaattgctaatatccaccgtctaggctgtaccaacactattgtatgcaattacgatgcccgtgagttccctaaggtaattggaggttttgacagaattttactggatgccccatgttccggtactggtgttatcggtaaggatcaatctgtcaaggtgtctcgtaccgagaaggacttcattcaaattccacatctacaaaaacaattgcttctatccgccattgattctgttgattgcaactcgaaacatggtggtgtaatagtatattcgacatgttctgttgcagtggaagaggacgaagctgtcatagactatgcattgagaaaaagaccgaatgtcaagttagtcgatactggtttagcgatcggtaaagaagcgtttactagttacagaggcaaaaagtttcatcctagtgtgaaattagcgaggaggtactatccacatacgtacaacgtcgatgggttctttgtcgctaaattccaaaagatcggtccatcttcgtttgatgataaccaagcaagtgcaaaagaaaaggaaactgctgctagaaaggaagctttggaagaaggtatcattcactctgacttcgcaaccttcgaggacgaagaagacgataagtacattgaaaagtctgtgaaaaacaatcttttgaaaaagggtgtcaatccaaaagctaaaagaccttctaacgaaaaataagttcccacaaacgtagtgcatcatgttagcatagttttctctctctaatctttctctgtctacatatatatatatatatatatatatcaatttcaaatatgtctcactgtatattaaattcaaaatagaaataataaagccgatttgtaaacagcactaagaaaaaaggcgatgatattacttattaatattcgttgccaatatagtattacatatatctctatttatttctctttttttgtttttaaggcgtttcagtttgctgtctccttagtcttcaaaatacttcgtattccctaacttatgctctttgatgtactctggaccgtactcttcgtattctttcttactgataactgttttcctatactgttcttcgtttcgtgctagagctgccatacccttccaggcatccaatgaaggatctgaagacatatttacagtgatattggtaccggtaggaaggaatccagtgaattccttcacaatacgttctttcaatcctggcaccttagcattaccgccggtaataagaacgttgttcaccatgtctatggaagtttgactcaattttcctggttgagaaccaaacttctttagtaaaatggtttctgataattcgcaaataccggcttggtcttgtccgcccattgtcggttgaaatatcacttctggtacccttatacgttctacattcaaatgcatttgatgttgttcatgtatattttcgctatcatgaggtctaggtcctcttaaaaacaggtggaggatagaatttctccaatcgtactgtgcttccagcgtatcttcttcagtaaagtttggatcgtgttctaaaagtagtctctccagttccacgatgtctttgtactcgtactctaatgcttcttcaaaagcctcaggattttgagtaatatcagtataaataagccagtcttcatcattagcgccaaaagtgtcatttggatcattatctattgtcgcttggtgtctattacgtttggccccttgtttgacattatcctcagccaatgaagctagatttttcattctgttctgtgaaacttgagattttctgtccttcatttcgtcacgtagttttaacttttcttttctcctttttattaatttgtttaatttcaatcttttgtcctttatccaaccatttaagtcagtttcacgccattgttgctcttttaattttttttcttcttcttccttggcgactctttccttttcttctttagccttttgcctggcgtcttgactggccttcaaaaatctttgcttccttttctccttgatttgatcttcatttagatcttcgtctgcaatatcaagcaaatcaaatttctgggctgttttgtcttcattcatttcatccaggtgactatcatcttctgcttcaaccatttgggctttttttaatgattgttctaggctatgaagatactttttaaaatcacgttcgtcatcaaaaccagcgttttgcaaaaccgagagtactttcttcttaggttcgtcaattaattggtctctaacttttgagaagtattcaaattcttcctgcttctgaaccaatttttccattcttttcaaacgtgcctgttcttgcaagcgtttcccagtttcctttcttttttcggcttgaattcgtaattcttcttctgtcttttgaggttgaaggacttctgtaaaaggggcttccactaccacatcatttgtatcaaggttctccaaggtgaggattttttcaatatcttcatcataatttcgcgaaacatagcaataatctttatacatcgtttcatactgcaaataagacatctttgttggaaaatatggatacttcaaagccatcaaatcattcaagtagtcaactgcttgatgtcctccccaattaatcctttttgcatctgtcaagatacctgcaccatcaactacgggaattacattggtgtcctcatggccacaactgatgaccaaacctgttttatttccgcttgggttataattgtaaaaactaaacagactgtctattccgaaagtaacgcctggtacattgtaagtttcaaacaaaatctggtaccaatttgtccgttgtgattgaacagttgccagtctttcggtaagtaatattggattaggaattccgttatctggtaccactcccaaatgatgaaaagtgtagtccaatatttcttcagtgagattccaattggttacaaatggtccgtcaaaggggcttctcgattgcgaacgcacagcttgatccaacaaggtgtcattaccgacaaaagtgaaatttttgtttaactttctgtctctaaacttggtcaatgcattcggaaaaatatgtgtaggggtagcatggttaacgaatcctgctctcagtttgcttgatccaaaatcaatggcaatgggcgactggggattgtaagctgactgttcatcgaatggttctggggtttgtctcaatggagggtcgtctatcactactgccttaagaggagtcaaagaggcgtctctgctagacattatacgtcttatgttcagagtccttcgaaatttcacttttataacaagtttttactgagaaccgctgcttatattgattattatattcttcccaaagtgagtatttcataagcgttgtaatgatgtatcatagtctacgaaacgagataaatgctaaacgctaattatagttgagaatttacaacgatgtaagtcgcactaagccaagaacttctttcgatgattgtcattgctcttagcaaactgttcattgtgagttttgttacttgctgaaaattacatcggtcaagacccttctatattgtcaccttccatttatgaagacagcacttcaaggcaaaagtgtttaatatttatacgcggatcatgattgcttagctccttctttaactcagtacttgtggttagaattttgtagatacctgcacacattttggtagcagctgtgtcggtgtttcatgaggatcggaaagatatgtacggaaagatcacatgtatatatttaacaaagaatgcataattcgccttgttgatggttacgaccagatcagataaagtagttcaaagatcacaacagaattttatctttccaattaccattcagaaaaattttttatctcttggagggttattttcgggcctttcaagaatatgataaagatatatcttggcagatgtactgatgattactggtgcgttagaaccgtatggccttgaaaagaataaaagcaaacatcgatttttttggtactgaattacacaatttttaaggactaaaaaaaaaaatgtttaacctgaacaaccatgtatcttagatgtcagggtatctagattatttctctaccattcaggacatcatccaaaaacatcgatggcgcctgtcttttatgagcctttttaggagagctagtatttgaggtagcagaagcgactggtatgaggcccaaggaggattggtttctcttatggtagccttccattgagttaattttcttttcctttctttcaggtgacgctgctctttgtggtctattgaggttcagctttctctcttcttcttcttcttcttcttcttctagataggtacctacgtataaaaatggatcgtcaataaaaatgttagtgtcttttgattgatggcggctatgacttttttcatattgtgacacttgtaaagtaggagatataaataaggatcttctgttgtctgtgaacggatcctgaattgggttgaatggtgaggcagcatcctcgtattggctagattctaattggctcatagaatcccaatcatcctgcatatatgatttctcatcattgatgtcaaagggattgctttgtaaagaagaactatgcttgtggtgtcccctgtacaaatttttactatcatttgcataagaatttgtcattgtgaaacgacgagacaaataactggacactaaccaccatataagaatactgataaaaatggcacctatgacagcacccacagcaatgtatacagttccatttggtttatcagcagcatttaaaataaatgggtttcctgctgtagatgggggtgttatacttgcgacaattagtgatgaggaggatgttgctccactggaagttgagaaagccgaagatgttaacgatggaagggacttggaactcgtttcggacactacacttgacgtgggctttgacagggcggttgaactagttgtagtagtaactaaagtaggaaggtctcttctgaccagcgatacagacgggataaagtttttcttaaccatctctgccgatgtttctttctgaacttttgacaaggtatgagtctagttgattataatacaagagtgtgggtatgttattaataaacattataaattattaacccatatagctgctaaatataattgaaaatctagtaatttctaattatacattttttttttttacaaatgttttatgatatgtttactatttcccgctttaggaaatcatattaagggtttcatgaaagaattctgcagagtgatcattggaaatcggcagaaagtgagaagggaggctgtcaccaggttcccctatactattcatgtgagtggtagcatgcaaagtaaagaccctttttcatttagtgattcatccatgaatagctcttggtgctagcccagatttttcagtaatttttgttttttcttctgaattttccagaattaaaaaaaagatcagaaaaaagcgagagtttacttaagatattaaagtctagttgatatatcaacaagtgaaggcaaaataccaatagagtgcacgtttcttgatgctatgaaatacatacccccattaaatttttcgccagtggtgagcacggatgtatcgttatatcgatcgggatacccgatgccgttaaattatagtttcatcaagcatcagttacacttgaagaccataatatatattggcgataaagataggcctctcgaagaatatcaaagcttcctggagtcagaaaagataaaatactatcacatatttatggattcaagccgcgatgaaggaattcaagaaagaatgaaccaggtcttgcacttggtgctggatgtcagaaactatcccatcttagtgcattccaataagggcaagcaccgtgttggtgtagttgtgggaatcataagaaagttgttacagggatggtccactgcaggtatatgccaagagtacgggttattttctggtgggatgaaagatggagtagatttggagtttatcacaatgttcgaaaccaatctgaaaataccgagaaacgttatccctggctttgctaaacactgcttgtatttgaatgagctagaggctgcggaaggaagtgatgatgagtcaggaagtgagtctattctcactgccaagcaaccaatatgattatgagaaccagccgttacaaagaatattttctgtcattaatatatttgtataaataaaacaacaagtctaaagatcaagtagaaaaatggaaacaagaacgagcacatatatggtatatagtgaacatatatatattagatatatacgttcaagcgtcgaaggacaaagaccaacctagcttgtgaacaggttcagacaacttcaaagcatcgaaagaggaaccgacacccagagtgacgccaggtcttaacaattgcttgtaagccaaagtgacaataccggaatcggacaccttagccttaacttgggaagatgcatcaggcaaatatctagtggcgaattcgatgttgacattggagttaggtagtttgcagttcattgtagccttagcaccgacctgtaaaaaggcgttgacgttttggaagaagtcaacggtagttatttgctcgttgttcaatgtagcgcccaaggagtagtctttggcgaaataacttaaagccatggcataacgagaaatggaaccggcgctgatatcgtaaccaaactctgcgccaccaacaataccttcgtgggccatagttaagtcaccaacaaatgttggtgacttcaaacacaagtcaaaggcacctcttgcggtgaagaaaggttgtgtgaacgtagtgtttaagacggcggacttggcgacgcctggagtcaaagaagtgatcaattcgttctttagaccaggggtcaagttggcaaactctaatttggtttgcaagttgtttgtgttagaccagccttgagttagacccaagccggtttgcttgtcattcaactttgcttccacgttagtagacagtggaccgtctttgacaggctgtttagccttcaatgagaacttaatgccattggcggttgttgtttgcacatcaaaggcagctggggtagcatgatagaaatccttgttcaataggtcattgatatttctggagatatcgctgtaaactggaggagacattgttgagaggttggtttgatttttgctttgggtacgcttggctgtttcgtgttgggagaatccgtagcactaatgagtagtggaacgagttgggggtagttatatagtagatcaactcgtgctctgctggctataaaaggggttctttgttgaggaacggccgaaatggcggtgtttgattgggccgcagccggcaaaaagcaccggaaccgtgaaaaaagctcgtctgacgcggaaacgtgcggcaaaaaatctccgcgacggggaattgaaccccgatctggcacgcgacaagcgcccattctgaccattaaacttgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaacgatgataataatatttatagaattgtgtagaattacagatttccttttatggattcctaaatcctcgaggagaacttctagtatattctgtatacctaatattatagcctttatcaacaatggaatcccaacaattatctcaacattcacccatttctcatggtagcgcctgtgcttcggttacttctaaggaagtccacacaaatcaagatccgttagacgtttcagcttccaaaattcaagaatatgataaggcttccactaaggctaactctcaacagacaacaacacctgcttcatcagctgttccagagaacccccatcatgcctctcctcaaactgctcagtcacattcaccacagaatgggccgtacccacagcagtgcatgatgacccaaaaccaagccaatccatctgattggtcattttacggacgcccatctatgattccgtatacaccttatcaaatgtcgcctatgtactttccacctgggccacattcacagtttccgcagtatccatcatcagttggaacgcctctgagcactccatcacctgagtcaggtaatacatttactgattcatcctcagcggactctgatatgacatccactaaaaaatatgtcagaccaccaccaatgttaacctcacctaatgactttctaaattgggttaaaacatacatcaaatttttacaaaactcgaatctcggtggtattattccgacagtaaacggaaaacccgtacgtcagatcactgatgatgaactcaccttcttgtataacacttttcaaatatttgctccatctcaattcctacctacctgggtcaaagacatcctatccgttgattatacggatatcatgaaaattctttccaaaagtattgaaaaaatgcaatctgatacccaagaggcaaacgacattgtgaccctggcaaatttgcaatataatggcagtacacctgcagatgcatttgaaacaaaagtcacaaacattatcgacagactgaacaataatggcattcatatcaataacaaggtcgcatgccaattaattatgagaggtctatctggcgaatataaatttttacgctacacacgtcatcgacatctaaatatgacagtcgctgaactgttcttagatatccatgctatttatgaagaacaacagggatcgagaaacagcaaacctaattacaggagaaatccgagtgatgagaagaatgattctcgcagctatacaaatacaaccaaacccaaagttatagctcggaatcctcaaaaaacaaataattcgaaatcgaaaacagccagggctcacaatgtatccacatctaataactctcccagcacggacaacgattccatcagtaaatcaactactgaaccgattcaattgaacaataagcacgaccttcatcttaggccagaaacttactgaatctacagtaaatcatactaatcattctgatgatgaactccctggacacctccttctcgattcaggagcatcacgaacccttataagatctgctcatcacatacactcagcatcatctaatcctgacataaacgtagttgatgctcaaaaaagaaatataccaattaacgctattggtgacctacaatttcacttccaggacaacaccaaaacatcaataaaggtattgcacactcctaacatagcctatgacttactcagtttgaatgaattggctgcagtagatatcacagcatgctttaccaaaaacgtcttagaacgatctgacggcactgtacttgcacctatcgtaaaatatggagacttttactgggtatctaaaaagtacttgcttccatcaaatatctccgtacccaccatcaataatgtccatacaagtgaaagtacacgcaaatatccttatcctttcattcatcgaatgcttgcgcatgccaatgcacagacaattcgatactcacttaaaaataacaccatcacgtattttaacgaatcagatgtcgactggtctagtgctattgactatcaatgtcctgattgtttaatcggcaaaagcaccaaacacagacatatcaaaggttcacgactaaaataccaaaattcatacgaaccctttcaatacctacatactgacatatttggtccagttcacaacctaccaaagagtgcaccatcctatttcatctcatttactgatgagacaacaaaattccgttgggtttatccattacacgaccgtcgcgaggactctatcctcgatgtttttactacgatactagcttttattaagaaccagtttcaggccagtgtcttggttatacaaatggaccgtggttctgagtatactaacagaactctccataaattccttgaaaaaaatggtataactccatgctatacaaccacagcggattcccgagcacatggagtcgctgaacggctcaaccgtaccttattagatgactgccgtactcaactgcaatgtagtggtttaccgaaccatttatggttctctgcaatcgaattttctactattgtgagaaattcactagcttcacctaaaagcaaaaaatctgcaagacaacatgctggcttggcaggacttgatatcagtactttgttacctttcggtcaacctgttatcgtcaatgatcacaaccctaactccaaaatacatcctcgtggcatcccaggctacgctctacatccgtctcgaaactcttatggatatatcatctatcttccatccttaaagaagacagtagatacaactaactatgttattcttcagggcaaggaatccagattagatcaattcaattacgacgcactcactttcgatgaagacttaaaccgtttaactgcttcatatcaatcgttcattgcgtcaaatgagatccaacaatccgatgatcttaacttccaatctgacatcgaactacatcctgagcaaccgagaaatgtcctttcaaaagctgtgagtccaaccgattccacacctccgtcaactcatactgaagattcgaaacgtgtttctaaaaccaatattcgcgcacccagagaagttgatcccaacatatctaaatctgatatccttccatcaaagaagagatctagcaccccccaaatttccgatatcgagagtactggttcgggtggtatgcatagattagatgttcctttacttgctcccatgtcccaatctaacacacatgaatcgtcgcacaccagtaaatctaaagatttcagacactcagactcgtacagtgacaatgagactaatcatacaaacgtaccaatatccagtacgggtggtaccaataataaaactgttccgcagacaagcgaacaggagactgagaaaaggattatacaccgttcaccttcgatcgatacttcctcatcagaaagtaattcactacaccacgtcgttcctatcaaaacgtcagatacctgtcctaaggagaatacagaggaatctataattgctgatcttccacttcccgatctgcctccagaacctcctaccaaattatcagactcctttaaagaacttccaccgatcaattctcgtcaaactaattccagtttgggtggtattggtgactctaatgcctatactactatcaacagtaagaaaagatcattagaagataatgaaactgaaattaaggtatcacgagacacatggaatactaagaatatgcgtagtttagaacctccgagatcgaagaaacgaattcacctgattgcagctgtaaaagcagtaaaatcaatcaaaccaatacggacaaccttacgatacgatgaggcaatcacctataataaagatattaaagaaaaagaaaaatatatcgaggcataccacaaagaagtcaatcaactgttgaagatgaaaacttgggacactgacaaatattatgacagaaaagaaatagaccctaaaagagtaataaattcaatgtttatcttcaacaggaaacgtgacggtactcataaagctagatttgttgcaagaggtgatattcagcatcctgacacttacgactcaggcatgcaatccaataccgtacatcactatgcattgatgacatccctgtcacttgcattagacaataactactatattacacaattagacatatcttcggcatatttgtatgcagacatcaaagaagaattatacataagacctccaccacatttaggaatgaatgataagttgatacgtttgaagaaatcactttatggtttgaaacaaagtggtgcaaactggtatgaaacgatcaaatcatatctgattgaacaatgtgatatggaagaagttcgcggatggtcatgcgtatttaagaatagtcaagtaacaatttgcttattcgttgatgatatgatattgttcagcaaagacttaaatgcaaataagaaaatcataacaacactcaagaaacaatacgatacaaagataataaatctgggtgaaagtgataacgaaattcagtacgacatacttggattagagatcaaatatcaaagaagcaagtacatgaaattaggtatggaaaaatctttgacagaaaaattacccaaactaaacgttcatttaaatccaaaaggaaaaaaacttagcgctccaggtcaaccaggtctttatatagaccaggatgaactagaaatagatgaagatgaatacaaagagaaggtacatgaaatgcaaaagttgattggtctagcttcatatgttggatataaatttagatttgacttactatactacatcaacacacttgctcaacatatactattcccctctaggcaagttttagacatgacatatgagttaatacaattcatgtgggacactagagataaacaactgatatggcacaaaaacaaacctaccaagccagataataaactagtcgcaataagcgatgcttcatatggtaaccaaccatattacaagtcacaaattggtaacattttcctactcaacggaaaagtgattggaggaaagtcgacaaaggcttcgttaacatgcacttcaactacagaagcagaaatacacgcagtcagtgaagctattccgctattgaataacctcagtcaccttgtgcaagaacttaacaagaaaccaattattaaaggcttacttactgatagtagatcaacgatcagtataattaagtctacaaatgaagagaaatttagaaacagattttttggcacaaaggcaatgagacttagagatgaagtatcaggtaataatttatacgtatactacatcgagaccaagaagaacattgctgatgtgatgacaaaacctcttccgataaaaacatttaaactattaactaacaaatggattcattagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaacgatgataataatatttatagaattgtgtagaattacagatttccttttatggattcctaaatcctcgaggagaacttctagtatattctgtatacctaatattatagcctttatcaacaatggaatcccaacaattatctcaacattcacccatttctcaaaactatcacggaatactaatcgaagactagtgacgcacgttacgctatagcaacaacgtcacaaggataacgttagtagttttttggaaggacaattgcaaactatatgtaaacgaacgaagacacacagtccaaagctgtaacaacaaccacatatataaatggtagtcttctaggaaacttcactgtaagattagatacgtagaggtgaaagacaagttgaagtttggatcggaagttccattaatatttgggtaagtaagttcgccgcgcggcagaaacggtgagtacttactcacttttgttctaactacaacaaaaaactgtaaaagtggtgtaaggtttacgttccgttttggttgcaaatcatcagccctggtttaagctttatgtccaacattggttagcgaaggcaccgtactggtctcgatgtcggtgagcaggggcggcgaaattcattccaatcttggataatatatatgtatatatctatacacgcggcgagatcttgtcctctaatttcccttcgctaaatcattaagaggtcattcatgaagttaattcagcaccaaagttggactgttagacacgagatacacattgcagtccaaatgtgcagatttttcagataattgtcgtcgcacaagactgcccctcccgtcctcagacagacacaaaattagattttacgtttacataaagatgtacataacttgaaaaaacgttaatccctcttaaatttagaccttgtaagtcttcctggccactctttgtgatatattgtagtgcaatatattgattcgttcttcttatttctttgttcttaggcatttccgctttagaaaattcgttgggtggtttctgcgacgggtatccccttcgattttgcataatgatcttcaattctacaactaaaatcaagtagatacaggaaaatattccataaattatagtgtaaatcgccctgtatacaccttatcgtttcatctcaggcaagttaaagcatttgggaaacgtgctagatgacagaagaagatagaaagctcactgtagagacagaaacagttgaggcacccgtggcaaataatcttttattgtcgaataacagtaatgtagtagcacctaatccttctattccctctgcctccacatctacctctccgctacacagggaaatagttgatgattctgtcgctactgctaacaccaccagcaacgttgtacagcataatttgcccaccatagataacaatttaatggattccgatgccacgtcacataatcaagatcattggcattcagacataaacagggcaggaacatcaatgtcaacgagtgatatcccaacagatttacatttagaacatatcggctctgtttcatcaactaataataatagtaacaatgccctaatcaaccacaaccctctgtcatctcatctttccaatccgtcatcttcattacgaaacaagaagagctctttgttggtagcttctaaccctgcgtttgcttcagatgttgaactctcgaagaagaaacctgccgtcatctccaataatatgcctacaagtaacattgccctttatcaaacagcgagatcggcgaatattcatggtccatcatcaacttccgcatctaaagcgttcagaaaggcttcggccttctccaataacacggcacccagcactagtaataacatcggctcgaatacacctccagctcctcttttacctctaccttcactatcacaacaaaataagccaaaaataatagagaggcccacaatgcacgtcactaattcaagagaaatacttttaggtgaaaacctgttagatgatacaaaggcgaagaatgctcccgcgaattcaaccacacacgataatggtccagtagcaaatgatgggctgcgtataccgaatcactcgaacgcagatgataatgaaaataacaacaaaatgaagaagaataaaaacattaatagtgggaaaaatgaacgtaatgatgacaccagcaaaatatgcactacatctactaaaacagcgccttcaaccgcacctttgggcagtacagacaatactcaggctctcactgctagtgtctccagcagtaatgctgacaatcacaataataacaagaagaaaaccagcagcaacaacaacggcaataacagtaatagtgcatccaataaaaccaatgccgatatcaagaattctaacgccgacttgagcgcttctacctctaacaataatgcaataaatgacgactcacatgagagtaattcagaaaaaccaacaaaggcggattttttcgctgcaaggctggctacagctgtaggtgaaaatgaaattagtgattctgaggaaacatttgtttatgaatcggcagctaattcgactaaaaacctaatatttcctgactcctccagccagcagcagcagcagcaacagcaacctccaaaacaacagcaacagcaacaaaatcatggaataacctcaaagataagcgccccattgctaaacaataacaaaaaattattaagccgactgaaaaattcaagacatattagcactggtgccatattgaataacacaatcgcgactataagcacaaatccgaacttgaattctaatgtgatgcagaacaataacaatctgatgtcgggacacaatcacctggacgagttgagcagtataaaacaggagccaccgcatcaattgcagcagcagcaaccaccaatggatgtacaatcggtagattcgtatacctctgacaacccagacagcaatgttattgccaagtcgcctgataagaggtcaagcttagtatccctatctaaagtttctccacatttactttcatccacatcaagcaacggtaacacaatatcgtgtcccaatgttgccacaaattcgcaggaattggaaccaaacaatgatatttcaacgaagaaatctctttccaattctactttgagacattcctctgctaatagaaattctaattatggtgacaacaaaaggcctcttagaacaacagtgtcaaagatatttgattcaaaccctaatggagctcctttacggagatactctggggtaccggatcacgttaatctagaagattacatcgaacagccgcataattatccaacaatgcaaaatagtgtgaaaaaggatgaattttataacagcaggaacaataagtttccccatggtttaaacttttatggtgataacaatgttattgaagaggaaaataatggtgactcgtctaatgtaaatcgaccgcaacacactaaccttcagcatgagtttattccagaagataacgaaagtgatgaaaacgatattcactccatgttttattataatcataagaacgatttagaaacaaaaccgctaatatccgattatggtgaagatgaagacgtagatgattatgatcgcccaaatgctactttcaacagttactatggctcagcatccaacacgcacgaacttccattacatggaaggatgccttcaagatcaaataatgattactacgattttatggttggcaacaatactggcaataacaaccaattgaatgaatatacccccttaagaatgaaacgtggtcaaagacacctatcaagaacaaacaatagcataatgaatggtagcatccatatgaatggtaacgatgacgttacccattccaatatcaataataacgatattgttggttactcaccgcacaacttttactcaaggaagtccccatttgtgaaagtaaagaattttctttatcttgcatttgttatatcatcactattgatgacaggattcattctgggatttttattggccactaataaagaactacaagatgtagacgtggtagtgatggataatgtgatttcaagttcggacgagttgatcttcgacatcacagtaagtgcttttaatccaggattcttcagtataagcgtttcccaagtcgatttggacatttttgcaaaaagttcttacctgaagtgcgattctaatggtgactgtacagtaatggaacaggaacggaaaattttacaaataacgacaaatctttcgttagttgaagagagtgctaataatgatattagtggtgggaacatagagacggtattactaggaaccgctaaaaaactagagacaccattaaagttccagggcggcgcatttaataggaactacgatgtgtcagtctcgagtgtcaagcttttaagtcctgggtctcgtgaagccaagcacgaaaacgacgatgatgacgatgatgatggcgacgatggtgacgatgaaaacaatactaatgaaagacaatacaaaagcaaaccaaatgctagagatgacaaagaagatgatactaaaaaatggaagctactaatcaagcatgattacgaattgatagtccgtggaagcatgaagtatgaggtgccctttttcaatacgcaaaaatctacggctattcaaaaggattccatggtccatcctggtaagaagtgagtgttaagaatgtagctttttcgtcaaagctgggtatttttctttttatagcgcaggagcggaaggcaatttccaaaacaggaatgtactttccaaaaaaggaaaatgtagtttgttttttgatgtttttttctctttgactatttcaaatttagaagtgaaaaaatacaaaaatgttacataggattcgatacagtgtaatatatcattattattacttttaaataaagcgtttagtaaacaagagtgagggttatgcaactcgtttagtaaacattcttttttttttcttcatttaagtataagacaacaatagtagcggaagcgatagtaatacatttggtagcgataagtgcacatgcaatttcactcagataagcagcatttggacagtaaaaccgacatcgatttcaagccaaactcaccgcgttccttacaaaataggaataccaaaaatttatctttagatatagcagcactccatccattaatggaattctcatcgccaagccaagatgtgccaggttcagtaaaattcccatcgccgacacctttgaatctatttatgaagcccaaacctattgtgttggagaaatgtccaccaaaagtaagtccaaggccaacgccaccatcgctgtcgatgaggcgaagcgaggcctctatatacacactaccaacatctttgaagaaccgaactgtttctccaagcgtgtatacaaaatcatccacagtatcgtctatcagtaagctgtcatcatcatcaccgttatcgtcattttcagaaaaacctcatctgaatagagtccattcattatccgtgaaaactaaagacttgaagttgaagggaattagaggacgttctcaaacgatctcagggttagagacatccacgccaatttctagtactcgtgaaggtactttagatagtacggatgtcaacagattttctaaccaaaagaatatgcaaacaacattgattttcccggaggaggactcggatctgaatattgatatggtgcatgcagagatttatcaacgaacggtttatttagatggaccattgctggtactgccgcctaatttgtatctatattcagaacccaaactagaagatatattatcgtttgatttagtcattaatgttgccaaagaaataccgaacctggagtttttaataccgccggaaatggcacataaaataaaatattaccatattgaatggacacacacatccaagatcgtcaaggacttatcccgattgacacgcattatacataccgctcattcgcaaggcaagaaaatactcgtacactgtcagtgtggagtatcaagatcggcgtcattgattgtggcgtatatcatgcgatattatggcttgagtttaaatgatgcatacaataagctgaaaggtgttgctaaggatataagtccaaacatgggtctcatcttccaacttatggaatggggaaccatgttgtccaagaactcaccgggcgaagaaggagagactgttcacatgcctgaggaagatgacatcggaaacaacgaagtttcctcgactacgaagtcctactcttctgcgtcctttagaagttttcccatggtaacgaatctatcatcgtcgccgaatgacagttctgtcaattcttcggaagtaacgccaagaactcctgctacgttgactggagcaaggaccgcactggccacagaacgcggggaagatgatgagcactgtaaaagtttgtctcaacccgcagattcactggaagcttctgtggacaacgaatcaatatctactgccccggaacagatgatgtttcttccttaagggacagcatctcccaaaagaatctttatgactatcagatctgcaggcagaccgcctccctacgcttctaaatagaatgtacttagcacttctgcctacatagtaattattcatcattgtaagtgtcacattgcaaaaatcgtccaatagacgttttcctcgtttgtgattggccctacgttttgcgccgatacaagcggcggcgaaaagttaaaaagaacaatcaattaaataagaaccatcagtcctcgtattttgtcttctgtttgcaagcaatgcaccaaacacaagatcaactaagaacgcatctacaatgttacgtaacacttttactagagctggtggactatcacgtattacatccgtaagattcgctcaaacacatgctctttccaacgctgctgtaatggatctgcaatccagatgggagaacatgccctccactgagcagcaggatattgtcagtaagttgagtgaacgtcaaaaattaccatgggcacagcttactgagcctgaaaagcaagctgtgtggtacatttcttacggagaatggggcccaagaagacctgtattgaataagggtgattccagttttattgccaaaggtgttgctgcaggcctactattttcagtgggactttttgctgtcgtcaggatggcgggtggccaagacgcaaagaccatgaataaggagtggcagctaaagagtgacgaatatttgaagtcgaagaatgctaatccttggggtggttattctcaggtccaatctaaatgaacaggccagaaattttgaaaggaaatcaataggggttaacgattgtcatggttttttcagctagtctgtgacctgtacgaaagtgaatatcttattacattataagtgtatccatggcatccgcccaatacaatgccaacatatcaaacataaaattggctgattgccactctcacattttttctttatttatttactcaaattttgtaattttttgttagacatataattttatatcattattcttattattcttatatttaagggaacccccctggaatgaaataagctaatatagtatgagggaatcctgtataaatgggtttaccttgttattctatgcctccctttcaaagacgtatttcttaaaaacttctccatttggttgaatactatgaaaaaaaaaaaatcaactagaatagatatggaagataaaaatgtgtaacaaaaaagaagaaaagagctggaggtatgacaatagcgccaatggcaaacgatttagaagattttgagtctctgctggagcctgattttgatgctaaacaatttggtaatgacttactgaaggctactaataacaatgacacaaccattttagaccttaacacgcctcttaaaaagctaaactatgatctacatgagattgactctagaatagaccaattgatgaatagcaacccattggagataatagagttaatttacaaaaatgaacacgtcaattcaaccatagttggtgagttgaaaccaagtttgggatatatgaatatgtcgtacgatagactaaagaatcaagttctagatccttatgaaagagcgaggaaagtccaactagcgttgagtaaagtttaccaaacatcttttctcttgcgcggagcattgctttatattcatttatcaaacaaattaaacgcactgtctaaaacagcccaactaagcacatcaacagctattaatttagcctccttacactaccaacttgaaattactttggaagaaaataaaaatctaaaatccttgcggaaaattaaacaattagatcaggacattgtttcccccaacaaaagagagttaataacatttttgtctttacaaatgtgtaaagagtgcttgaactctattaaaatcaaatcgaacaaagaaataatatctcagctggcctactccttatatctactttcatctcaagaattcgagtctgcaataaacaagattgtactatctaatgttacaatgagctcacaaatcctatcaaaaattttaaattctatcaggatgtttcctgatgcgttcaatgaagttgttgaaaaaggttataacatctacattttagaaacactactacagaacatcaaaacggataatgttacgaattcctcgagatctattgctgctaataaatcacgccttggcaatcttttatcagaatatacctcaatgaagagtaaagcaggttctggtacaccgagagatctgttttggagcaaagtttcatctgccttcaaaaaggactttgatatatctgttaatagaggaggccctgtgggcaagtcgctgttaaaaaataaagattttattataaacactatgaagcaaagtatgaaaaaatcttctgataatagtgattaccaaagctacttggatgtaatgctaaactcagtatctatttctctaaataagtgagacagtttacataaaattaagaatgttgatgaaataggatgaatctaaagcaattttcaatagcatgtgcatatgtttaataaaaattacatgaaatgtaatatttgtttatattattaaagattatactagtaatagttattatgagaaatccaatatcggttagtttatatgaagtattaatatgtatatatatacatttacgtggtcattctgtcctaaacttaggggtactgccagcttttgccagtgggttcaaaggtaccttttttttgtttttctttccaccacgcttatgaaactttttcttcaactgtttctttatctcacgagctttggtatcacgctccttggttctttcaagtgccagttttttggctgcacgttgcttttgaccaggtctcctctttttaatcttcaattccttctgctgctctaactctattctcgcattgtgcttatacagatctattattcgaccctggcaatatggccatttatcacgaatacgtagatcatcctccagaatttttgtactttcttgtattatcacatcatagtcgatagagctctgttggaattgcagcttttggtctgcagaatagcttgcaaagtagtagtctttgggcctttcttggttgattatttcttcttcaggttccttcaatgaaattttcatcaaacttacttcagtctgtggcgtatccttctcttgagttgatgaaccttgttcttcttgagctgggctagtcgatgcttcaaccacaccaaacgaaaataacgggaactcgaattcttcttgtttttcttccttttgttcatgtgcgctgttattactttctttgagatctaatgatgagtcggttctttcaacttcaacgaattcaaattctgttggcggtactaatacctctacatgctcactattatttttactactactattggaatcataatcttctcctaatccctctccttcattataaagatcttttcttgatactctgcaaaataattagaatattaaacgattcgttgaaaagttagtaaaaaaatgaaattagaggcaaacttgtatcttatgtcaaagcatacatcttaaattcagacatttttatactgaatttcaatgtttttctttttttttcattagaggagatttttccattgctgtttaaatgaaactggtcgtattttaagtacttcaaatttttctttttcgtactgatccgatgacttgaaaatacttattttttatgtaggaacagaatggcatttttgaagtacataactctcacacgcaaaggccaaaatctttcacgatttacttttatttctatctgtattgtatatcaaaatctatacatgatgatcggttaataaagataaagattaaagaaagactgattgttatctgttgatactagtcttcatactctgtaagtattctctataactagcacaatttaaaactttgtcttcgacaagagtacttaatacccatagccttaaagaagccatatctttttcggagtttaggttggcgggctcgttaatagatggtcctcttattatgtataatgattgaaatgtgattgtatcattgttttctctaattctaccgattatcctccttagtctttcattgaaaggcgaatcgttcaaaagaggcagttcacttttccccacaggaatttgagatatggtgtcagtattgaatacatctattagtaactcaggaacagcatctccgccaacccataaaaataattctgcggaattgtcaattaaatacaggccatatctttcgaaaagagatatagtggcatttataggttcaggaagaaccgtttttccttcaaagtcaggtagaccgacttcgtcgggcatgtcgtgcagggagtaaactgtagggtaaatgctctttatcaaataatgaagaggctccgtttccaatctattcaacgcacttgcacggtaatcgcttggaacaacgcccggtctgagggctatatgtttacttagtccattcattaatagaggtaacattctcaaatttgcgcataggttaagtgaggttactgaatttatattagacatcgaaatttcttttttgtaggcatttaaaatatcttcgagcgattttgtgataaaatccctcgcagagtacatgcttgaattcaaagccttagtcaccgcgttttgtgtcatgaaatcagtaatggctagttgatctgcggatgcaaacacttccctagctgattcggacgttggtagagctaacgtcatgactctaattctacgttcaccagtgtttagagtcaacaatgttgacacttgcaagtagcaatattctgccattaatgagtcttcgatggatatcccgaaaagataagactgatctctaggcattgtggaaaaagcgcataaatcagaggatctgttaaaaaaatggccaaaaaacgatgtggccctcaagccagtagaacaacgaactctcataacagcttccattgaaatatccatggataaatgccttgataattccctagtaaacttagtaacatcgttcaaactggtggcattaaaaccaggataaaaatgtgtttgaccaccagaaaaacggcccaggtgagatagagtggcaacgtccatgtagtcctctgatgccagaaacatgtccactgttatttgtagtttattacactcaattgtgaatgttttataaaaggaatctttacacgacagtagctgagagctttcttttggtgtgtttaatatgccctgttcacttctttttttcaatttcccgatgccagtatttggtaaagttgatgaaatgacttcaactttgcctccagtgctttttatcaaatttgacgcagcttttagggcaggtccaagtgcaaacttgctactgtgtgtgtcttgaaaaatttcaggtatctttttcaacaatgtttccagattatttttacaatattttagtggaactactaattcatcactcggcattggtaaaaatggttcatccaaatcgccaatatcaaacatttgaattgtttctgaattatcaacgtcttcctcttcctcgtcttcatcttcttcttcaccatctgattcttcatcatcctcatccgatacttcataatcatcatccaaaggaacgtaaaaataatgaaggctatgatcaacacatataatagcaattctggtccttccatcatgatttggtagaaattctatgttttctaaaatggttctggcagaagtagccaataaaccatttttgacagcgttttgagaaacatctaaaagaaatacataaacagatggtgggggttccctaacagaatattctacgggagccaagtaatccacgacagagtttttaatttcgtttctttcatatctgttgattggagcgccttgtaagttctgatcaaacccaaatgggacatcatttttgaaacggcatatattacattgccattttctcccttggttaatgaaaacgacaaaagggttcatatatgaacgacaacggcgacagcggacaatgactccgtcagtatttagcggtacttggttgtctgaatcttgcaaatgcaaatatggtctaataacaatggcaaatggtaacttcgttttcttcagcagagagtttgtttttggcaccgctttcaaagtagatctgacgtactggtatggaacatttgaatattcggatggagtcacaatgttatcctgagaaatggtgattggaagaggtggtaaagacaggtcacggattggcggaggtaattctgtaaacaaatccacagggtatagttgattgaccactttcccagaaccaggaaactgttgattttgagctagctgtgtaaatgagttagccctattgttcaattgtaggttgcccattgcataagctgtttggtcgatttgttgttgagactgctgttgctctgcaactattggcatacttgcaatgtatggcacctgagcttgagggtacaccctcttcttatgatgagacattattcactgcagctgtcgatcattaatggaagaaggttcatcaaccaagcacactgcaaatgaagggttagatgaagagttcgacgaagacccttttaactgacgtatcattcatcgttgtcatcgctacatctatgtccttcgggtaagctaaacaaaaagtgaaaagttcaataaataataagattgagaggtaagtgaagtgaagatagatgttagtatccaagtgtgaccaacatgttcaggtgattgcaggcgaaaatgggcagtgcttggacaaactacaattttgaagaggttaagtctcattttgggttcaaaaaatatgttgtatcatctttagtactagtgtatggactaattaaggttctcacgtggatcttccgtcaatgggtgtattccagcttgaatccgttctccaaaaaatcttcattactgaacagagcagttgcctcctgtggtgagaagaatgtgaaagtttttggtttttttcatccgtattgtaatgctggtggtggtggggaaaaagtgctctggaaagctgtagatatcactttgagaaaagatgctaagaacgttattgtcatttattcaggggattttgtgaatggagagaatgttactccggagaatattctaaataatgtgaaagcgaagttcgattacgacttggattcggatagaatatttttcatttcattgaagctaagatacttggtggattcttcaacatggaagcatttcacgttgattggacaagcaattggatcaatgattctcgcatttgaatccattattcagtgtccacctgatatatggattgatacaatggggtaccctttcagctatcctattattgctaggtttttgaggagaattcctatcgtcacatatacgcattatccgataatgtcaaaagacatgttaaataagctgttcaaaatgcccaagaagggtatcaaagtttacggtaaaatattatactggaaagtttttatgttaatttatcaatccattggttctaaaattgatattgtaatcacaaactcaacatggacaaataaccacataaagcaaatttggcaatccaatacgtgtaaaattatatatcctccatgctctactgagaaattagtagattggaagcaaaagtttggtactgcaaagggtgagagattaaatcaagcaattgtgttggcacaatttcgtcctgagaaacgtcataagttaatcattgagtcctttgcaactttcttgaaaaatttaccggattctgtatcgccaattaaattgataatggcggggtccactagatccaagcaagatgaaaattatgttaaaagtttacaagactggtcagaaaatgtattaaaaattcctaaacatttgatatcattcgaaaaaaatctgcccttcgataagattgaaatattactaaacaaatctactttcggtgttaatgccatgtggaatgagcactttggaattgcagttgtagagtatatggcttccggtttgatccccatagttcatgcctcggcgggcccattgttagatatagttactccatgggatgccaacgggaatatcggaaaagctccaccacaatgggagttacaaaagaaatattttgcaaaactcgaagatgatggtgaaactactggatttttctttaaagagccgagtgatcctgattataacacaaccaaagatcctctgagataccctaatttgtccgaccttttcttacaaattacgaaactggactatgactgcctaagggtgatgggcgcaagaaaccagcagtattcattgtataaattctctgatttgaagtttgataaagattgggaaaactttgtactgaatcctatttgtaaattattagaagaggaggaaaggggctgatgttttttgaaaatagaagccttgtttatgagaaaacttatacataatattacatacaaactagagcattactatataattaacttacttgtcacagctgattgctttttctaggggaatctacattttcaatgtaaaattcaggaaccctattctgaatttgtgaatcattcgtttccggtatcgatgacgtggtgttagtgattgtcaaattgtctaattttggaatggaattcaagggaaaattgctactactcacatcatcgtatctcgtatgttgctcattagttacctggggggtcacgctctccgtggtgttttcattactcttggctttttctttagacagtttggcaactttactcacatatttgcatttgtcgtcatagttgggcaaacttgataaggctttgatatttccaaaccattctatcatatcgtcataagagtctactttgaatacccagttgtgacccctatgtattagtccgttagaattcgtacgcaatataaacttgttcttgccctgctctgagttggatttcgtctttttggaatgctcagtgacagtacattccactaatggtattgacattaacggtgtggaaaatttatgcttatctggtgtcttaaattcatgtaaaaagcttggagtgaggacataaaacccacgtgagtatgactttaaaaattttgatcttttctccagaaacccagatttaacttcaaaagtaaaaggatcgttttgattgctatacgagatctctttaaacctcctcatgggtaaatttggaggcacaaaattggaaatattccttagaatgaaactatcccattcaagattcgtgtttttgttcagtatcgtggaatctaatttagagataactgagtcaaatacaacttgggcttctttgccaagaattctagcgtagctggtcaatccgttctgtatttccattacaataacactttctaactgggcccctgaattctgcaagttatcgaatgcctcgtgcaaataattttcttccaccaactgtcttttgatttgcttttccaattgcaattttatcaaaaatgggtcactctttggtgtacctaatttacattcttttaatgattcattaaaaagcttcatcaagtgtttagtttgctgaagctctttgttacaggaatttttaaaatcagattgcaaagccttaatttctttaatcttgactagtaaatctcttctcaaatcctctagcctgggtataatttcactggtcaactccttggaacttttcgatgccaaagaggccagattatcatgatacttggtcagcatcgtgggcaaatcttgaacggatccacttcctaagggcagaaaaaatttctgcatggacttgtcttcattagagaccggttgatattggttttcaatgctgaaaaaggggaactgcacagcatgggacaacctcagttgctgtctaactatttcgtcctgtattgaggcggtctcagagagatataccaagatggcacgaataacatttctccaggcagaaaacctagcagacaagacatcagtgggctgcgcagaagtcggtatcagtatcgccagaggggacctaggatcgttttggttagaatcatactgcttctggtggctatgtaaagacatttttggcagcgttagcatggaagggtcagtgaaggaaccaacattattgatattgttattattaatattattattttgtgatgatggaatattattagagttcaaagagtgcgtcgtattggtgccagccgcagcatcgactatcgaattttgccgatcgtgatcatatacgttcaactgagccgggatagtgggatcggaagtcacagcgtcgatagggtaaggtataggattgcgttgcgcaagcgacgagggtagtgacaggggtatgttctggcctttttgttgctgctgttgataggcgggattaaaatgttctgacctcattctgccttccagttgttgatattgacttctgaggtcaagagaggctcttgcactgttccgttggtaagacatggtgcaatggacggctgggtaaagcgtataacgctctcctaaacctttgcttgcgcggtcatcttctcatgtagtaggttgcatcgccttttgattaaagaatgcggcatgacccggaaaaaagaggcaggtattggctaatgactactaccattatgagtttttaccagtatcagcgccatcattaggaggatatattagcattggtggacgtaagagctcctaaatatacaagcatcgccgtgatgtgttatatattgcagctttatcttgctggagtgtctaccgtatttacttctacttttggcatttttttcgccaatgctggctcgaacaagaaactgcctgccatttgaattattcatatataaatacactaatcatacgtgagcatagtgtgacaatttcggcgcaagatattaatggagcacgtatcaaagaggtcaattgggcaattctttaagaggaaaacttcaactgtagatggaagcaaatcacagaaatgcggaaccactaaccaactgcggaagctgctgcataaaagaagggtacagaagcaggcagtgccggttgaatcccagtacagaattccgggtgattttagggataatcaaagcgtgagagtcaaaaactctatgtacaacagctcaccgtcagtaacgccatctacgcatcatatcaatgaaaggtatgttcgctatgacatcaacacaaggcctttggttgttgtgctcgcgatctcaattgtattttttggctgtctcctggtcctcaaggacatcatcatccagtcatcagaaaacatcctgagtgtttccaaatggaaaatcataggggcctccttcatgggtacgccctacacaggtcttctcacggggctcgttggccctctcctgtcaccattttcggctgtttcgtcgtggctttcattcatcttttgacacaatgcgtcttcagtttccgggggcattgcgtatggaaaatcatgtcactttttttcttccactttttcgtttgacttatataaacgcactttagtatagtttgctttatgtattaggttatcttggtgttctaattgatgttcttgcttccatttgtcattcgtcattccagctctatttacctgcccacgcttcgatttcgaggtttacttactgtaatctcaagaaacatacacatttccacccctcataaaatgttgcctctttcaattgagcagagaagaccttcccgctcccccgaatacgatcagtctactttatcaaattataaggacttcgcagttcttcacaccgatttaaacctgtctgtttccttcgaaaagtcagccatttcagggagcgttacattccaattgaaaaaactgcacgaaggtaaaaataaatcggatgaattacatctggatacatcctatttggatgtccaggaggttcatattgatggttccaaggcagattttcaaattgagcaaagaaaggagccattgggctccaggttagtcatcaataacgcttcttgcaacgataactttaccttgaatattcaatttcgtacgactgacaagtgcaccgctttgcaatggttgaacagcaagcaaaccaagggcggtaaaccgtacgtgttttcacagttggaagctattcatgcgaggtctttgttcccctgctttgatactccctctgtgaagtctactttcactgcatctatcgagtccccactaccagtggttttttcaggcatcaggattgaagatacaagcaaggatactaatatttacagatttgaacagaaagtccctatcccagcctacctgatcggtattgcttccggtgatttgtcaagcgctccaattggacctcgttccacagtttacactgaaccatttcgtttgaaagattgtcaatgggaatttgaaaacgatgtagagaaattcattcaaactgcagagaaaattatctttgaatacgagtggggcacttatgatatcttagttaacgtcgattcgtacccttacggcggtatggagtctccgaatatgacttttgctacgcccaccttgattgcacatgacagatccaacattgatgtcatcgcccatgaacttgctcactcatggtctggtaacttagtgaccaattgttcgtggaatcatttttggttgaatgaaggttggaccgtttacttagaaagaagaattattggtgccattcatggcgaaccaactagacatttcagtgctctgattggttggagcgatttgcagaattctattgattctatgaaagatcctgaaagattttccactttggtacaaaacttgaacgataacactgaccctgacgatgccttttccactgttccgtacgaaaaggggttcaacttactatttcacttggaaactattttgggtggtaaggctgaatttgatccatttattagacactatttcaagaagtttgccaaaaaatcattggatactttccagtttttggatactttgtatgagttctatcccgaaaagaaagaaattttggattccgttgactgggaaacttggctgtataaaccaggtatgccaccaaggcctcattttattacggctttggctgataatgtttatcaattggctgacaagtgggtcgaaatggctcaacatttgaaaaccacagaggatttccggtctgaatttaacgctattgacattaaggattttaattcaaatcaattggttttgttcttggaaactttgacacaaaatggccattccaacaagaaaccaaaagattttgactgggccaagtttcccgtggcatctagggcactgttagatatctatcaagataacattgttaaatcacagaacgcggaagttgttttcaagatgttcaaatttcagatctttgccaagctgcaagaagaatataagcatttggccgattggttgggaactgtaggtagaatgaagtttgtccgtcccggttacagactattaaactctgtagaccgtcgattggcacttgcaactttcgacaaattcaaggacacgtatcatccaatctgtaaagctcttgtgaaacaagatttaggtctttgaaaagggacgtgtcgtaacatgaatacgtaaacaattaaatataacctactaatgagccttcattgctacttctctggttctaattagtggcggagttctgtgtcgtgcgatacgaattttgcacttttgtcacatgcaatcgaggcaaaaagaaaaaataaataataacaacgaatataaatacaaatcgaaagaattcagattgaattcaatattgcagggctttgaacactgagtttggaactatcagccgtcaaatacgcataaaataacatcaaatactccaataatgaatcagttaggagctttagccgtaagttctaaattgtaaacacatttgcatcattgaaaaactatactaacgcgttaaccttttttctatatttctatagcaagtttcacgtttcactcaaaacttctccatggaaaatattaagagcgagttccaatccttgcaatctaaattagcaacccttcgcaccccgcaagaatttttcaatttcaagaaaatttccaaacctcaaaactttggggaagttcaatccagagtggcgtataacctgaagtacttttccagtaactatggtttgattattggttgtttgagcatttacacattattaacaaacttgttgctactctttgttattgttctagtcgtagctggtattgttggtataaacaaactaaagggtgaggagctcgtaactccatttggttctttcaagaccaaccaactatacaccggactggtttgtgttgctgtgccaataggtttcttagcttcgccaatctcaactttgctatggttgatcggtgcttctgccgtcagcgttttcggacatgcatcattgatggaaaaacccatcgaaactgtatttgatgaagaaactgtttgaacactcctacaagtgttgggaaaaggagtcattcttttctattgtgtattttactcttcttcaatatttagttaattcttgtcttttattctctttctccgtcaacattagtatttaattgtatacagacaccattcataattgcagttagcttctctgttctttctcattcctaggatttacaatgcagtcttaccttatttgtttatgtttttttcgtttatcaagcgtgcaatcaattactgaagattcacgtgccaaaacgtaaaaataataataacataacccgagagaggcaagattagaatcaattcatcttttcaaacaaatggttatatcgactaagcgaagtgattagatggtgtacgtcgcagatattcaacagtgacgaattatatgcgattgtaagattgattggcaaatcgtattccattactactattaacaactgatggcatctagaaggtaaaaagggtcaacgtagatgaggtagagtttgagcttagggccctgccgagttttcattagaagacctctactacacttcaaaatgaaatacccctgcatcaccagattcatcaacctaaacgtacaagacgtatgaaacacgtatgaaacagttgttgcgaaaaaaacaagattaagtattttcaaagccccggttgccttgatgaacctaaacgtataaatagttgagcaatcagtttagctccgaagatctatgcttccaccctttagtcagatttagatcctatatagattatatgggataagtaacattccgtcaatcaagctgctcttctgacaggtattaatattgttaagacggctagtattgactaacttcatgacacaaccactgttgtatctcaaaatgagatatgtcagtatgacaatacgtcaccctgaacgttcataaaacacatatgaaacaaccttataacaaaacgaacaacatgagacaaaacccgaccttccctagctgaactacccaaagtataaatgcctgaacaattagtttagatccgagattccgcgcttccaccacttagtatgattcatattttatataatatataagataagtaacattccgtgaattaatctgataaaccgttttgacaactggttacttccctaagactgtttatattaggattgtcaagacactccggtattactcgagcccgtaatacaacaaccacacgaaataatcgggcgtgtggtctagtggtatgattctcgctttgggcgacttcctgcctaaacaggaagacaaagcatgcgagaggccctgggttcaattcccagctcgccccgttatcttttttcaccatcagggcggaatttttttgtttagcatcaatcaacctaacctctcatgcttctccaagctgaaagaagtaaactcactctatgtacgtgttgcaacatatatctgccaaaagaatgaaagtaggttcagaacaaacagattgaaaggagaccagtaaaactatatggggggggttgttcttcccgcctccttctgggattatgaagacgcgctgatctgctatagttcaacgtccttttcgcttactatttctggtaagaaatataaggaattctcggattaattacttttctcgaaaggggattccgaacacctaccggaaaaaaatagcagcccttaaggggagagtacggctcttggcatgacgggaggcaggacagcactaaaggcagactagtcactgagcgctccaagttgggtatgatagtatcttcaagttttggtcgagtagctattcctcttcttcaaagccacttacgcttcgcccaataatgtcatgatttacaaataaaccttcctctccgaacccttaaaagtaggcaaattgagaaaattttttgctcgtctttttttctctcgtttcgattaccttattgggaacttctcgaagaactcggcgaagaggtccagaggaagattactgactatcatcaagccttgtttcttttggcctcttcagtaagctgcaaatgcagtattggcttttttaaaaaagaaaaagagaaggaaagcggaaactagtcttgttgctcttctagtgcagttgttgtttgttcatttgtttcttaataacagtcaacgagaaaacttgcgcgtgcagtaggaaaataagtagcaaattacattacatggaaaacttgcaaccatctgtgagcacaggcgaccaatgagtactttcaacagttacagccagccaaaggaaagcaatgataatagtcataataatgtcaacaagagcaaatcgctgttagatataatatttggtactaatgtatcggaatgggctttttctgagaatgctttaatgaaagctatggatttgaaaatagaacaagaaaagactaagcagcaatattataaacttgaaaacttgaatcgttcgatagagttgtttaagcttgcttccagttcaggtctgcccataaatcaaatacataaactattcaacaccgaccatggcgtaccggcgtcttcgccgatgaaggcagggggcaatcaaccacataacaatacagaaggcacgcaatcttcagaaaatctgcccagattgaatggttctatgaagtcattaaaacctctaaatatgaacacagtgtcaccaactccaatgagtcgacagccctctccatataagtttccagcatcatcctctaccggcggtatatcacactccacagttacaaatgtacaacgaagagctaattctcctgcaagaataggtgcatccgcagttgctgcgttgaatgacaatatttccattaaggaggaagatgtggctaggcgaattccctctggtacaaaatctcaagaatcgcctttaaacaagaagccgacttctcttcacagccgtaacttgtcacttccaataggaaagttcaccaatcctaatattccttctacaatgacatccatactaagtttcaatagagaccaacagcagccgctatctcaaccactgcctcctcctccacaacagcaacaggatctccacacgcacaatttacatactataccaaggaaacctggaatggttcaaaaaaagcataggcgtgcaagatccacatcctcctttggagtgatcgatttaagtattatcgatgaagcaaaagaaaaacaagtacagagatcaccatcccctatacattctaacgtgtccgtagcacttacctcacatgacaaaccaattgaatccaatatgaaggaacaaccaaatatgctgcaatcggttcgtgaaggacgtcaagtacacgatgacttggatgacagaacatgcagtgaaagcagtagtagaaacgaaagccccgtaagaaccatcacaaaggataattctgtaggcaagattttaaatagtacttgagtgatcattattttctttttgatgttccccctacgtatgtatacacccatatattatatagatacccgccgcataccaacataaaaaaggtaacaaatatttgagatatagagcatcgctacattatgggcaagatgcgtctttgtgagacgattttaaacagaagttgttcatctctcagtgatcaatacctatcaacatgtcaaattcatcagtggaaaaatttaaaatttcgaatacctgatccttcttgttcggatacaaatgaatcaacagtttcctgaagatattataaaatagcgacaacttcttgaaacattcatcgcatatttcatcagctatcattggtgacgttaatttaaatagtaaattaccttgaacatctgttaacgcctgaggtagataatagttcaacttatcatgcacattttttctgaccatgtctaattccatcaatgaattatccctcagggctaagtacatatcataatccaattcatcctttactgagtccacaggaaaaatcatattgaccaaattgctgtaaaggtctaaacctgtattctcaaataggaattttatttgtaaagttagcatttgcttagtatattccttcagtttatcacaaacccagatggtgattttccggctgtcatcatcttgtgcaaacaatccctcaaaaggttgaagtctagatttaattaaatcgaaacagtttatctctatagttagcaatgatgccttttctttttcattttttttcgccaaaggaaaagatgtttgcaattgttttaacagaacatcttttattggttgttctacaattgtttgtaaattcttagatgagagcaatttattatcttctgattcctcatcttcggcagcatgtgtcttttcataaatttcaaataactctaccaatttattcatatactctgatagccactctggtggcagtaaatcatctgaagaattttttgtttccgccatgactgtttgcttcatatagtcttcatagtatccaataattctgtttttggaaatgtcttccaacgactttaaattgttaataatagaactatcgtcctgaattccctttctctcgaacataactctgtaaagtttcagcagcctcacaatctcgaaattgatgatcggattttcttcaaacctcacgatttgctcgatacgaatacgacacgaattggatagcgactggatgatatcgttcagcaatttgttgtcgatgcctttcaagaatgtcttgttttgttgaagtatagaaattggggtatcttttaagtcttcatcctgaaagtcaaatagtgacttcacgaaatcagcttcatttgcgatgatggaatgaacggacgctagtacgtcaccaatatacctaattggatcgtgtgccgataatatgatgggtttagaggtagttgaattcatatcgaattgagacaaaaactcatccagaatactcttggatctcagtgtggtcactcttttcaacaactcattaaataattctagatcacttgacaggaagaccagactcttccgaaaaatgtttaagctttcttgttcagtagtaccatggtcatttaataaatttgaagaggattcaaaactatataaaaaatcgatcaaataattgaagatttttttgtttgtcttttctaaaatttcattaactcccattatcaaagcatttccagcattcaaattaggaagcgtcagcaagaaacttgattcatctttaatattgattactttctttactacctcgaaaaagatgttgtctatagtaccattggtgattacatcgtcctctacctgattcaaagtaaacctatcccttatagataacagtattttttttttcagcttcaactgctctgcctttaaacggtattgatctatttcctgaagtaccacgttatttgttggaacctcatttgtctcattacttagtaatttttcgctcgttctttgtattttttcgacggaagaagataatcgtttaatccttctaatgataggtttgaattcctcaagtaccgtaatatgttcctttagcagttgagattccaaatcagtcctcaatgctcttcttgccaaagtacctacatattcaggattcatgagcttttgttcatcaagggacaatctctctttattctcttctagaacctttagggattttcttagttggactgtggcctgatagttaatcaatgtgtaattgttcaatatcttggatagtttattcgaaagaaccaaatttgtggtatttttgttggaaccacttgacggggatactaattttgataaatcaaggttttttggctcgtaattcgtgaaattttgagattcttgctgcgatagtttttcatcctgggaattttgccctaattgtttgcttggatttgaaagctgtattttatcaatggaagacattgcgtaatgtgtcattttcttatgtaggtctttcgaaccagcaccatcattatctactggcaaagttgcattattattggaataacgttgaaggtcgggcaacttaaactgtagatctagtttaccggtgggctgtgactgtgcatctgaggttaagtttagtcttggctcaggttctggtaattctggcgtggcagtatccgccattgcgtaggtctgatagtctacaacgaaatccattgtgagtaaacttcactggggattttgttacgataatgtacaatatacttcagatactacagctttcggatgaatatttactagaatgaattactaccttagatgtatattttgtatgaaagcgtcattacgccagttgtatgtattttgtcgtctgagacggcaggtgatatataagtaaaatggaagtataaacgaacagaaagcaatcattaacaatttacttatagatttcgactaacatacgcatcggtaggattagataccagtttttgaaatccaatttttccctcgtatatggaatgtgctgagagttttcctcagggatatgcgtatcaacaaaagagaggtggtaatacatgcaatcatatagcggtttgtttctttaatactatatgttgtcacttataatcctgttatattattgatctttaggtttcagctgatccttctaatatccctctattggtttcgtaattcgtgttatcctttaagaagatcctagcgacataatcatactatcaactgttatgttaccgtttggtgaacagttggctttttgctccggcatttttgattaaaaataggctcttgttaagctactggaatttttctatattaccaggctactcttgatatggcaccggaatgtaataggagttacaagaccatttcaagttaaagaaaaattactggaaaaagggtagtaacgtacgtggacgaaataaataagaaggacgtaaatttaatacaaatgcacaagtaaagttatcggctcctattcttcactaattccatgcatattaagaactgctggaataagaattgaccgttgcttattgactagtggccatgttactagtatacctatcacacacaatgtaagaaagtgacataagccatgagatacaatctcaaatctagtaaaagccgaaatacaagaactgatgatgtaacagagtaatgcataacaacgtgcaatgcaaaggaagaaataatagtgttattacgtaggacattgatttcctgtcatgactattatatcctcaatgagcgcatataatgcattctgtatattcaataataccaccttatcaaataacgaataccatcgattatcagtaaattcatgtatcactcgcgtaaattctgaaattcagcccactaggaagacgtttatatcagtttacttttgtacaagtgacttattgcaagcaatttgtacgaaatatgcttacacttttcattagtaaaagaaccaaccacccatcattaacatctttttattttttatccttatcgtgtaaaaaaaacttaagaatagacatcctggtgacgcatatcgacgaaagcacacaacagcgtcaaaaattgattaaaaggtaagttatcatgcccacacctatgacgcctgtcaaggtcggcgctttagcctgccagaggaactcatttctcttcgatgggttcaaaacactggttgtttcttgcgaaccaacgaagaataaaaagggagagattgaaggttatgagattgaactacaagatactattctgttccccgaaggtgggggccaaccaagtgattctggttttttgaaaattgttgaagggaatcgtaattcgtcgaaaattgagaagatattagtttcacacgtttctcgtttcggtttacatgcaaagcatcatgtcaatgactacattgagcccggaacaacagtggaagtggccgtggacgagcaaaagagaatggattatatgcaacaacatactggtcaacacttgttaagtgccattctggaacgcaactacaaagtagacactgtatcttggtcgatgggtggtatcatcacaaagaaaaaacctgttctagagcctagcgactatttcaattatatagagttgaacaggaaattgactctcgacgaaataacgaacgtatcagatgagattaatcagttgatcatcaactttcctcaggaaattattgtagaggaaagaatcggtgaagaaacagtagatgaagttagtacatccaaaattccagacgattacgacctctccaaaggtgttctacgtactatccacatcggtgacattgattctaacccatgttgtggtacacatttgaaatgtacctctcaaataggttccattttaattctttccaatcaatcagccgtaagaggttcaaactcaaggctctatttcatgtgtgggaagcgggtttctttgtatgcaaaatctgttaataaaattttactggattctaaaaacttattgagttgttcagaaactcaaatttctgagaagataacaaggcaaaccaaacaaattcaacaattaaataaaagagaacagtattggataaagagattagcacgtaccgcttctgaagaattaatgaacacactgaaagccagtggaaagaaaagggcttattttatggaagaagaatacggaacattggaactgttgctacagatccacaaggaagtatctaattttttgaaagatgatacagaaggttacgaaattatcctatgcggttatgaaagacaaacgaacactggctcactgctaattctttcggaatcgggtgaaaaaattgccaatttggctgctaacttaggttcgatactacaaaacctaaaaggcggtggtggtaagaaaggtggcaagtggcaaggtaaaattacatccatttcgaatgccgagtttgccgccctctctgattatttaagccatgatttcgcatcatgttgagaaatgtgccatttgtatacgcagatttgttgtatacataatggtaggtatttatcgtgatcaagtctcaggaagtcaataagcatggtctattcttttcttttatgtagtttataataggcaactttaatgttcccagaagacgcgttttccattacttattatacccaaaaaaaaaaattaaaaaaaaacaacttcgaacatgcaaacgcaaagcgaaggaaattataactttgacttctaacctattaaagaaatacaaacaaccggcaaggagccactgattaccaggtatttatgagtagtattgttaataaaagtggtacacgctttgcccctaaagtaaggcagcgtagagccgccactggaggaacaccaactccaaagccaagaacccctcaacttttcattcccgaaagtaaagaaatagaagaagataatagtgataacgataaaggtgttgatgaaaatgaaacggctattgttgagaaaccttcgctagttggagaacgctctttagaaggctttaccttaaccggcactaatggacatgataatgaaataggtgatgagggccccattgacgcctcgacccagaaccccaaagcagacgttatagaagataatgtgactctaaaaccggcacccttgcaaacccaccgagaccagaaggtaccgagatccagcagattagcttcactgagtaaggacaacgaaagtcgtccaagttttaaaccgtcatttctcgattcttccagtaacagtaatgggactgcgcgacgtttatctacaatctccaataagcttcctaaaaagataaggcttggaagcattacagaaaacgatatgaatctgaaaactttcaaaagacatagggttttgggcaaaccttcttcggctaagaaaccagcaggtgcacacagaatcagtattgtctccaaaatttctccacctacggcaatgaccgattctttggacaggaatgaattttcgtcagaaacttctacatcaagagaagctgatgagaatgaaaattatgtgattagcaaagtcaaagatatcccgaaaaaagtgagagatggggagtctgctaaatattttatcgatgaagagaattttacgatggcagagttgtgtaagccaaactttcctattggtcaaatatctgaaaactttgaaaaatctaaaatggcaaaaaaggcaaaattggaaaagagaaggcatcttagagaactcagaatgcgcgcacgacaagaatttaaaccactacactcattgactaaagaagaacaggaagaagaagaggagaagagaaaggaagaaagagataaactactcaacgctgacattcctgagtcagaccgcaaagcacatacggcgatccaactgaagcttaaccctgatggtactatggcaattgatgaagagactatggttgttgacagacacaaaaatgctagtatcgaaaatgaatataaagaaaaagttgatgaaaacccttttgccaatctttataattacgggtcgtatggtaggggttcatacacagacccgtggactgtggaagaaatgataaagttctacaaggcgctttctatgtgggggacagatttcaatttgatctcacaattatacccttatagatcaagaaaacaagtgaaggccaaattcgttaatgaggagaagaaacgtccaatattgattgaattggcccttcgatctaagctaccgcctaattttgatgagtattgctgcgaaatcaagaagaacattggtacagtagcagacttcaacgagaaactaatcgaattacaaaacgagcacaaacatcatatgaaggaaatcgaagaagcaaagaatacggcaaaggaggaagaccaaactgcacaaaggctaaatgatgctaatttgaataaaaagggatctggtggtattatgacaaatgatttgaaagtttatagaaaaacggaagttgttctgggtacaattgatgacttgaaaaggaagaaactcaaagaaaggaataatgatgacaatgaggataatgaaggaagtgaagaagagcctgagattgatcaataagagacatttatatgcatacataatggataaatagcacaactttttgttgtattatatcattttcttcaggtgtaccgcggcatcaataaatgaagcgatgttcggaagaaaaaattggcaacgaaaacagtattatgaaagttacatatgaggatcgttctataagcaaaagaaacaaaaggatgatatgattagtaaagagtatgaatttggtaagactagtatactgaatagaaagaagtatacattagttatcgatgaagacaagaatggcaattttataagatttaccgttttacctgtatctaaccgaaagttcaaaaaagtcaagcaaaatgggagggtagagattaacatgggcatacaatatcaccaaattgtacttattttactactgaatattttgttctatgtaatttgcctaagatcaagatttctcgaacatattaatagaacttttgaagtgacaatcgcgcgaagtttccagatcttaattataatgggattgtttgccttaggtacaattatacttgtgaggggacctagtgtggaaactgtaacaattttcaaagaaagtggactacagctgtccagagtgaagggtatggttatatttcctcaacaatggaatcggaagttctttgaacaagtagagtttatatccaatgaaagaattattgatgtagtgatcaatgaaggattctgtcggggatttcgagtgatattctatcttgcagcaattgtacgtaaatcgtctacgcttaagctattatttccagtatgtattcaagcgaatttaagattgtttcttacttcaacgatctgattagaaatactaacacaacaatgcagtcaaatttgcccagtatcgatgaccaacgtctaatatacaacatatctagaaaatatctcagtaagcaagaaaaacccctgagcagaccaaaagattgaacatcaaattatcattacagaaaatcttgagacattttggtatatacttatattttagtgtatgtttatatataattatagataagaatttgaacacacttaagttgcagaacaaaaaaaaggggaattgttttcattacatggtagataatttgttgatgatttcattcgtgaagtcagtagtagaagaggaaccaccaatatctctagtggtatgcttaccttctgcgatcgtttcatgaactgcctttgagattctagtagcatattcattcaaacccaaatggttcaacattaacgtggaggaaaggatcatggcagttgggttagccacattttggcctttaatatctaaaccaacatgtctggaacctggttcgaagacagcatagtccctgccaaagttggcacctgccaccaatcctggaccaccgatcaaagcagcgccaatgttgcctaagatggtaccgtacattgaaggggtaactaggacatcaaattgatgaggtttggccaccgcctgcatggaggcattgtcgacaatgatggacgatacgtcaatatcaggatattctttttggccaatttcagttattatatttctgaacagaccgtcacctaacttcatgatatttgccttatgcacagctgtgacagactttctgttgtatttcttggcgaagtcaaaggcaaatctggcgatcctttctgtcttaggtctagtcataactttcaaagattccactacaccagggacggattcatgttccaggcctgagaactcaccctccgtgttttctctaatgacaatcaaatctatgtctggaattctagtcttgacacccttcaaggatttgaaaagggccacattggcgtagatatctagttgtttacgcaaagcaacgtttagtgaaccgtgacctgtttggtcagcaggagtgtgccatagccccttaagaccaatcttatttctctttagagactcaacagcttcatagacgccttccttatgatctgtttgcttaatgtttatagtttcccagtcgatcgggatattttcagcctcaaaaatggttctcactgaatcagtgatttctttcccaacaccgtcaccaggtatcaaagtgacggtgaaacgaccgccatacttcttgggtagggtgcgttccgcctgagcggcagtggctaaagttctcttagcaattgttctgttaagcatttttctcttacaattatggaggaaaagggagaagaatgaggatagggagaataatgaaccttgattgttaccagtaatattaaggtactgttgaaatagatctacggtagagtaaagaaatcaatcaatcaagaataagccaatgaagcggaagaaaacaagaaaaaagacctatggaaaatatagatagtcctatgtgctcacccacataaaacacttatatatatattcagtgtaggcatgtattgtacggggatatatatatgagggtcttcctttaatcgctaaataacaataccgagctaccaaaaaaaataaaagaaggtttctgcaatatggttggttgatgagtgacctatgacgcccgatgctcggagaaggtggtcaggcacacgtgattcacctaaactcggcgccgaaaaaaatttgatcagccgtacagtgtgattgttatcacgtgatagtaacgtaagtcacgtgctttctaaccatcaccccgcacgaacgttcgttcccgtttcgatgttgacgtcagaatgagctaacttgacgccactgaattaattcgcattgtcaccatgacgcttatcaagccgaaaaaattactagtgattccttcctccccctctctcgatgagtaattttgaaatgaacaagtaggctgacatagagtactataaatacttaggaagtaatgattctcgaggataggtaagagctgtcctcttctaattcttgttcgttttcttctgaaaaccccaaccacatcaactacagctaagactacaaatttcaattattacacatcagaatgagcgctaccgaatcttcatctatattcacattgagtcacaactcaaacctacaagatatcttggccgccaatgccaaatgggcctcccagatgaacaacatacagccaactttgttcccagatcacaatgcgaagggccagtcccctcacactcttttcatcggctgctccgattcgcgttacaacgaaaactgtttaggtgtcttgcccggcgaagtgttcacttggaaaaatgttgctaacatatgtcactcagaggatttaactttgaaggccactttagagtttgccattatttgtctaaaagttaacaaagttattatttgtggccacactgattgtggtggtataaagacatgtttaactaaccaaagggaagccttaccaaaagttaactgttctcatctgtacaagtacttagacgatattgacaccatgtaccatgaagagtcacaaaatttgatccatttgaaaacgcaacgtgaaaaatctcattacctgtcgcactgtaacgtcaaaaggcagtttaataggattattgaaaaccctactgtgcaaactgctgtacaaaatggagaattacaggtatacggtctgctttacaacgtagaggacggtctactgcaaacagttagcacttacacaaaagttaccccaaaatagttttagcctcaccgatatacttatataatattcattgaaatagaaagacatttacaaagtagacggggatatttagccccactcatataaattatgcattataacttttataaaaaaaaagaaatcacacttaaataaatgtcttaattgcacattccatgttcagatatacactatcttaccttttgaataggaatgatggaaaaaaaattatgcttccaatcggatttgaaccgatgatctccacattactagtgtggcgccttaccaacttggccatagaagcccgttattacggtctgtgatccagcaaatgtcagatataacgaattgaagttgcttttcccatcaatgtttgtcaagttgaaacgctgtagcacacactaagcattaacgactatattacaagtaaagcatcaaatgattacttaaaagagtaatcgcaaactatattgaagttggcaaaggcacatgatccaaatggtaacgataacaacatatatgaaaagtagtgttctaggaaacttcgataggggagaaagtacgtaaaaaaaataattttgagttggattcgaagttccattaatatcttggataattaagtttgctgcgtgagagacaggcagattcggcttcacaggaataaactcctataatttaaaggaacttgttagtgttagcactataagtaagaaaaagtaaattctggcagtgttgcttttaatcgcaataatatttgatttacattcaaacagtttcatatacctctttgatagaacatatttgcatatgtgtttatttgttttttatttttttttgattacttcttttcaaaaactaaatgtgaacaaagaagaaaaaggagtataaaagaataaataatagcggtattacgtgtgttggaaaaagaatcatagatcgtcaatggactagtatttgtattaccagtattattataatatggatcgtaagaagataacataaaacatagaaacagttgtcaaatccttgcacaattctaacattcattatcctattacattatcaatccttgcatttcaactttccatcaaatttaatgatttgttttcaatctttatgtcttctttttacatcgcatatgatactgttggaacgagagtaattaatagtaacatgagttgctatggtaacaatctaatgcttacatcgtatattaatgtacaactcgtatacgtttaagtgtgattgcgcctattgcagaaggaatgttaaacgagaagctcagacaatactgaagctgtgttaaagatctattagttgaacatgatatggtaggtacatatatgaggaatatgagtcgtcacatcaatgtatagtaactaccggaatcactattatattggtcatgattaatatgaccaatcggcgtgtgttttatatacctctcttatttagtataagaagatcagtactcacttcttcattaatactaatttttaacctctaattatcaacagataccatgctagtattacaaataatactaaacagatgatgttagagtttcattctgaaaagaatgtggattttgatgtaattgttgggattccattttttataaggcaataatattaggtatgtagatatactagaagttctcctcgaggatttaggaatccataaaagggaatctgcaattctatacaattctataaatattattatcatcattttatatgttaatattcattgatcctattacattatcaatccttgcgtttcagcttccactaatttagatgactatttctcatcatttgcgtcatcttctaacaccgtatatgataatatactagtaacgtaaatactagttagtagatgatagttgatttttattccaacataccacccataatgtaatagatctaatgaatccatttgttagttaatagtttaaatgtttttatcggaagaggttttgtcatcacatcagcaatgttcttcttggtctcgatgtagtatacgtataaattattacctgatacttcatctctaagtctcattgcctttgtgccaaaaaatctgtttctaaatttctcttcatttgtagacttaattatactgatcgttgatctactatcagtaagtaagcctttaataattggtttcttgttaagttcttgcacaaggtgactgaggttattcaatagcggaatagcttcactgactgcgtgtatttctgcttctgtagttgaagtgcatgttaacgaagcctttgtcgactttcctccaatcacttttccgttgagtaggaaaatgttaccaatttgtgacttgtaatatggttggttaccatatgaagcatcgcttattgcgactagtttattatctggcttggtaggtttgtttttgtgccatattaattgtttatctctagtgtcccacatgaattgtattaactcatatgtcatgtctaaaacttgcctagaggggaatagtatatgttgagcaagtgtgttgatgtagtatagtaagtcaaatctaaatttatatccaacatatgaagctagaccaatcaacttttgcatttcatgtactttctctttgtattcatcttcatctatttctagttcatcctggtctatataatgacctggttgacctggagctctaagtttctttccttttgggttcaaaggtacgtttagtttgggtaatttttctgtcaaggatttttccatacctaatttcatgtacttgcttctttgatatttgatctctaatccaagtatgtcgtactgaatgtcgttatcactttcacccagatttattatctttgtatcgtattgtttcttgagtgttgttatgattttcttatttgcatttaagtctttgctgaataatatcatatcatcaacgaataagcaaattgttacttgactatttttaaatacgcatgaccatccgcgaacttcttgcatgtcgcaacaatttattaaatatgatttaatggtttcataccagtttgcaccactttgtttcaaaccatagagtgattttctcaaacgtagtaatttatcattcaaacctaaatgtggtggaggtcttatgtataattcttctttgatatcagcatataagtaagcagaggatatgtccagctgtgtgatataatagtcgttgtctaatgcgattgacagtgacgtcatcagtgcatagtgatgtacggtattggattgcatatcagaatcatatgtatcggggtgttgaatgtcgcctcttgcaacaaatctagctttgtgtgtaccatcacgtttcttgttaaatataaacattgagtttattacttttttaggatctatgtcatttctatcataatatttgtttgtatcccaagtgttcattttcaatagttggctaatttctttatgataagcttcaacatatctgtctttttctttgttgtctttattataagtaattgcttcatcatatcttaaggtcgttcgaactggtttgatcgatttcactccttttattgctgcaattaaatttatgcgtttcttcgatcttggtggttccagacttctcatattcttattattccatgtgtctcgggatacctcaatttcagtttcattatcttctaatgatcttttcttacttttggtagtagtcagaacattagaatcatccataccacccaaactggaattagtctgacgagagtgtatgtgtggaatatcttttgaaacatcagaagtgtccgtaggagattgatgggttaagtcaggaagtgggaggtcgtcaagaatagaatcagccgtaacattttttgaggatttgtcaggcattatattaggagtcgcatggtcagaagatcgatattctggcggatccgtatcaatggagggtgtattatcacatacagcctttgtttctatggagatgatgggagtagtggattcactgttggacgaacggtcatctattgagggcgtactatttgtagtcctgtatttgatatttgtatcactatttcgttgaatatatggttcctccgtaccacccaaacgtgtagttttgatgttttcaagtccataattaactctatcctgtgaggtcaaatcaatcatatcattgggactaccaggtcgcttttggtttcgtgcagtgaaggtagacgagtgtctaggtgaagtagtatctgattcaacggtaccaaccatttcggtactctctttattaatgatatggggtgtacgagatcgtatagtagatggaagaatattgtattcagatatgtcggcatcaacttcttttggtgcacgtactttttggactggttccttgtctaattgtaaagggtttattgattgggacgagaagtcgttcactagaggatcagagtttatttcaatctccgattgatagtcatgatcagattctgtattttgatcatatgactgctccgtttcattttgttcaataaaagattggttatgggctgttaaacgattgagatcatcatcaaaagtgagtgtatcgtagtcgaactggtccaatttcgtttgcttgttttgtaatataacgtaattggtagtatctactgtcttttttaatgatggaagatagataatatagccataagagtttcgtgacggatgtaaggcgtaacctggaatgccacgaggatgtattttcgagtcgggattatggttgttaactataaccggttgaccgaaaggtagtatagtagtaatgtccagtccagctaaacctgcatgttgtcttgcggatttatcgttttttggtgagactaatgaatttctgattatagtagaaaattcgactgctgagaaccatagatgatttggtagaccactgcaatgaagcagtgtgcgacaatcgtttaataaagtacgatttaatcgttcagcgacaccgtgtgctctagaatctgccgtggttgtatagcatgcagtaatacctctgttcgtaaagaacttatgaagagttttgttagtgtactcggagccacgatccatctggataactagaacgcgagcattgaattggttcttaataaatgctaatatcgatgtaaaaacattgaggatagattcttcacgacggtcgtgtaatgggtacacccattggaatctggttttctcatctgtaaacgatataaagtaagaaggtgcacttttcggtaagtgatgtacaggaccaaatatatcggtatgcaagtactgaaaaggctcatatgattcttggtactttagtcgtgatcctttgacatgtctatgtttcgtgcttttgccgattagacagtcaggacattgatatgtgctagcgttagaccattcaatatccgattccttcaaatatgtaactgcattcttcttaagagacttctgaatacttcggaagttagcatgtccaagcattcgatgtattaacggatatggatatttatttacgcttttgcttttgttgacgttgtttattgttagctttgaaatgtgcgaaggaattaggtattttttagataaccagtaaaagtctccatgtttgactatgggagctagtactgtaccatccgatctttctaaagtgtttctggtaaagcaggcagtaatattttgattagccagctcactcaaacttaatagatcataggctatgtttggtgtgtgtagtgcttttattgatgttttggtgccgttctgaaagttgaagtgaagattaccaatggcatttataggaatgtcttgtttttgagcatcgactatgtttatttcagaattgggtgttgcatggtgtaaataatgggctgatctgacaagcgtttgcgaagctcctgaatcaataagaaggtgatcaggtagttcgtcattcgagtctactgtgtgtgttggcttagattctttctgttgctggcctaagactaagttcgttgtcatcgcttaagtattgtgatgaaacggttgattcattaatgtgatcattgttcacccttgagaatttactagatgtagcaatattgtgagcttttgctgctcttggttttgaactatttgttctctgataattacgagttgtaacctttgtgttagtcgtgtttggagatgtgcgagaaacatttttgtattcgctgtgttgtttgtattgggacggtttatttagattcatgattttattttcgtcatatattaactgaatttcagcgaataattgggaaagtttcatgttcgttttggtacgatattgattacgtaggtatttgaagtcaccggatagacctttaagtattagttgacaggccaatctgtcgctaacattgatattgttttcttttagcctctgaatgatcgtactgactgtaatttcaaatgtatcagcagatgtacttccgtcgtactcaaggttggcaagagctatccaatcctttaattcttgattgttagtttgcattttggacacacttttacaaaggactgtaaggatgtcagcataattaatttctaaaatttgttttacccatgttggcaataaatgaaatggggcaaatgcttggaaggtattgtatatatacgcatgttcttcataagtcatttgtcttttgatttcaccctggtcatttggaatgatgtcaccgagattagagttcttcaaaaatctgatgtaaaatttaacccatgtagaaaagttttcttctgatgttaaagtgtgtggtggtaagacgttatttcccacctttgtcttagcttgaggtatttcagagtgttgattttttaaatcgattggatcaggtgaggaagtactcagtggtgggatataccgtggcaacggatagtgtgggtccggttgataatacgcaggtgacgtttgataatgtgaacacgtcatcatagatggttgttggtaatgtgcccagttagaggccatagctttgtttggggtcatcatgccgtgctgttggtactgtccattctgtggaggtggtactgaagcaggttgaggagagacatgatgatggttctctggaacagctgatgtcccaggtgttgtctcttgttgagaattaaccttagtggaatctctatcaaattccggtaaattggaagctgaaacggctaacggatcttgatttgatgggacttccttagaagtaaccgaagcataggcgctaccatgaagaaaaatgtggattttgatgtaattgttgggattccattttttataaggcaataatattaggtatgtagatatactagaagttctcctcgaggatttaggaatccataaaagggaatctgcaattctatacaattctataaatattattatcatcattttatatgttaatattcattgatcctattacattatcaatccttgcgtttcagcttccactaatttagatgactatttctcatcatttgcgtcatcttctaacaccgtatatgataatatactagtaacgtaaatactagttagtagatgatagttgatttttattccaacacattccaataccactgataagtacattctgcatgtctatttataaaaccttctttaagacaaatatgctatttatcctttgataacaatttcctgtgagacagaaatcaccataaaataatcgggcgtgtggtctagtggtatgattctcgctttgggcgacttcctgcctaaacaggaagacaaagcatgcgagaggccctgggttcaattcccagctcgcccctttatattttttcaccatcaacgtggtgtttcacttattccttttctagtattttttttccaccttatagaagcgtgcacgtttaatgctggagataaaaaaaaaaaatgcattaatactctatatagcagaaatatagttgttataacattgtaccaacaaaagaagccctatgaagataaactatgatctagaagtatcaacttgtttggaatgtatgcttcgttttttaagttatagagtagttctgccgaaatctcttgcagatgttaggcatctctttagatgtattgtctttatgaaactagtatggtttgaaacgacttttcatggaatgtttcttggctttcttgtgtttctccttccttggcctcgtggaaaccgattctttttgaataataagaggttcgtctaaattaatggaaccttctctgtcgtcatctcctaagacgttcatttttttagagtaatcccaaaaattttctggaatatctaacggcccctgtttgttttcccaaattttaacgcaaccatcttcaccacaggagtataacatgttgctatgttgtgctggtataaaaatatctctgacgacctcgtctccatgggcgtgtgggataacaataccgttttcagtatccaccttctcatctttaaatggtaggaggcacaactctccacaattttcttgggttttaccggttgcaatgagtccagggtaaatatctaccacgtagtcacagttccatatttctcttacatcaccaaagtccaagggttgtggctctttcaattcgtcagatttgtcgttcaattcgtgaattgcaaatgtttccatatgtgatagtgtaaatatcctctttggggacaaccatccacaggaatgtattgacgcataattaataacttggtgtaaagcgtcctcctcctcatcttgtttcaagtcataaatgttcgtgtaaccatcagttgaaccactgagcaaaatattgacgtcagaaggatgaaatttaatacaggtaacgtcatcatggtgagagtcaattaatgatctcaatggagtgtcccatttgcgaatatcatatatgtatacagcagcgtcaattccctgcaattcggtaccacaggccaatagaccatgacgagaatctaaggaaataaagggggagttggcctcgttttgaatttgagcaatgcggtcattcgtccttatatcgaaaactttcaccgcgtcgatagaggcgctactaactagatgaccagcagagaagtcgctaccgatgaccttcatatcattgattgcagtttcgctcgccttaatcttttgtactgatttaccagtactccagtctagcaaacgtatttcgccattacttaatccagttaaaagaccatgtttataactaggctgtaacttaagacaccaattttctgacccgaaagaattcgattcaactaaagaataactagccatgctctagaagttaatttgagattctcgaacttaagtagtttttatttacacagtaagacgagccagtgcctatgtcctaatgactgcgtacgtgcactgtagtcccatctaacatttttacaatctggactaagaaaacttttataaatcacattgccaatgcaaaaaaaaagaatggtctctagcgggatcgaaccgctgatccccgcgttattagcacggtgccttaaccaactgggccaagagaccactgttatctgttttccaccgtccctccacactaccaaaccaacgtcactactgtgtgccagcaccaccgctcattatccctgtgccacaaaactcaacttacactgtcattcgaatttccggcaaactccgactgagaaatgttcgtactacttcctttctagggcacattgaggaaaaactcattgaatgcaccctttacaaatcttaatatctctgacgtttgtattgtattaaccaagcaaccctccctgtgcaagtagaagccctggatcctttgtggtcgtaaaatgaacaaataccaataagacgaaaacaaaaacaaaaacaaaacgacatagcaacaatgcggaattatttaaggctggcactctttccgcatgtttatcacaattatttccactttcacttaaaaccttgtttaagcttggcctacaccacaggaaaaaaaaccatccgatctaatcttcaaatatcaatttgaggttgaaaaaatttgctaaagcgttggtctaattttgtttttcgcccacataatgtctacatctttccaggagttcaaggccttttgcaacaaggttgggctagactttcaatggcttaatttgcaatcctccaagtctgttcccgaaagcggttcctctgaaggtttctcagccgtcagtgataccgtacaagaaaacatcagaccagctacggaaccacttaacgtcaaccagtccaaagatcctgtcagcaactttttttatgatgtcaagaatgctccgctctggaacgtgtataagaggaatcattccggtcattcttctactgaggcttgctctggagtaagttcagggcaagcgtcaaaaaacatacccgaggcaatggtaaaagagacagtcctttctaatcacgacaatgtcaccataataaacgaattactgccaacgtcttctgccatgcaccaggaagaaagcaccgctatgacaacctcctacctcttatcccactccgtaaatgatagttgcaacgtaatgctttcttcctcctcccacaaccgtgctatgctcccaccttctcttgtgcaaagaaataacgctaccacatctcccacaacagactctgcgtcagaaaacaacgaatcggtaccctcactaacctcatctgttagcacatcctcatcagtttattcgtcatggaatcctcctcattctccccacatatcgtcatttccagacggcaatttcgcatcgcttaacgcagaagtgacttgctttgatttccgccgcaccaaggactccagaacaaaagagacgaatgaatctatcattccaactgaaatttactgcccaataaattccactgatcaccacaaacattatccaagccaaaaatctaaacaagatgcctgcgctcctgctccccgcaatcaaaatataagctgcagcgtcgggtccgcagcggaattttcccagtctaaccacacgttgactactgtagttccttcatacatgcaacagtaccttgacaggccacagaactggtttgaaagcaaaatgggaaaatactgtccactctttctgagaagtacaaagaacattgactacgattccctcgaatttaaatttgagcgcaagatgatagctgttcaatacctgcttttagacgaacaatctgagcccagaaggtactacaatccctcaaataaaagtattccattctggaagagacccttcaacttcgatacaatgcccagctacgaccaacttatggaggaagcagagtgccgtttttattcataccaatacaaatacgaaggtttccagaggattgagccctactccattttttgtccctggaaaaacacacaaagagaaatagatctggttcttgatcacattcatttttctctcgatgtcggcgagaagaagtctttaaaccgaaaaggaaacatcactctcgatactttagacagtaaggtcgatcctaacattcagatcaagccgtatcagatttttccgtccaacaacctagtatacgaaggcttaccgcatcccgccgaacaatccttaattttgagtcctggcacctccctcattgagagggcgtttcaggcactgatagacatatgcaaggaatctattccaccttctaatgactgtactacccgcaaccataatagcgctcctcagcttaccgtgccagaaccatctaaaccatgccggctactacttgttcgtgagtctcgcacagcaacagaactagaaactaacaaaaagctctggctccactcacagagaaggaatatcgaagtgaccgtaccaatgcatccttctgagcatgggacaaaaagccggttacgaaaatggctctcaacttttgtacatcagtgaaccgtcagaagttccgatagttcgaactgtttggcacggctgacgaaatacttttaacgagcaagttagtctacacataacttcgtacttaccaccgttttcttctggcgcgcctcttcaagtagactaccacttccctcttgtaatagttgttatatatgttttcatagtctgatttaaattttacgcatattcatcaattaacccaatgcaccaaaaaggcgggaaagaagcagtaaagcaaaggcctttgccaagccttcttatcgacagaagcagcctcaaaaggttccttcgagagcggcgcgcgtatttattcacatcgcgaatcactggacccttaaaataaaggcgcctattcacgacatctgccacagaaacaactgttcagttatcctagcagcagtttttgcacaacggtataaacctgtacaaaactttagcaaggttttttaacaacaaaagtgcttgagggacacaacacaaactatagaacagacactgttttcctgacactgctttcctgacaagagactcgtttctgaattattttttttttcaagcatctttgtttcgctggaaccattgagtcttttcttccatttttaatctttattctgcctcctttcctaaacacaagttgatacaacgaggctgtcaatagcaagagcgtgcgcgagatcatgctttactccagagaatcaaggacaaccgtccttttccttgcgttggttacctccctaaccgtactttgtcactcggtcgatgtaacaactgtatttactacgtcaacaatcaccgaaatcacaactgtgactgccgcaccgcaaccacaaaacaaagcggaaaccgctttgaatactgctactaacataattcaaaccatgcagtttcttttcaactgcgcaccatttaagtggaagggtcctttgaaaataacttcttgtgcgctgaactttattgtcctactactcaccgcttggggctatcttctgaagtatctgcaggaaaataagctgaatagcgatgctgatatggaaaaaatggtaggactgggatttggggaaatggtcggcagaatcttcggaaagggtgtcgggaaagcttttactaaaatggatatcactcagaaactagtgtacccgttcgaaggaagcaaccggcagaaatgtctactcatgaccgtcggagaaaactcgatagtgccattccacgatttgtttacagagatatgctttgaccagtacactctggactcgctatcccaccacaaccatgggagtatttcgattttagatgctggatcagtgagcgccttggggttcgcggatatttcatcgaaaatgccctctgtaagcgaactatacacactttttggagattatacgatagaagtactgggcggcatcactaaactggcttcaactcttaacagagaggactggcagggggaaagaaacgggttcgcggttttatcgagagaccggcctaaccagacgttactaagcgtccatatgtactcttcaagcttgctatagatggagctgctcctggctgtacacaccatacaccaacttacccctacatgtacatagtatctgtcagtatttcactttaataggtattaataaaaatttcaatctgtgaacactcaaacctgtttcccagtaaaaatatacagcggcattgagtcttgcggctcgccaacttggaagcagccgggaatgatactactgcaatggctttttatagtacatatcgactttgccagctacataagggaaaaattaatgtctaaaaaaagcgcttacatccttcttgcaattgcaagatttggaacgcacagtacgtacgctgcgctacgggatgagtatttattgatctgtaagcgtttgattattagactatgctatcaatatttttgatgacgcgggtaaaaaatagcagacaattcccgccagatggaaaaaaagctgggctttaattcaaggaatggaaataaaaataattttgcgtgagttaacttgagagacaagagaaggaaatacttaataatgatactgggaaagaagattcaattgaagacagtaactaaataatactttctaatttttgaatttgctacagttcggctttttatctactctcttctggatcaatttttctttttcatctaaagtttaaaaggagatgggtttatatcaagcaaagaatgatgagggaagtgatccgaaaagcagcagcaagattgacgatttgatagaaaatgaggcagaaatcatacgactaatcaaggaagatggcaagttactgatagacaatggcgatggtagagatatccataacataattcaagaagacaagctcctcagtgtagaatttaacgaagtactaaagcgatttcacggggaagaaaagtcagatattcctcggaaggagtttgatgaagacgaggatgacggatatgattctaatgagcaccatcaaaagactatagaagtaatgaacacactaaatcacgtcattaataaagaggtgattcctcccgaaaactttagccacgtcgttggggagatataccgtagcagtttcccacgacaagagaacttttcgtttttgcatgaaagactaaagttgaaatccatcttggtactaattccggaagaatatccgcaggaaaatctaaattttttgaagttaacgggtataaaattatatcaagttggaatgagcggtaataaggagccatttgttaatataccgtctcatctactgacaaaggcactagaaatcgtgttgaatcctgcgaatcaaccgatactgatacattgtaatagaggcaaacatagaacggggtgtttgattggttgtataagaaaactacaaaattggtcgctaacgatgatttttgatgagtacagacgtttcgcatttccgaaggccagggcgcttgatcagcagttcatcgagatgtatgacgatgacgaaattaagaggattgctagtaaaaacaactggttgcctctacaatggtaatatgtagacagtgattacctttacgtaactagtctcttcgaaaatgatgtttattgataattattatacatggtttcttgccggttataaaattacgtatactatctaagcatctaaaaattagccccgcaattatgtctgtaaacgataaattacagcatatataccctcctcatgtcgttaaaagcattgcgaatagatagatgaataatgtattaaaaaaggagatgtttgtatgatgtccccccagtctaaatgcatagaaaaaaaaaaattcccgctttatattcatgatctttcacctcttagtcttctggccaatttgatatccttcttttggatagtaacacgcttagcgtgaatagcagccagattagtgtcttcaaacaaagagactaagtatgcttcgacggattcttgcaaagcaccgatagcagaagattgaaatctcaagtcggtcttgaaatcttgagcgatttctctgaccaatctttggaaaggtaactttctgatcaacagttcagtagatttttggaatcttctaatttctctcaaggcaacagtacctggcttatatctgtgaggcttcttaacaccaccggtagatggggcggattttctggcagccttggaggctaattgttttcttggggctttaccaccagtggattttctagctgtttgtttagttctggccattgtggagtgtttgcttggatcctttagtaaaaggggaagaacagttggaagggccaaagtggaagtcacaaaacagtggtcctatataaaagaacaagaaaaagattatttatatacaactgcggtcacaagaagcaacgcgagagagcacaacacgctgttatcacgcaaactatgttttgacaccgagccatagccgtgattgtgcgtcacattgggcgataatgaacgctaaatgaccaactcccatccgtaggagccccttagggcgtgccaatagtttcacgcgcttaatgcgaagtgctcggaacggacaactgtggtcgtttggcaccgggaaagtggtactagaccgagagtttcgcatttgtatggcaggacgttctgggagcttcgcgtctcaagctttttcgggcgcgaaatgcagaccagaccagaacaaaacaactgacaagaaggcgtttaatttaatatgttgttcactcgcgcctgggctgttgttattcggctagatacatacgtgtttgtgcgtatgtagttatatcatatataagtatattaggatgaggcggtgaaagagattttttttttttcgcttaatttattcttttctctatcttttttcctacatcttgttcaaaagagtagcaaaaacaacaatcaatacaataaaataatgtccggtagaggtaaaggtggtaaaggtctaggaaaaggtggtgccaagcgtcacagaaagattctaagagataacattcaaggtatcactaagccagctatcagaagattagctagaagaggtggtgtcaagcgtatttctggtttgatctacgaagaagtcagagccgtcttgaaatccttcttggaatccgtcatcagggactctgttacttacactgaacacgccaagagaaagactgttacttctttggatgttgtttatgctttgaagagacaaggtagaaccttatatggtttcggtggttaaacaatcggtggttaaacaatcggtgtttgaaattattttcatgcctttcaaaaaataaaataacgatcattctattgggaatataatagaaccttatgtatgcatttttcggttttttattatttcatgtactatatatattaaaaataagtctcaataaaagaaactagtttccgaactgtcttagatagtcttcccttatgtgctcctccatttcattgccgttgagtgcttcgacgtggcgttcgtgtcccctctgttggttaagcagatttacccaaatatttacgcagaaacccatggaatcctcaatttcacgctttttcttgggacatctgcacctgcagccacacccaaattcccttccctcgtcgtaggccgcgtttttacgtttgaattttgagtcactggctaagtaggagaattcctcattccccatggcattatgtggacaatgctgtattgtggagtgtctatatccgatgtctctaaaatagtgtacatcgtccaaatccagagttagcgacaatccaatagagtgaacaggagcgtccccccatctttccttccaaaatccaccacttttctccaaatattgaaaaaaactgttgtaaatgtcattgtcgaacacgcttagccgcgcaatctcaaaattactccagaaatggcatagattgtactcttcattgaaaaatttgtcttctacgatatgcttcctagagcgagccttatgtatcaaattcattattccctctttgtcatcatttatctgttggaaatcatcaccctttttcaaaagctgctcgatggctatcttttcggatatcttagccttggcctgaaaatcatagttgatccagtcccgtaactccggatcatcggattcaaaaatgtcgtaatcctttgtaaatagtttccataatgacccaagcgtaacgcctttttgactgataaagcttttagtgtgtctaaacaaatttgggactgtccaatacaattcggggatgatgatcgtaaatccatatttcttattagttcggagcatctccaaaaagggatcgtaggtaatatcacagaaaaactcaacatcgggttccaatctccaataccattcgtacttctgtactagcgggtgcttgtaaaataatcctgaataaaaccggcacatcttatgatatgattctaagtttccgtaaagtatgcttctatcaccttgatcctcaattgcgttgtagaactcgaacgtatcctttacgtcactgggaaaattccaagatatctcatcgatagtgccaaattccaccagcgcgcccactgtaacatcacgtacttttgctttgaagtcctcttcaaacggctggtcatttaagaacacatatggatagtggaaccactgattgaaatgctcttctatactgttgatagtcttgataacatcttctagctccccgttccttgttagcatgacaaacgaggcattctgcttgatgtacgatggattcaacaaatagtcctgagtattcacacaattcgaataaaagggtctgtccctcttcgtcgcaagatccatcttggaaaacggaagaaaatttcccatagttccgtctacggatgcaggctcagatacaagtaccacatacatggttatgacgaaggcaatcaggatgcacgtcgccgtaagattgcaatggatacatcccagaaatgcatttatcgtccttcttattagcaacatctgctaccttatgacgatgtgccgtattgagacacatttattgatgacacctccattgaacaagactatttgtgcacggaagcactcatatctactacttcgcatttttttgaagaccctttctcgaatgcctgcccaaatttttcaattttcttggcatcatccacacaccgcatgcttaaagtgtactatccaaaaaatgagagaaaaagcaaatacctaaaagcaccccacctcttccatatcccacgtaatggcaattggcatatatgctcggcaagggaaattactggtcgtaatatagtgcaacatgcaacttgccaggcgcactatagtcacatcttattatgttagcagttgagctccagctttgactgcactttagcttagttgcaacttcgcccctctgttgggggctgaaaagtacatccgcgcatttaacaattgctaagctatcttgaataacattatactaattaatatctatagaagcagaatgtctactacgtcgaggaccctacccctgtatttgtgccttgcatgagcgagctatatatcagcgatacgtttttttgttttcctttcgaccttcttgcctaccctctcacttttcccacctgaattttttttatcatattagtccgatattgagtttataaaccttgtgaagtgctagataaagtacaatcaaaagagcaggcaatagccatcacagcagtttagtacgattatacactctgaacgcgagtaaaactaggttgtatttttagtctcgattggaagtttcgtcagacagtacaaggaagatgtcattcagcaacggaaatatggcttcctacatgactagtagtaatggagaggagcaaagtataaacaacaaaaacgatatagacgataacagcgcttacagacgtaataatttcaggaatagtagcaattcaggatcacatacgttccaattatcggacttggacttagatgtggatatgaggatggattccgccaattcatcggagaaaatatcaaagaacctttcctctggcatcccggactcatttgattctaacgtgaacagcttgctgtctccgtcaagcggttcttattctgcagatttgaattaccaaagtctatacaaaccagatcttccacagcaacagttacaacagcaacagttacaacagcaacagcaacagcaacagcaacaacaacagcaacagcagaagcaaacaccaactttaaaagtcgaacaatctgatacatttcagtgggacgatatcttaacacctgctgataatcaacatcggccatccctcacaaaccagtttttatctccaagatctaattacgatggtaccactaggagctcgggcattgactccaattatagcgatacagaatcaaactatcatacgccttatttgtatccacaggacttagtttcttcacctgcgatgtctcacttaaccgcgaataacgatgattttgacgatcttttgagcgtcgcatctatgaactcaaattatttactgcccgtaaattcacatggttataaacatatttcaaaccttgatgagttggatgacttgctatctttaacatattcagacaataaccttttatcagcatcaaacaacagtgatttcaacaacagtaataacggaattattaataccgctgacactcaaaacagtaccattgccattaataaaagtaaagtcggtactaaccaaaagatgttattgactattccaacttcttccacaccttctccttccactcatgctgccccggtaacacccatcatttctatacaggaattcaatgagggacacttcccagttaaaaacgaagatgacggaacgttacaactaaaagttcgggataacgaaagttatagcgctactaacaataacaatctacttcgtccagatgataatgattacaacaacgaagctctcagtgatattgaccgctccttcgaagatatcattaacggtcgaaaattgaaacttaaaaaatcaagaagaagatcttctcaaacttccaataatagtttcactagcaggagatcctcgagatcaagaagcatatctcccgatgaaaaagctaaatctataagtgcaaatagggaaaagttattggagatggcagatcttttaccatccagtgaaaatgacaataatcgggagcgctatgacaatgatagcaaaactagctataacaccattaacagtagcaattttaatgaggataataataataacaatttgttaacaagtaaaccaaaaattgaatcgggcattgtcaatattaaaaatgaactagatgacactagcaaagatcttggcatacttctagacatagatagcttgggccaatttgagcagaaagttggtttcaaaaatgatgataatcacgaaaataacgataatggcacattttctgttaagaaaaatgacaatctagaaaaactagacagtgtaacaaataataggaaaaatcctgcgaattttgcttgtgatgtatgtggtaagaagtttacaagaccttataacttaaagtcacacttaagaacgcatacaaatgaaaggccatttatttgttctatttgtggtaaggcgtttgcacgtcaacatgatagaaagagacacgaagatttgcatacaggtaagaaaaggtatgtatgcggtggtaagctgaaggacggtaaaccctggggttgtggcaaaaagtttgcaagaagtgatgctcttggtaggcattttaaaactgaaagtggtagaagatgcatcactcccttgtacgaagaagccagacaggagaaatcgggacaagagagttaattatttttgtttttttaagctttgaataggaattttttttttctatataataaatatgtaatttcataatgacagtgtagaaattatggctaatctaatccatgcaaaggtattatttggttattgtttttgtaatgaaatagtataaaacagtgatattcttacggattaatagtttttacgcccgtctgaattttctaagctgccgaaaataatggcaagtaacaaaaagttattgtatgaggatgcgttttacgtggcaaaagttttgatgccaaatagacaaaagtagctcaattcaacatgacctcatcatctggtgttgataatgagatttccttagacagcccgatgccaattttcaatgagagttctactttaaagccaattagggttgcgggtgtagtaacaacagggacagatcatatcgaccctagcgtactacaggcatacttagatgatactattatgaaatccattactttggggcagctagtgaaaaatgcggatgtgttaaataagagattgtgccaacaccacattgccttgaacgccaaacagtcgtttcacttccaaggcaatacatatatctccgatgaaaaagaaacacatgatgtggtgcctttgatggaagttgtttcacaattagatatattacctcctaaaacgtttacagcgaagacagggacaaattttgggaacgataatgatgcagaggcttacttacaatttgaaaaactaatagataaaaaatacttaaagttacctactagagtcaatctcgaaattttgagaggtacaaaaatacactcctcctttctattcaattcttactcttctctttctccccaatcaattctaaacttgaaagtttttagtcaattttataattggaacacaaataaaggattagatattgggcaaagaggagcaagactatctttgaggtacgagccactgttcttacataaactattacacaatccgcattctaatgaaagtcccacgttatttcatgagtggtttttagagacctgctggagatccactaagatatgttcacaaggcactagtgcgccctatatgtattcaggtacaatgttatctcaagcaggcgatcagttaaggacaattttgggtcatacattcgtgctggacaagagagatcatattatgtgccctactaagggttcgatgttgaagtggagtaatgaactttcgcctggaaagcatttaaagacccaattagaattgaacagtgtaaaaagttggatgaatgacgactttattactttttctactaccattaaaacaggatatctaaagaacttatcctcacaacaatccttgcctgtacatatatgtgataagtttcagagtggtgggcccagcgacattcgggggtttcaaacatttgggttaggccccagagatttatatgatgcagtaggtggtgatgcttttgtttcctatggtcttagcgtattttctcgattgccctggaaaaaagttgaaaagtcaaactttaggttacattggttttttaatgggggtaaattggttaatcatgacaatacgtcgttgggtaattgcataggacagctttcaaaggaacactccacatccacaggtattggtcttgtactaaggcacccaatggcaagattcgagctaaactttactttgcctattaccgctcacgaaaatgatttgataagaaaaggattccagtttggtcttggtctggcatttttataagaatacattccttttaatgtcaaggtgaagctatcgcctagcttcccattcaatatttttcatatgttatatagcaacatattctataaaagcctcactaatagctgtgctgcacgtatggtaattaattcctgattcagagaactcagaaatccaatacgtttgccttaaaatggaggagcaactttttctgtgctaaaagttgccgctcatgtattgaaggcataataaaagaaaccaaataatttgtagaacaaaatggcagataattgtgctagaagataaatacttatatatcgcaccatcgttattttgagttttcttttagtagttcgtgtgattgcagcaatgcgatctttatcctcaacctcatttcacacaaaatcaagactatgatgctgttcaattttactagtccgtgtccacttatatatatgcaaaagtattatcaaacactttagaaaaggaagaaaatgtttttgaaataagccaacatgttctagtattttaacttggggggcgtttaatatttctgttagtttatcaatttggcctgccataagaatttctgacaaaggttttgtggttgcacatactctgaaaaatggggaagtttgagccacggttcacccatcttgaatgtgtgttataagtgggctactgcagtagaccaaattgaaaggattttttgaacactggagaaaaaaacactaggttcgattctttaaatttaatacatgtcaaggtccgacccagctttccacctcaatatcaaagcaatttttaattatgcattataacggtacctattctcaatatgtcttgacgttccaatatcatgttaaacaaaggtagtcaaggacgaaacatttccaaaacggatcatcaccaccataatgattgaatttacaggcttaacggtttttaaatttattcttcgcatgattaaattgcagatgctggtctaagatacaaagtatgtagcagaaactttatccattgttcgtggtacttgtcccaatgatcgtataatgtaatttgctcttgaatcgtatccataacctcctcaagatctacaagagattctgccataaaacgattaaaagctatttgaacaggagaactagaatttttaggatctctgatggcttcagaagccgcagatgctaacgatgatcctttggttggtttcccatgaatggaaatcgtaatgaataaacatgcaacagcgataatatgaggagggtaaagcaaatgaacatcatttatataactgtcgttgattaaggaccaacagttttgtagatcatctgacgatagtgttatttgaaatggcggttgctttaagacttgaacaatttgctttaaggattgataagggtggtggacaattaagtaactttccaattcttctagtaagtagaactcaaactcagtaactttagtagggtcaggaggaataaattcgggccataaggtacgggcttcacttaccaaagttctgatatattgcgggcattcttcaactttgcatgctaaatatacacacgtagtaaccagcatatataggtttatttctctaactgaagcctttattaaaaaccttgatagataaatatgtgctgtagccagtgcatactgtcttatatttagtctccttccaagcttcattatcaggaaatagcagtagatccttagattataatctttatcatagtgtaagtctcggtgagttattggtatattctttgtgatggattgttcgatgccgttttgcttcgaatccattacaatattcaaaccttgaggaaacagctggcactccaatagccataacttctgcctctctttagccaatgatgccttggtatattgccaatgatgcctttgtgtagatgtccagaagctccccgacatgtctaacttttgagattcagatgccttatcgctcttcaactaaagtttgagagggcattttttgttcgaacaatatgagtgctaacaaggttgctaccacatcaatgaactctactcctgtatgaaccctaattttccttcatgaaaaatgaattttcgatgtttttccgtggattttatattttttcaaatatataaaggagtaagaaaataactttgtttatcctatgttgcggtaaagaactaaatagtggtcttcacctgttttctaatttcttctcgtttaaagttcttcaatccatgaccaaagaatcgtcacaaatcgaagcttacaaaatggagtaaaattttttttactcagtaatatgctttgggttgaaagtctcccaccaattcgtatgcggaaaacgtaatgagatttaaaaattttaaattgtttaaatcaactcattaaggaggatgcccttgggtattctgcttcttgacctggtacctctattgcagggtactggtgttttcttcggtactggattccgtttgtatggaatctaaaccatagttatgacgattgctctttcccgtgctggatcgagtaacccaatggagcttactattcttggtccatggattcacccctttttatttttttaacagtttgttgtttacactactttttagcagtgtaaaacttttgcatagttaaatatgccgaactgatctaataaaaagtctgaataactcagatgagttatttattggtaaacttgtgtaagaagaagatggaatagtgaataattcatcaaatgatgaaataccaatgcaacagagtcaagctctgagtttcaaaaagaaacatggacgagattgcttttttattactgaccatgattattcattacttaccattgttcctcattctatataattgattgggcaccacgtaaattcttgagccttttcggtagtattcaatcgcaatatggggtagtttacggaagtgctgtaaatgatgtctaaaatgaacaactatgcgtccttattgtgacaatgaattcccttcttaaatctctatagaggtcgaatagatgaatactcaacacaaaacactataaaataaaaaaaaatacaaaagtgtttatatttttgctgtgcgtgctagctcatagcacccttacttgtacgctatcagacgatagaattaaagagacacttcgtctgaatccacttatactctttgttttaaaaggtactgcaccttctatgaccttgatttgcgtaactttaaatccatatgactaagtatcttccaatcagctgttaaattgactgatggccatcaaaatacatgctaaactaacatatggactggccctttcaccaacacgtgccattttccagaaggcccccaaaacctcatgatttttgtaacgatctaggagagacggccactgcccatgaacataagaacatgaacaaatcagtaacaatatcacttgcagaagagaacgaaaattaaataatgcagacatattctgtcgtggaaaaaggacgcaactttgcaaagtaaatcgatccggctctctagttattttgcaaacgatgtttaccgctgttctgtctttatccttgagttgtcgttgctcactctattgaagatcaaaatttcgctcaagaagagcagtcccaccatgcgtacaccacactacaaaaatgaatgttatatcgttttttcatgaattacaaatgtctatcgaaaagttcattactaaatataataagatcaggatcattaagagataaattcactgtgtcaggttacttcctgataagctgaaacaagtgggttctttccttaagataatgttcaaatttactaaaatctgtaatttcaagaacgtcaaaatttcttttaatcttgttgaaaaaatgtttatcagcttttcttctcttcttgtaagccatcaagattacaggtgggtttatgcagtgagtgagatcaagtagtgttttttctagtaatggaaaagcttcctcgagatacacacaatcagctgccaaaactagatcaacgttatttgcttgcatagcaccttcttgaggtgagaaatctgccgacagcggctcaccccaccaaagttccctcgcaagaacttcatactgaacttcgtccagttctatatttcttttcaatagtggtatcaacttgtcaatgtccgtaacatatactttagtgccatcgtggaatgtgtttttttccaacaaccccacgcacaatccaactaaacctgtaccactacccaattctaagacttttttaaattgtttcgtaccattgaccgtcttacttagcagatggtcaactgatttctcgagtatgtactcgcacaacagttcgccagcgatccagactttaccgccacaaccactttcaccgccatcttcacaaattttcaatgcaggcaataattttccaccgaaggaaaggtctgtttgaccgagatgctcctttggcctaggaacaactagatctccaaacccaccaaatatactctccatactcaatacctcactagtcgcgtttttataacgttctagggaaaattatgggccatttttttacatagagcctgctcatcataacttttgaattatttaaatacgaagaattactttcagtgtttgggtgtgagggacttttcgtttggtcaagccaaaaaagcttaagagaaaagaaaaatctcttctggttttacttgactaggtttccaaattataatatccgtattattaacgtgacactcagtattctccattcgtttacgggaacgttgatatgtaaacatatgcagatcctcgtattttagcaacgacagggagaaacaagaaatgagataggatgaaaaaaaataaaagttagatatttctatttaattagaattccgcgtaataaataatgacacgctattatagttcatgtattattatccattacaggactatcctcttgaattacgggcgtatccaaccttctttcaagttcttcttcagttgaacacaacgaaatggaatcggccaaaaatgcctctttggccataaaatcgaagtgtccaaccaaaagctccatgtcacgttcggtattcacggatgctgtttcgtaattttcaggatacactagtgctgttttgccatcatcaaggattaggtattgaggattcactactaacgtatgcttgagatgtggttcaaaaaatctccttagatcttcggcagtatttccagcaaccaaattttgaaccaaaaaaccatttttcttagccacctctactttaggttccgtatcttgaacctcgaagttgattagtttagctgtggtgcgagcttgaaattcttgtgctttcctttccttctgcaattgtttaaatgattcatatagtgggtaagcttctgctaatgataagactggtttattgcttgcgccattatcttctttcttaataaatacagatctcatgggctctctgtcctgagactcggaatataggccgtaagctttggctagttcacggatgaagtggcgttgaggaggcctcataggtttgaaatgcaagcttgaacgtgttttatcgtccattaatttattaagaatagcttcaatttgtgaacaccatctttcttgctttgaatatactgataatgctgcctctgtaaacggtaactgcagttcttcaaatgttgtagcaacagagaccagtttttttaacgcatctagttcattacttgtaaaattattggtttcttccttaattccaaatgcctccttcaattcctttagtcgtttcaaagcttcacattcttcattgcaatccagcacggaagattcagttacacttactctatcactttttgcgccacaagtaacactttttttgatccttccacatttacaataaattttcactagcgtggcacaaggtaaatcgggacactctgtcttaccatggcacggtttaggacattcatgattacaattgagccttttttgcccacaggtctgtttacacaccttttggcaatttcctggtaaatgacatgttttttggcaggtatgataacagtaagagagtggtatcccacattttattccacatgatacgtctgtttgaaaacaaaccgttctcactttagttttcttcccacatttacaaggtttaaatacggtttccgtacatggcgggcacgacacatccaaggaatgacaggtatgtggcattggtttatgaccacacgtagattcgccacgcacaactttaatacatggatgattacatgtaggtagcttcgtgccacaacgcacgggtgcaggaacaactgtattgccacatgggcagaccagatcgttcgaatcactctctaaacagggcggacactttcctgggtgacattttctctgacatttatgaattccacatgatagggtcaagttacacggttttaggcagatatgttttgcttccacaagagactcatccaacaaatcttgcgttctgaacaagtttttcttccttcttatcgccgatggcctaccactgcagcacctatcggtgcatctatgtctacggcatgacatcagggattcgcatttaatattgcagcgaggccttccttgaaatccacatggaactgaaaatgtactttgctcacaagcacattttacactatcaatttgcaagcagggttccatacaggctttatcatgacaagtgaaggggcacgaatgtttgccacattttagtggtttaccgcatcttgagtcgcaggttggtatcggatcatcacaatgcttacgaggcttagtcagttcctctagggctgtccggccacagggacaagttttcaaagagctaggcaaaaatgggcatgccttttctccattaattgtgggtgggcttatgcaagattctatgaatgaatgcttgcgacatgagtagtcgacaactctattatctgcacaggcaaacacgcctatccacctgttcccattttcatccttcgacgacttaccggacttgggaaactttgtttcactacactttatgttagcacgagtgtggttaccacagtagcattttatttgctttttcggactatctttactaattatcatttctggacatggcccacataagccagggtggcatttctttttacaggtgtggatggagcaagataaaggcaatccacatacttcttgacagttgaagttttttttcataactttagactggtaacaaaagatacttttcgaatgcttaccacagtggcacataatctcgaccattctagtacactctggatgcggccctagatgacaaattttggaacaaccatgcatacaagtagaagcattgcaggtttgtccacatgagttaggatccagcggattcggatcaggattaacaactttaccgcaccaacatgtgggccgattttttaccggaactcttttgctaacataatagcagtttggacatttccatattctatctacggttttttccgttgattttaacgcccattctcttatgcatccgtaatcaaacactctataacatctcttgcaagcaaacatttggcacgtataatccatctctactgtacaaatcatacaaacatatgagtcaccgctagaaatttcctggatcgcacgttcgtaatattgcatatcatcatcactttcctcttcatacgaactaggctgctcgttggcgtcttcaacactcgaaatacacccatcgcttaggttgtgatgtctataagtgtcaccgccgtcttgattttgctccaggcctaaagactcatgttcggtcatttgtaatgcctacgactgcaaatagattagagcagtctcgtctcacgctgtttcacttggttgttgccactgtcgcaagaaagaacttttatatttacgaccttttcacagagctcatcgataatttttataatagtatattacccgaaaatcttcctttatgtgcgggatgtatagattattgaaatgtcttttccgtagtactacagcaaaaatgcaataatacatatcagatatacacatatatacatgaatgttctgaaagtttaatctctttcaaaacagacagcaaagaaaccaataccaccgtcactttttggtagtgccctgatacaaccctcggcaagctgttgagggtcataggtgactccatctctaaaaacctcttcgaactcttctaccttgcctcttctaggccaagaaggaataacttctctttttggcgctactttccaaccccattctctaactgacttatctaaaagaaggtctatgacgactcgttcattttcttccgcatgaatggaacatgtgctgtatactatttttttagccgctgggaaactcattgcatgctttaccatctggaactgaaatgaactcagcttcgctaaccttgtctgtagttcttcctttgctataaactcctcttgctcatccggcacaatgccaccatcgtcatctttatcatcaattttccttctattaaatgagtcaaaaaacttacgaccaaatataccgctaccggagcagctcggatctacaataaaacaagtaacgtccttatatttttcaggagtagcgagctttgtaaaatcacctacattgacactgatgttgggagaacagccagctatcttgatcattttttgtaaaacttttgctctttcaggatccttctcgaaagcgtatattcgagtattattgtccttcggtggttcgggatatatataagaggccgtatgggtagtcttattacctggagcagagcaggaatctatcacaatatcacttggtcctggattcaaaatgtgggctggaaaacaagaagcacgatcttgaatgataatcttcccatgcttataaagctcatgtgctgtaattttgtcagacggatgaattccaaacaagtttggaataaactcatcataatagatagacccaggaactagttcagaccatttgtctacctttaaagtaaacttcttcctcaattcggctaacaccggctcagtctcaccatttggatggcattttaatggattgattctaatccatctaacaggaggaaggtcattggaaatatcctcgcttaataccaactcagatagctctcttactttcaatttgagtttcaatttgaccatttcgctatgcaatgggctcttaaacttcaaaacataatctttgatggggtgtttgcccatttgaattcttttctgcttagacaacagcaaatcatggcaaagcaataacaaagttagccttgaaaagagtggtttgccctttttcttgggtatatcttccaatatgtgtgcctttttcatcactttctccaaatatggtttatatttccaacacgaatcgagaactgcataaatatgttttggattacttttcagcttatatcttttacagcttttcagtaccagcgtctgcatagagccggaaatcctttcttttgcagcctccttctcaatatcttctagcacccatgttgcatccctgtagaaattcatgctttttcgtagctaacttctcagtgaaacacttggtgaagaaccagctcttctcttaacctcatcgaatattttaggccagttttttttttcctcacttgccattttcccgcaccgtttggaaatctcgaggaaaatgcttctttccaaaagtttaatcaggtcactaattaggtaaatagagctgggaggaagcatatacagtgtttcgtctgtggaaggaacttttatttttcttaaatgttttaatttttagtgacctaattcacataacaaaatattgagaaagggaaagttgagcactgtaatacgccgaacagattaagcatggattctgtaatggttaagaaagaagtactggaaaatccagaccatgatttaaaaagaaagctagaagagaacaaagaagaagagaatagcctctctactacttctaaaagtaaaaggcaggttattgttcccgtttgcatgccaaaaatccattattcaccgctgaaaactggtctttgctatgacgttagaatgaggtatcatgcaaagattttcacatcgtacttcgagtacattgatccacatccagaggacccaagaagaatatatcgtatttataaaatactagcagagaatggtctgattaacgaccccactttaagcggcgtggatgaccttggtgatttaatgctgaagatacctgtaagagccgcaacctccgaagaaatcttggaagttcatacaaaggaacatttagagtttattgaaagcacagaaaaaatgagccgagaagagttattaaaagagactgaaaaaggtgattccgtatatttcaataatgattcttacgcgagtgctaggctgccttgtggtggcgccattgaagcatgcaaggcggttgtcgaggggcgtgtaaaaaactctctagctgtcgtaagaccacctggccatcatgcagagcctcaagctgcgggtggtttttgtctcttcagtaatgttgctgttgctgccaagaatatcttaaagaactacccagaaagtgtaagaaggataatgattttagattgggatattcatcatggtaatggcacacaaaagtcattctatcaagacgatcaggtgctatatgtgtcattacacagatttgaaatgggtaaatactatcctgggaccatccaaggacaatatgatcaaactggtgagggtaagggtgaaggattcaattgtaatattacttggccggtcggcggtgttggtgatgcagaatatatgtgggcatttgaacaggtagttatgcctatggggagagaattcaagcctgacttggtgattatttcttcagggtttgatgccgcggatggtgatactatcggacaatgtcatgtcaccccaagttgttatggacacatgacacatatgttaaaatctctagctagaggtaatctttgtgtagttttggaaggtggatataacttggatgcgattgcaagaagcgctttgagtgtagcaaaagtactaataggggagcctcctgatgaactacctgatccattaagtgatcccaagcctgaggtcatagaaatgatagacaaagtaattcggttacagtccaagtattggaactgttttagaaggagacatgctaactccggttgtaattttaacgaacctattaacgactcgataatatctaaaaattttcctctgcagaaggctattcgtcaacaacagcaacactatttaagcgacgaatttaatttcgttactttaccgttagtaagcatggatttaccagataatacagtgctatgtactccaaacatttccgaatctaacactataattatagtcgttcatgatacttctgatatctgggcaaagagaaatgttatttcaggtacaattgacttatcctcatcagttatcattgataattctctagactttatcaaatggggacttgacaggaaatacggcatcattgatgtaaatatacctctaactctgtttgaacctgacaattactcaggaatgattacatcccaagaagttctaatatatttatgggataactacatcaagtattttccttctgttgccaaaattgcttttattggaataggagactcatactcaggtatcgtacatctgcttggtcacagggatactagggctgttactaaaacggtaattaatttcttgggagacaagcagttaaagccactagttcctctagtagatgaaacattgagtgaatggtacttcaaaaactcacttatattttcaaacaatagccaccaatgctggaaagaaaatgaaagcagaaaaccaagaaaaaaattcggtagagttttgagatgtgatacggacgggttaaacaatataattgaagaaagatttgaagaggctacagactttatactggattcgtttgaagaatggagtgatgaagaatgaggaaaaactggccattaataattttttttcggcaaccttcatgccttatgaaagttgaataataataaagttgttacaatgttcattgtataatccaatatatctaaaataggaaaaagaaatgaacaaatgcattaagctgtgttttactaagtattatgggaaaacgtatacattaaagtggatgcttacatatataacacattgtaataaaggttctttgaacatgttaccagcctcttcagagatcgatccggttctgttgagccaaatactcacttatccaaggataactttcgtcccgcgaggagcagtggttttggaggaggtttaggctttaaatgtgaaggcttaggtggtggggtaggttttgtttttttgtcttttgaaatcgggccacttgatttcagcattgttggcttatctatctcccctttctcatgcagcttgaccttggacattttcctagcgttgaatgactcctcagaagagttgagtttatcgatcatacgctgttgaatggagttcttcaaattctgcttagatacgtccaaatcttcataagatggtttgttaagatcgtctttggaattatcaatcgtattaacgaatgtcgacttaaaaggtgaattttcgtgtttcaaatttacctttgtagacgttggggtgaagctagtgcctggtaggcttgatgaagtaagagattcctttacggattggtttttttttatgttaccgcgtgtggaataagaacctagagatcgagttttctttaattcatctacgtctccagaataagattcatctgaagaggaagaagaatcttcgtactggggtattatgttttgtagtggaaagtctattgaattattctgcctaaaagtatgtgcttcagagacaattgcctgctttaacttggttgcggaatttgccttgagttcgttgtcattatttgaaacactactcgctagcggttcaacaagtggaggatccaatgcgtggtacatattctgtgatttgtcaaaaagtggttgagaacctttggcggaattactgaagctagcgtcatatgctatttgtgatggttttctattaggatgcatttgtgctgttgtagtattatcagccatgctgatttgaaatgtagcgttcggcatcgtattttccatggttgtgggagagttcaagcttagaatattttgtgttgccgaaagctgatgaagttcggtcaaattcaaatggctactgggcgcctgaaccacttgtatgtcatttattggacacggaacattttgcataattgatatcctcttcagtagttgataaacgttaggcctatggcgcggatcttgaaccaatatatcacgtattaagcctttcaactgttcactgtagttcggatacaatggaaattcaaactttccgcttaatatggcaagatcaccgcccttttcaaacggtgttgtgtaatagcaaagcttatatagaaaaatacccagcgcccatatatccgacttttcatctatcggcagaccgcgaaatgtatcaatcatctctggcgaccggtactgtgcagttgtgtttttcaaaatgtcttgctgaacatatgatagctcttgtgaattcctaggaggccttataataccgcatacagaaccaaagtcacaaagcttgtactcattattggctgagataagaacattttctatctttatatcacggtgaattaacggaggttgcaaagcatgcatagcggcaactccttgagtaacttggctcattatttgcaaaatttcaaattcatgaagcctgttttgtagccttgtgttcataaaatcaatgagaccacctctttcacaatattccattaagacgaatacttcatacgaaccattatgtaacattgccttagctgcatgagaatcaatgtaagatacaacatacctattgtttttcagcaacctcatagcatctacttcagctcttaaagtgtttagactaggtttgtctggaacaatgactctttttaagcatgcaacgcttgaattagaatgtgggtcaggtgggttgattaacgcggaatatacttgagcgaacccaccgcttgttagatatttaatgatctcaacctgatgtgacccaactgttaactgtgtacctacattgtaagtgccaatttgaggttgattcatgttgatttatctggttgcttaaaatacctaattatgcagagtaatatttctttctcagggaaagaagttggcaaagaaaatataggaccacgaaggagaaacaattagcacttttaggatgtttccttggcctattcttattttattatcatgaaaaaattattttttctgcacgttgatttaccaaaagaatagttaaatcaacaaggcttagaattcggaccctattgctgcgaggcgaaagagggctatgcataaacatgagttcgaaataacccgtaaatcataaacaaacctaaataagccgtggttagcggccttttttcgttattaccccaagataaatgtgcagctcttgtaagctcagcatacatacttgttgagtgtgtcaggaactgttttcaggaacccaaggttgaagtgttaaaattaagaagctggattgtgctctccatattaaatgaagcgtagttacaaatcgttggcatggagaagtttgcctcgtgtttacatttacaatactaaatagttgtactgaggtttgacgaatataagggagtaaggagcgcatcgtgtttctctcttcaagttaatactatggagaccttggccatttgaaagtactataaaaagccactgaagtagtatcattcccggctgcttccaagttggcgagccgcaagactcaatgccgctgtatatttttactgggaaacaggtttgagtgttcacagattgaaatttttattaagacctattaagtgaaatactgacagatactatgtacatgtaggggtaagttggtgtatggtgtgtacagccaggagcagctccatctatagcaagcttgaagagtacatatggacgcttagtaacgtctggttaggccggtctctcgataaaaccgcgaacccgtttctttccccctgccagtcctctctgttaagagttgaagccagtttagtgatgccgcccagtacttctatcgtataatctccaaaaagtgtgtatagttcgcttacagagggcattttcgatgaaatatccgcgaaccccaaggcgctcactgatccagcatctaaaatcgaaatactcccatggttgtggtgggatagcgagtccagagtgtactggtcaaagcatatctctgtagacaaatcgtggaatggcactatcgagttttctccgacggtcatgagtagacatttctgccggttgcttccttcgaacgggtacactagtttctgagtgatatccattttagtaaaagctttcccgacaccctttccgaagattctgccgaccatttccccaaatcccagtcctaccattttttccatatcagcatcgctattcagcttattttcctgcagatacttcagaagatagccccaagcggtgagtagtaggacaataaagttcagcgcacaagaagttattttcaaaggacccttccacttaaatggtgcgcagttgaaaagaaactgcatggtttgaattatgttagtagcagtattcaaagcggtttccgctttgttttgtggttgcggtgcggcagtcacagttgtgatttcggtgattgttgacgtagtaaatacagttgttacatcgaccgagtgacaaagtacggttagggaggtaaccaacgcaaggaaaaggacggttgtccttgattctctggagtaaagcataatctcgcgcacgctcttgctattgacagcctcgttgtatcaacttgtgtttaggaaaggaggcagaataaagattaaaaatggaagaaaagactcaatggttccagcgaaacaaagatgtttgaaaaaaaaaataattcagaaacgagtctcttgtcaggaaagcagtgtcaggaaaacagtgtctgttctatagtttgtgttgtgtccttcaagcacttttggtgttaaaaaaccttgctaaagttttgtacaggtttataccgttgtgcaaaaactgctgctaggataactgaacagttgtttctgtggcagatgttgtgaataggcgcctttattttaagggtccagtgatccgcgatgtgaataaatacgcgcgcctctctcgaaggaaccttctggggctgcttctgtcgataagaaagcttggcaaaggccttacttggcatttaagtaaagcctttgctttactgcttctttcccgcctttttggtgcattgggttaattgatgaatatgcgtaaaatttaaatcagactatgaaaacatatataacaactattacaagagaggtggtagtctacttgaagaggcgcgccagaagaaaacggtggtaagtacgaagttatgtgtagactaacttgcttgttaaaaagtatttggtcagccgtgccaaacagttcgaactatcagaacttctgacggttcactgatgtacaaaagttgagagccattttcgtaaccagctttttgtcccacgctcagaaggatgcattggtacggtcacttcgatattccttctttgtgagtggagccagagctttttattagtttttagttcagttgctgtgcgagactcacgaacaagtagcagccggcatggtttagatggttctggcacggtaagctgaggagcgctattattattgcgggtactacagtcattagaagatggaatggattccttgcatatgtctatcagtgcctgaaacgccctctcaatgagggaggtgtcaggactcaaaattaaggattgttcggcgggatgcggtaagccttcgtatactaggttgttggacggaaaaatctgatacggcttgatctgaatgttaggatcgaccttactgtctaaagtatcgagagtgatgtttccttttcggtttaaagacttcttctcgccgacatcgagagaaaaatgaatgtgatcaagaaccagatctatttctctttgtgtgtttttccagggacaagaaatggagtagggctcaatcctctggaaaccttcgtatttgtattggtatgaataaaaacggcactctgcttcctccataagttggtcgtagctgggcattgtatcgaagttgaagggtctcttccagaatggaatacttttatttgaagggttgtagtaccttctgggctcagattgttcgtctaaaagcaggtattgaacagctatcatcttgcgctcaaatttaaattcgagggaatcgtagtcaatgttctttgtacttctcagaaagagtggacagtattttcccattttgctttcaaaccagttctgtggcctgtcaaggtactgttgcatgtatgaaggaactacagtagtcaacgtgtggttagactgggaaaattccgctgtggacacgacgctgcagcttatattttgattgcagggagcaggagcgcaggcatcttgtttagattttcggcttggataatgtttgtggtgatcagtggaatttgttgggcagtaaatttcagttggaatgatagattcattcgtctcttttgttctggagtccttggtgcggcggaaatcaaagcaagtcacttctgcgttaagcgatgcgaaattgccgtctggaaatgacgatatgtgtggagaatgaggaggattccatgacgaataaactgatgaggatgtgctaacagatgaggttagtgagggtaccgattcgttgttttctgatgcagagtctgttgtgggagatgtggtagcgttatttctttgcacaagagaagatgggagcatagcacggttgtgggaggaggaagaaaacatcacgttgcaagtatcgtttacggagtgggataagaggtaggaggttgtcatagcggtgctttcttcctgatgcatggcagaagaagttggcagtaattcgtttattatggtgacattgtcgtgattagaaaggactgtctcttttaccattgcctcgggtatgttttttggcgcctgccttgaacttactccagaacaagcctcagcagaagaatgaccggaatgattcctcttatacacgttccagagtggagcattcttgacatcataaaaaaagttgctgacaggatctttggactggttgacgttaagtggttccgtagctggtctgatgttttcttgtacggtatcactgacggctgagaaaccttcagaggaaccgttttcgggaacagacttggaggattgcaaattaagccattgaaagtctagcccaaccttgttgcagaaggccttgaactcctggaaagatgtagacattatgtgggcgaaaaacaaaattagaccaacgctttagcaaattttttcaacctcaaattgatatttgaagattagatcggatggttttttttcctgtggtgtaggccaagcttaaacaaggttttaagtgaaagtggaaataattgtgataaacatgcggaaagagtgccagccttaaataattccgcattgttgctatgtcgttttgtttttgtttttgttttcgtcttattggtatttgttcattttacgaccacaaaggatccagggcttctacttgcacagggagggttgcttggttaatacaatgcaaaggtcagagatattaagatttgtgaagggtgcattcaatgagtttttcctttaatgtgccctagaaaggaagtagtacgaacatttctcagtcggagtttgccggaaattcgaatgacagtgtaagttgatttttgtggcacagagataatgagcggtggttctggcacacatttgtgacgttggtttgatagtgtggagggagggtgaaaaacagataacaatggtctcttggcccagttggttaaggcaccgtgctaataacgcggggatcagcggttcgatcccgctagagaccattctttttttacatttctcgcaatgtgatttattttgcttacccttcccactgccgttacaagggaggtgaacgaagaggcttgttagcataaggtttacgcgttgcggttgtaagcacaatgttcttactaaacctctgaagattaattatcctaacgtatactaattaattcaaagagaatatttactcgttctcttttcatcattttgtaacataattctttacgtattttcacttcgtacttttttcaactttttttgccttcgcttcttttttgttgtaatttttcaatttttttttttcatcgttggccgtctttccttgtccttcattttcctctcgtaataatcattcaactacggtaaagcatgcctttccttttttctactctgcagttattttcataatatctactgtttccatttcgtgctttaagttagagtttaatcttcccttctatcatcttaatagcaggttcataataagaagattaccacatctactctttgttcgattccaatgtctgaaaataacgaagaacaacatcaacaacaacaacaacagcaacctgttgccgtcgaaactccctcggcagttgaagctccagcatcagcagatccttcttctgaacagagcgtcgctgtcgaaggcaattctgaacaagctgaagacaatcagggtgaaaatgatccttccgtagttcctgctaatgctattaccggtggtagggaaacttccgatagagttttatatgttggtaacctagacaaagctatcaccgaagacattttaaagcaatatttccaagttggcggaccaattgctaacatcaaaatcatgatcgataagaataataagaacgtcaattacgcttttgttgaataccatcaatctcacgatgccaatattgccttacaaacattgaacggcaaacaaattgaaaacaacattgtcaaaatcaactgggccttccaatcccaacagagttcctccgatgatacatttaacttgtttgtcggtgatttgaatgttaatgttgatgacgaaactttaaggaatgccttcaaagacttcccatcctacttgagtggtcatgttatgtgggacatgcaaactggtagttcaagaggttacggttttgtttcctttacttctcaagatgatgcacaaaatgccatggacagcatgcaaggtcaagatttgaatggtagaccgctaagaatcaactgggctgctaagcgtgataacaataacaataataattatcaacagcgtcgtaactacggtaacaacaaccgtggtggtttccgtcaatataacagtaacaacaataacaacatgaatatggggatgaatatgaacatgaatatgaatatgaacaacagcaggggcatgccaccaagttcaatgggaatgccaattggcgccatgccattaccatctcaaggccaaccccaacaatcccagaccattggtttacctcctcaagtaaatcctcaagctgttgaccacatcattagaagtgccccaccaagagttactactgcctatatcggtaatattccgcactttgccactgaagctgatttaattccgttgttccagaacttcggttttattttagatttcaagcactatccagaaaagggctgttgcttcataaagtatgacactcatgaacaggccgctgtttgtattgttgccttggcaaacttcccatttcaaggcagaaacttgagaaccggttggggtaaggaaagatcaaattttatgccacagcagcagcaacagggcggtcagccacttataatgaatgaccaacaacaaccggttatgtctgagcaacaacagcaacagcagcaacagcagcaacaacaataaatattatgaagaaaagtggaatgaaacaaaaagaaagaataaagagaggcaacctacaaatcccaagataaaataaaaaaagaacgacaagaatccattcattatattatactatttttaaaaaaaaaattactacgaaaaagggagagaaaaagaagaagaaactcaatttactattgctcgaaaaataaaagggcctataaacttactctatttttttagtttttctgtgtcttatttccttccttcgtcactgtttaatttttaatactattattttcctttaaaatgtgaaagtcattgctaatagtgtgataaaaataaagaacgtattttctgaaggctttctttattatatttcctttttcctttcttaccctattttttttaaacatccatcccactgtattttgtcgagtccatatatataatttttgtttttattttttacaacttttgttaagtatataaaaatgctacctagcgttatggagacatgtcagtcttgagtccaggcacataaaggcaacagccactaccactgcgcacccgtgacgctgctccaacgttctcattaagtacggaactgtgtttcgaacaaaagaatggctgttaagaccaaaaaaaaggcagcttaacaggaacccggctggttccacaggacttttctttctttagggaaaggttgtgaaaatgacaaccaaaaagtcgcgacgccaaatatcaaaaacctagatgatattacttcgtctgccaaacacctcctttccctctatccagcccttattttttttccaagagcttcatatgcacgcccgaatcatttcgaatcgcgtacgtggcaggttgtggctggcatctttcccaaaaggaaacggaccaataccacgcatccccgagctcttggtctttctttatcttgcatagcccaaaaaataaaatggggcgggaaaaagggggcatatcagagcatcgggaacttctttcaatgcaatatatatggcacatataaaaaattctggcttcattatgttaggtgcagagattccgtttagaccaattgaacggtaaccagaaggtaatcttaaatatacaaacaaaaaacaaggtccataatgacaaagaatttcatcgtcactttgaaaaagaacactccagatgtggaagctaagaagttcttggattcagttcatcacgcaggtggctctattgtacacgaattcgacatcattaaagggtacaccatcaaggtaccagatgttctccacttgaacaagttgaaggaaaagcacaatgatgtcatcgagaacgtcgaagaagacaaagaagttcatacaaattgattcctgagataaacgcaaacacttttttactcggaaattttctctccccgattgtaaatttatttctcgtctactataataattcaccaaaaaacagcagagcacgtcctatatatatatatatatatatatatatatatacatatatatatacgaatatatttatgacagtctaaatcgttgctcctgttcaattttaacgctcttttataactgctgtggcgccatttctttggcatctaagatgtgtctcgggactttctttttctggtcatcttgctttccttgccttgtcattaacagagctaaactgtgttgaggaagtggtcttttaaattttcaaggtcgcggcccgtgcattgcgcggctggatgtcttttaggggagcgatgcgcttgcacaaaagaatagccttgatttccgctattaatgggtatattcttctaacaatttgagttttttctccacttgtttctttcttctttctcttttccattcacattttgctttacttttctggataatatatatgtgcatatatatatatccatttaaatatatatatatatatatcttttgtcctcctctccagttacttttgcgccagaaattccttcttcttttcaatctaatagagaagggtagatagtgtggtgcaaaaaaagagccttttaaaccaaaaataaataaaaaaaaggaatcacaaaatgtcagattcacaacaatcaatcaccgttctagaagagcttttccgaaagttggaaactgctacttcagaaacaagagagggtatttcttcggagctttcctcatttttaaacgggaacatcatcgagcatgacgttcccgaagttttttttgatgaatttcaaaaagctatccagagtaaacaaaaggcgctcaacacgctgggtgcggtggcttacatagcaaatgaaactaatctatcaccttctgttgaaccgtacatagttgcgacggtcccttctgtatgcagtaaagctggtagtaaagataatgatgttcaacttgcggcaacaaaggccctcaaagccatcgctagtgctgttaacccggttgccgttaaagcactcttacctcatttgattcattcgctggaaactagcaacaagtggaaagagaaggttgctgttctcgaagtaatctctgtattggtagatgccgctaaagaacagattgccttaagaatgccggaactaattcccgttctttcggaatccatgtgggacactaagaaaggagttaaggaggcggcaacgacaaccatcacaaaggcaactgaaactgttgataataaggatattgagagatttattccaaaattaatcgaatgtattgcaaatccaaatgaggtgcctgaaaccgttcatctcttgggtgcaactacttttgtagccgaagtaactccagcgactttgtctattatggttcctttattgagcagaggtttagccgagagagaaacctctataaaacgtaaagctgcggttattatcgataatatgtgtaaattggttgaagacccgcaagttgttgctccattcttaggtaaactactaccagggctaaagaacaattttgctactattgctgatcctgaagcgcgtgaagttacattaaaagctttaaaaaccctgagacgtgtgggtaatgtcggggaagatgatgtgttaccagaaatatcgcatgctggtgatgtttccacaacactgggcgtcatcaaggaattactggaacctgaaaaagtggccccaaggttcaccattgtggttgagtacatagccgcgattgccgcaaatctaattgatgaaaggatcattgatcagcaaacgtggtttacacatgttacaccttatatgactatatttttacatgagaaaactgcaaaggaaatactagacgatttcaggaaaagggcagtagataatattccagttggaccgaatttccaagacgaagaggatgagggtgaagatttgtgtaattgtgaattttccttggcatatggtgccaaaatattactaaacaagactcaattgaggttgaagcgaggtaggagatatggtctatgtggtcctaatggtgccggaaaatccactctaatgcgatccattgctaatggccaagttgacgggttccccactcaggatgaatgtcgcactgtttatgtggaacacgatatcgataatacacattcggacatgtccgttttagattttgtatattccggcaatgtaggaactaaggatgttattacctcgaaattaaaggagtttgggttcagcgatgaaatgatagaaatgccaattgcatccctatctggaggttggaaaatgaaattagctttggcgagggctgttctgaaggacgctgacattctactattggatgaaccaacaaatcatctagacactgttaatgtggagtggctggtaaattatttgaatacttgcggaattacatcggtgattgtctctcatgattctggttttctggataaggtttgtcaatacatcatacattatgagggtcttaaattaagaaagtacaagggtaatttatcagaatttgttcaaaaatgtcctacggcacaatcatactatgaattaggtgcctctgaccttgaatttcaattcccaactcctggttatctagaaggtgtcaaaacgaagcaaaaggcaattgttaaagtaagtaatatgacttttcaatatccagggacaactaaaccacaagtctcagatgttactttccagtgttctctatcctcaaggattgcagttatcggacctaatggggctggtaagtccactttaattaatgttcttactggtgaactgttaccaaccagcggtgaagtatatacacacgagaattgtcgtatagcgtatattaagcagcacgcttttgcacacattgaatcgcacttagacaaaactccatccgaatacattcaatggaggttccaaactggtgaggatagggaaacaatggatagagcaaataggcaaataaatgaaaatgacgcagaggccatgaataaaatatttaaaattgaagggaccccaagaagggttgcaggaatccattcaagaaggaaatttaaaaacacgtatgagtacgaatgttcgtttttgttaggtgagaacattggtatgaaatctgaaagatgggttccaatgatgtctgtcgacaatgcttggctaccaaggggcgaattgattgaatcccattctaaaatggttgctgaaattgatatgaaggaagctttggcttctggtcaattcagggctttaacaagaaaagagattgaattacattgcgccatgttggggttggattcagaattagtctcacattcaagaattagaggtttatcgggtgggcaaaaggttaaattggtactcgctgcctgcacgtggcaaagaccccatttgattgttttagatgaacctacgaattacttggacagagattcattgggtgctctttcaaaagcattaaaagcttttgaaggtggtgtcattattattacgcattcggcagaatttactaagaatctgactgacgaagtttgggcggttaaggatgggaaaatgacaccctctggccataattgggttgcaggacaaggtgctggcccaagaattgagaaaaaagaagaagagggtgataaatttgatgctatgggtaacaagattaatagtgggaagaaaaaaagcaaactctcttctgcagaattgagaaagaaaaagaaggagagaatgaagaagaaaaaagagatgggtgatgaatacgtttcttctgatgaagatttttaatttgaagtcgagtacatctctttcagtgagtaacttatatatttttgaagttaacatccttattctttttttatatttttattttttttatgtttattttctattactgattttcacaaagaaaggtaaaaaaaaacatacttcagcggctatacaaccatatttaagtaaatgcactcagagaaagtatacaagtaaaaaacctaagtaaagacataaatatcccaaaataatgcaaaaactcctctttgtcttttctgtgttattgacagtagtactagcaacagcaccatttcaggtacaatgtcctagctctccacttattagggaggccaaagtaagttaaactctttgccactttaacaaatatgggccaaaactaaccgaatataccaaaacttcgtattcctttgtttattagcatgaactctgtccagaagaaaccttgtatctgaagaaaaaaaaaattaaaacgaagaataaactgattcagtttttaaaatccttgacagaggcaaagtttagttcgaagttttataaacgcgtgttgaaagatcctccaaaaattgggattgctatatctggcggcgggtacagatccatgttagtaggtaccggatttatttcccaaatgaacgattatggcctttttgaatattcggattatattgctggattatcaggcggaagttggatcttgatggatttggtagttcaaaattttgaagtaaaatccctgctacaagagtgggaccttgaagaggatcttttattaggcataccggaattcgatatttccgaagaagaaattgttaccaatgcaaaaaaggagtataatgataatgatttgaagatgaagaagcgtcaggggggttctctgattacaagctcttcaaatttttatgaacaaatagaggagatcatgaattccatagaagaaatcccagaagactatatgataacgaagagaaacttgaatccattagcaagactaaaaaaaatattctttcctaacaacactttcactggaactgatgcgaagattgaaacctttaaaaaagtgctagacttttacaaaagtttgcatttgaaaattaagcctaaaaaaatggagggtttccaaatatcgttcaccgattattggggtaaagcaatcgttcaaagactaaaaaaaaatttcgatgacgatcccaaccattccttttcgttttcgaagcttgtaaactcgtctaaaaaatttaaggaatgcagtgtgccgatcccaatattcgttgcaaattgcaaaaatggacttctttcaaacgttatatttgaatttacgccctttgaatttggatcttgggaaaatatcctcagacttttcgtcaagttgccctatttgggctcaaaaattgtttctggaaaggccgagaagtgtattaataactttgatgatctaggttttattactgcgacgtcttcttcaatattcaacaatgtgctcatcttcatctggaatttggcttctcagtcctccagagaagcaatgaaagctttgaatatggttatgggaatttttggcctaggtaaagaggaaatatttagtatttcgaaagactcctcgagattagagacagactatgccgtatatcaacccaatcccttttatctttatcctgaaaaagacaatgtcctaactaacaaaaatcatttataccttgtagacggcggagaagacggcgagaatattccactcagaacattggtgattcctgaaagggaactagatgtaatttttgttctggattctagttcggatattgacaactatccaaacggctccaagttaaaaaggatattcgaaaaattagatgaagagaacgttcattaccaatttccgaacaatgtaaaaacattcactcaccccattgttataggatgcaatgctaccaaaagaactggacatgattcatttttgccaattataatttatcatgccaatgcgaatcatggaaacgcatctaatacgtcgacattcaaaataacttacaatcagtctgaagttagcagtatgttacccactggaaggggagtgtttagcaatgattatgacctttattataaaaattgcttaggctgtatattaaccaaaagaacaatggacaggctcccaagaaaaaagaaattttcgccattttgcttacaatgctttaaagactactgttactcataagagagtagactttttctgtgaaatttaatgagtttttgttcaccttttttacttttcttctatgccatatggttaaataaaacatggttcaaacgcgattcttttttattatctatgtctttattatgtagtcttcactataataaccgttaatgagcgacatagttgcatcagtttttaaggccaatttgattcagaaccttttcaagttcttcactttccatcttatccgaagacgcgatctggtggcatctaatactatgcttctcgaatatcgtttcatcaatttcaatttcaccattttttaggtaaacaatatcagtaataaaatcttgccattcaaagtcatcattctctgaatggacacccttagattgcctatagcctgctattgccctactcatagaatctatgatcatttgaacgtagtgtaaaccgtctaaaccaaaaacctctctatcatatttattatttatgagcaaaacttttttcgtattattagattccaaaattacttcagcaagattaccaagaataaggattgggagtaaacttgtcattaaagaaccgatagaataaacgaccatgtcagcttttttcaccttggaaatagctcttggatttcccattggttttatctcttcgccatatgggtttatatacaatatcctatgtaccggagcaggtagattctgtgattcatcaagcttgtcaaaatgcaactgggagtttttcagttctggaagaatatagataggattggcatactcctcttccgcttcttcttcctcatcgtcgaggagaattttcaaatggtcgtcataagagccaagtaaatgaataaatttagctgaatgtgctatgctattatctttaggaacagatttcgagggatgcgatatttgtgattggccagttatcatctcaccattcgtcaacaaagccgagatatgatgtgtgtgattggtatttatacatggaataacatgaactagaggactgcaccttcctatcctcatcattagttcaatagatgcgtctagagaacctaaaaacaatctagcaccagttaagaaaaaatttccaatggatgcactctcaaactgaaatggattcgagtgtttgatttttttcaagagttctgcttgcatatggataataaaagaacgacacatttccttaacttctatcgaaatatttttccatatgggatgcgaaccttccactatttcattccattctttcttagctaataacttatcattaggtagcctatggccaaacaactcgacaagctgttcatcttgaagtagtctcactattctagatctgatatcaccaattgctgggccaccaactattcgtagaatttcacttgtggacccgccattatctgatattggcaatatatacgtcagctcatgtccttttaagatagaaatattagaaaagcaaggagtcaatgaatttgtggcagtcccaccggagcacacaacgacgttcatctagtaaactatctcaccacactctgctattttgtccccttattacctcgagggaacaaaagattccgtttcctctctttcatagtccgcctaaatagcttaagaaataaacccaaacatcacacattagcgttctttaggaaatacgaaacaggttaatacaacagtagtaactttccacataatatctaagcattacacgctgaaaaaaactctttattggatatcaacaacccaacacattgtacgacatattcttttatcgttctactatggtaccctgttcaaatctctttttctaaaatgagcgaaattttcgaaaattatcgcataatttttcatcatcttaaattaaaaaaatacagtgtcctctattgtttatctcaacagaacgcacacattcttgaaacttgctcacataacataagctggagtgacatagcatttatatatatacaagggaaatggtcaaagctgttatttttaccgatttcgacggtaccgttactttggaagattctaacgattatctgaccgatactttaggtttcggtaaggaaaaaagattaaaggtcttcgaaggcgtgttagatgatactaagtcttttaggcaaggtttcatggaaatgctggaatccatccacacccctttccctgagtgtatcaagatcttagaaaagaaaattcgattggatcctggtttcaaggatacattcgaatgggctcaagaaaatgatgtccctgtcatcgttgtttccagcggaatgaaaccaattatcaaggttttattgaccagattagttggacaagagtctattcacaaaattgacattgtttccaatgaagtggaaatcgatgcacatgatcaatggaaaatcatctataaggatgaaagtcccttcggacatgacaaatccagaagtatcgatgcttataaaaagaaatttgaatctaccttgaaagcaggtgaacaaagacccgtttacttttactgtggtgacggtgtttctgatctaagtgctgcaaaagaatgtgatttgctatttgccaaaagaggtaaagatttggtcacttattgtaaaaaacaaaacgtcccattccatgaattcgataccttcaaagacatcttggctagcatgaaacaagttctggctggtgaaaagacagtcgctgaattgatggaaaattagtgcaagactcttacgaaatattaaagtttaataccgtgtaactgcctcttacatatgtatgcatatatacgtacgtactatatttttcttgtatatcttttttattgtctgagagaaagaacatcaaaaaataaaggaagatcctcctcggatttagcatgcttaatgccgaatctttaatacaaaacgaatgatatttcaagtatactaattagaaatcaatcaaacataccaaaagggacagtaaagagaaaagcaggagctctcttttaggggaaaagtaaaatgtgattagtatttcgttgcgtgtactagtcaactcttcttgtcattcttaaatttacattaattaccccaattttgcatcttcgtatataagagtgttccccttataagctttctcctgcacatacctgcagtaaacacaagcaacactttagagatagttgtccaagttaaaatgagtaaaattaaagttgttcatcccatcgtggaaatggacggtgatgagcagacaagagttatttggaaacttatcaaagaaaaattgatattgccatatttagatgtggatttaaaatactatgacctttcaatccaagagcgtgataggactaatgatcaagtaacaaaggattcttcttatgctaccctaaaatatggggttgctgtcaaatgtgccactataacacccgatgaggcaagaatgaaagaatttaaccttaaagaaatgtggaaatctccaaatggaacaatcagaaacatcctaggtggaactgtatttagagaacccatcattattccaaaaatacctcgtctagtccctcactgggagaaacctataattataggccgtcatgcttttggtgaccaatatagggctactgacatcaagattaaaaaagcaggcaaactaaggttacagtttagctcagatgacggtaaagaaaacatcgatttaaaggtttatgaatttcctaaaagtggtgggatcgcaatggcaatgtttaatacaaatgattccattaaagggttcgcaaaggcatccttcgaattagctctcaaaagaaaactaccgttattctttacaaccaaaaacactattctgaaaaattatgataatcagttcaaacaaattttcgataatttgttcgataaagaatataaggaaaagtttcaggctttaaaaataacgtacgagcatcgtttgattgatgatatggtagcacagatgctaaaatcaaagggcgggtttataatcgccatgaagaattatgatggcgatgtccagtctgacattgtggcacaaggatttgggtctcttggtttaatgacgtccatattgattacacctgatggtaaaacgtttgaaagcgaggctgcccatggtacggtgaccagacattttagaaaacatcaaagaggcgaagaaacatcaacaaattcaatagcctcaatatttgcctggacaagggcaattatacaaagaggaaaattagacaatacagatgatgttataaaatttggaaacttactagaaaaggctactttggacacagttcaagtgggcggaaaaatgaccaaggatttagcattgatgcttggaaagactaatagatcatcatatgtaaccacagaagagtttattgatgaagttgccaagaggcttcaaaacatgatgctcagctccaatgaagacaagaaaggtatgtgcaaactataaaccaatccgccattcatttgaaaagacaagtctggcctagggttatagtgttcagacttgaggttgaacatatccaaaaaaaaaaattcctatgatgtcttaaatacgtatacctaataaaataattctagactatattcaacttactgtaacccttcacctcactatcacagctgacgcatgtagcaaatcctttataacccagagatatcctacaatcatcgcataatgcaaggcatctacagggccaagttacaatatttcttttattaactttgcagattaggcaggagagatccatttcctccacttcgtcgcaactatcaaaggcaaaatcaaacttgaactctaatttgtcatcgtccttcatatttaaacgtttgtacatatacctggagtttgtatgatgcagaaggcgttcaataacaacatcgactagtacaccttgtgggtttcttttaccatattgtgatctagtcaacggtccattaaccttattatggacatccatttcataatttaaaatagaccacatggagatgttccaggctatttcctctaaatcatcagaatcgacagcattacttgataaatgtgttaattctttttcttcatcaataatcaactgactttccatatcactatcaaactcttcatctgaaacactttcatcgatttttctggggggaaagtagtcttttgatgaatcgtcttcaggaagcaataactccaggcttctgagatcactctcaatattaagctctttgacgtccggtttatataaaaactttttatagtttttttctgtaacatatttgtttaaatccctctttttacgctttcccactctcggtttcttatctatactgctctcaaaatttttactccacagaagattttttaggagtctagaatacgtcaaaataatggttcttactaattcaaaaaggcctaaatatgtcctcgcaaaacctggtaactgggaatcggtagtcatttccttacgagataacagatcctctggtgtcgactggagttggtttaaatgtccactaaccacataactattactgaaagcagcgacttcatcaacggattttacgttgtctgatttcttaaatattttatagtcattcgacgttaaaagtagacacaatgaaagagctatttcgttaaactcctcttctccattgtaattatttgatctccaccatttttccaagtttttatatcttgaatataatgatcggaacggattactggtgaacaaagccttcaggaaaatgcctatagacgccagtaatatggtggaaatatagaaaaagccagggaaataattgtgaatgagacagatgttaataaaatctaatccgttcaaataggtcctagtgacgaatgcggtaaaaaaacccgcgtttaatataacttctccacataatctataggctcttatatgaaacaattctaccaaatgaattactaatctgtgaaaaaccgctcctagtagttcaacattatcgccaatatgctgctgccccgcgggcattttggatatgatataaagattcaatgataaaccccatatggaaaaatcagagcatattaatgaaggaacgttcgtcgttgaagaaataaaaatttcaatgcagtcagacagagctacaaataaatagacacttaaagcataaaaatctgtatcactcacgtgcagttcatgcatgagtccaaattgactcagaatttgtaaaagtgctttaaccagtgaaagagtggctactaaatggagcaaagtttttgaccaaagaggtaaacgaatgtttgtagaatttgatctcaatgaagacattacagtcaacctattcaaaataatggcggtactaaaacatagaacagcatacttacttaccgaataggagaaaaacattctaattcctaccttagctagttgcaaagtggtgaagttacctttctccatcaatgcttgaaaagagtccaaagttggggctgaaactattgtagaatttggacttacaaaaacttccggtttctgagttgtgttatctaggtaattaagatttccagtcttgttgtgaaaaaagctaaatacatctcgtgttatggagcaattgcttaacatgttgcaatatatttgtagacatcagtcaaacttttgaaaatccctacgtaatgactgttcctgacaaattgtagcctctcggtgaccttctgtcaagtcaaccattccttacatacatcatttatatgccagagggcagggtaatgcagacatacaaaaactttaatttaccgcgcaccgcaccgcgcaatttaagattattgagtcaaaattaatgatgtatattatatgatttctgtggtgataaatttatttgagtttataattatatttgcttaggattactattaaaaattttcatctatagcacgtttttgagcgtcgtttagtgatattggatagtccactttatattttacaatcaaattacctctctgagatgggttctttggagttggcataccttgaccaggataagtagaagtttgtgagggttggacaggctgtactctcgacaaaggtaaggttctgccatcaattgtttggatagtttttgaaaaacctaacaatgattccttgaaagatagtggcagagtgtaaattaggtcatcaccgtctcttttaaagtttggatggctcttttcctggatgacaaactgcaaagtctttctacggcccgtttgaggattgtaatcaccctggttcttgtatgttattttggtaccagctttccaacccggttttaattgaatgtcaatttgtgtcttttcagaggccccatgtgggccctttcttccaattttaaatgacttctttttaccaacaaacaaatcttctagactaactggtaaattaacttgaactgtttcttcctctggatacgtgggagagcttgatgctgatctaaagccgccaggcatacctcccatgccgccatgcattcctcccattcctccaggcatacctcccataccagcaccgccgccagatggataactagagaaactgaagccactgtcatcagcaccaccgaatggggaactgccgccaaagaattgtgaaaaaatattgaaagcatcctcattactgaacgcatgtcctccggagaatccgcccgcaccgccagggaagcctccagcacctccagcaccgccaggaccaccaggaccaaagcttggaccaccagatctagcagcctcgagaccgtattgatcatatatttcccttttttgaggatcatttaaaatttcaaaggcctctgatatctccttaaacttttctgtgtcacctgttggcttatctggatgatattttagagctgcttttctataaccctttttcagttcttgctcattagcacttggagatactccaagtaaatcataaagttttgtctccttgaccattattagttctgtatactatactctattatattgatgtgaatgtattaaaaaaaaaatcttaaaatgcaaacaacttatcctttatcctctgaagagtttctggatggttatacaattctaagtcgttaaaagaattcgtgtaagagcttaaataatattaattagaatttttgacaagaaagcgcataagtttaaaaagggattaacaatacggtaaagggacgagaaatctatacaatatatattaaatctcgaactaccttggcaaggagtttgtgctgacagtggttgaaaaacccgtaaaaggatatcccattctttttccagaagtttctggaacgttcatataaaccaaagagggtaacacaatacgttaagattcagaaaagtaacgactagctattactgatcatgttatagaagagtgcgacaaccatatattattagcgcagcgatcaacgtggcagtcttgtcatccatataaaaaaggagttctgattgatgtctgttatcttagtatctgctggctatgaccacacaataagattttgggaggctcttactggggtttgttcaagaacaattcagcattccgactcacaggttaatcgcttagaaatcaccaacgataaaaagttgttggcaacagcaggccatcaaaacgtacggctttatgacattcggacgacaaatcccaatccagtagcatcctttgagggtcatcggggaaacgttacctccgtttcttttcaacaggacaacagatggatggtgacctctagcgaagatgggaccattaaagtttgggatgtgcgttctccgtccattcctagaaattacaaacataacgcaccagtaaatgaagtcgtaattcatcctaaccaaggcgagttgatatcttgtgatagagatggtaatataagaatttgggacttaggagaaaatcagtgtacccatcaattgacacctgaggacgatacctctctccagtctttatctatggcaagtgatggttcgatgttagcggcagcaaatactaaaggtaattgttacgtatgggaaatgccaaatcatactgacgcatcccatctaaaaccggtaacaaaattcagagcgcactccacatatataactagaattctactatcatctgatgtaaaacatttggcaacatgttcagcggatcacactgctcgtgtgtggtcgattgatgatgattttaagctagaaacgacattggatggccaccaaaggtgggtttgggattgcgcatttagtgctgacagtgcgtatctagtaacggcatcgtccgatcattacgtgagattatgggatttatcaactagagaaattgtcagacagtacggtggacaccacaagggagctgtatgtgtcgcattaaacgatgtatagtttacaatttatcaactaccaagcttgaaggaccgaagtgacaaaaaacattatgattttcagtgtttgcttatccgcctttttgtaaatatagattttactatcctgtgcattttagttaattgattgttcacaaaatgaaagcaatcgcgatgcatatcatcaatgaaaggaagacgagaatgtacagtataaacatattcccttgcatgtagcactaaattttaagtttcgtgtagacgaaaggtttagctacttgcgcgacaaaatagtaatatttacaggcattcttaaacattttatatgtgtacatactgtgcgtaaggaaagaaaatcaaagcttgctcaaaaaagcccgcctacttctagcaatgacttcaactttatttttggtgtaatcaaaacgtctagacacaattgacttcttcccgcttttggtttcaaccgtactatctgtttcggggaagaccgactttaagtatttcctacgcaaatgtacttcttcagataaagtcaaaaaattacaagcgtccttgaaaagcgccttaatataattcttgtcttttttggtttctaagtgttgggatttttctaggtcctctaatagttttgccttcaaagcttgtttttcttgttccgaaatatactggtgtagctctagcttgttattgaaagatgtagatgagttcaaaagatcactacactcatcaatcttggatagactctccgacaatttctcattcgtccagctttctctccttgccttcaaacgctcttcttcttttaaataatatctactattgaaccttgcatcttctatggggtatccattcttcagggaagcccttacacgaattaagtatgacgttgccaattcgatgtcttttatatctaacttaagttcatcccgaagaaccttactcaacttgtcttgtaactcctttcttttagattccctgacctctaactgcttcaaaatattaggttttgcgagatagtcttttctagaaatagaattttcttccttatatgctgcccttttatttgttaactcaaaacggccaaacctccttacggtaggctcaaaatgaggagatggcagtttcaaatcacgcctcaaggcaacaccaatgaattttcttttaggatgaaaaggatcaagatagtaacgaacaacaccaggttctaaggcgaatatggaatgatctttccctataccaacgttttctccaggataaaactttgttcctctttgcctcataataatttcacctgtggaaacatcctggccttcatatttttttggtcctaaccttcttcctgcagaatccttcatacttgttctcgagcccgcagcccttttggtggcattacgcacttgaaggaacacaccagacacatgtttttggaatgaaaaactagaagtatctagtaaaataggattccacatattctcaccttaggttaagcttgaaatattatgaccacccaaactggcgagttttatttttacaatgagccaacttcattcttcagtgaactatcttgaatgagtctccaaagaaagagctttaaaattcaatagcggaacgtcagatatcgaaacacccagtcataacagccaaatttgcataattggtataaaaacagtgtgtataacattacagagaagccgttgtgtgaaaatctttttagtacctattcaaccaaacaattgaacttgaacaccaaactctagccatccttatcctcttctggtcactacatatacctcaatttacgtctttccttgggtcgtttcaaatgactctctttgtttagcgagggaaatgaaaaagtagagtactggctgaaaaatttcataattatgtttgctcatgagttcgaaaacagtttgaatgagcagatagaacgccaaatattaagttaacaggatatgtctgatcaagaacgaggttcagaaaacgtatgtttcattgataagggaggtgaagaaaagtttgtaaaatgagactttatgaggtcattggaattaaatagacatcaacgaatggtgagtcaccatttaatgctgccttcaaaacgcttgcttcaatgtgattccactggttaaagggggttttttgaatgcattgctaatgtttatctactggctatgaaagtgagaatatcaattataaataaaaccctgattttctacctgccatgctataatgtacagtttattccaactttgaaacgcaatgacttattggtctctctcattatgaaatttagttacttttactaatgttattcattgttgtagaataatcgaagtagatcgaggtcgagatcacctgttcgtcgtcggatgagtgatgatcatggttatgaaagagacaaccatttgtcccggaggtcaggtaattataacggtaggcgtaagttcgcagatacgtacagaggaagcagagatagaggagaatatagaggaggtagagaaaggtctgattacagagaaagagaaaggttcaataacagagataatcctagatctagagaccgttacgatgataggcgcagaggaagagatgtgactggtcgttatgggaacagacgtgatgactatcctagaagctttaggagtagacacaatacacgtgatgacagtaggagaggcggttttggtagtagtggagcaagaggtgattacggtcctttgttggcacgtgaattggatagtacatacgaagaaaaggtcaatagaaactattccaatagtatattcgtgggtaatttaacatatgacagcacccccgaagatctcactgagtttttttcacagataggaaaagtagtccgcgcggatataattacatcaagagggcaccacagaggtatgggtacagtagagttcactaattcggatgatgttgacagggccatccgccagtacgatggggccttcttcatggatcgtaaaatcttcgtcaggcaagataatccaccaccgtcaaacaatatcaaggaaaggaaagcactcgatagaggagagcttagacataaccgaaaaacacatgaagttattgtaaaaaatttacctgcttccgttaattggcaggctttgaaagacatattcaaggaatgtgggaatgtcgcacacgctgatgtggaattggatggcgatggagtatccactggatctggtacggtgtccttttatgatattaaagatctgcatagagcgattgagaaatacaacggttatagtatagagggtaacgtcttggatgtcaagtctaaggaaagcgtacataaccacagtgatggagacgatgttgatatcccaatggatgattctcccgttaacgaagaagctcgaaaatttaccgaaaacgttgtcggtggaggtgaaagaaatagactcatatattgcagtaatttgccattttcaactgcaaaaagtgatctttacgaccttttcgagacaatcggaaaggttaacaatgctgaattaaggtatgattccaaaggggcaccaactggaatagctgtcgttgaatacgataacgtcgatgatgcagatgtttgtattgaaagattgaataattataactatgggggttgtgatttggatatatcgtacgctaaacgcctctagaactactctcgatctatatactttctcacctattggatctgcgacaagtatttattcattcttgacttatttccaggctttttaactttataatgtcattgtgtatacgtataatctgaaaaaatttcgaagactttgaagaagactgtgaaaagagtctgatttttccaatacagtgaaaatgggtttaacaaatatccaaaaaagtactttgaacagatatcgtaaatagacgacttttttatatgaataacaaaaaataaacaacagacaagaggcctcagaaggcttacgtaaagtacgtaaacgatctacctcttacaactggtagttgcttttgctctatgttttcattacgctctcatttctccagccgttgggaaacttttcgataataacgaatgaacagtttcatacatgcctaggaagatagcaccacctgcactgatccacattgtccggggccccactccactgaaaaatacagcaggaccttcctctctgtaaatcctaataataacgcttccaagtgaggcggttgttttgttgagcattaatctggttttcaagaaatctaatggtgtcgttgtagctgctgcgatcccacccgcaatagaaccgcagatagcccctttccatggctccacttgactttggccattggcttttgcccaagtcttttttagatactcgtataaaggaaactgtatacaagtaaacggtatttctctcataatggtggtagaccaccctctataaagatttttccttaaaccttccttattgtcatttcgtagaattgactgtaaagtctgccaggaagaattggtagagtgaacttgcgtcctttgcttaacgacttctgcgggaactcgaacaagacaagcacaaatttcaccaatggaagaggaaagcatgtgcgttgtcgtatcaatcaattgctcagatccctgtgagtaaagtttgctgatatatggccttgattttactttcatataatcataactaataaagaaaagtgaagcacctggcgccgatgctacaacagcgcttcccaaaccacgatatatgcctttgtatcctccattagcaaagaatccacccttagcttgaagcctggttttaattgtgtctatagggaaaaaaaccaaatccgtagaggtaccagcagcggcgccacttagcaaggaaagaaaaaaagtattcatagcaaacttttcaaagcgaattttagttcatcggtgtgtctaaacatataaaatcgccaaacaatttacaacaagtggagctttaatgatctcatatattctcgagggtgcaccccactgcaaatgtatttatatacaaaacagcgctcagtaagcgaggaaaaaaagaggcgcccgtgcttttgccgatacataaactaaaaaccaataaacttgccaaaatacgtatattcttcaatccatgaggcaccactaattatatgcaaaagctcaatatctgctccttcaatggcattagataactaacaacctatgtactatacaattttaaaatactctcttaattaattcaacttggctaataaagagtcaatgtcaacttcgataactggtgctgtagctgcatttgaaaattgacgagttcttgattcagcctcccgctgttttattttccttagcctattcaaagaaccaaatccagatacttctctattcaacttgaatggttgtaagaagaagttacaaacagaaaaagactcacccatagtggcaatctcatgaataatatcttcaacacaaattattccatgatctcctaattgctcctcgacaatattgttgtcattaagaactatttcgtgaggttcagcctcattctcacccttatagattattctacctctcttttgaatcaaggaacggatagaagataaagaaggcttgccaatcactacgtatggcgcaataaccttgagcaacggatatacgtttttggtcaatttgacgaaaacaccagtattagtttcaactaatcttagcaaagacaaaatcttaaatgctttgtttggaatatttacagcaagcggacctcttactctgacaatgaaaagtaaagcaggtttgccatcgtaagtagtcttttctctgattaaaccatcgtcttcttcttcttcagtctcctccaagtcgacagagttctcttcggcgccattagctttttctgttattttcagaataaaatctttcccagatgcaatatgctgcgtttcattctttgccttcttatcttctaatatagacactcttttaattctttccttttccctagaggtagccaaagtctttgcaactatactttcagctctgacaaatttgttcttattacttctcttttttttgatttgttcttccctctttttcttagctaattcttgtctttcgattctagttctatcagcatttcttcttttcctcaaaagaatttctggattagaattaagagtttgcgctttactgtcttgagttgaagacattgtgacttgtatatcttattctttttccctgtggcagcctcttctttctaggaacttaataacgaaagtaccaaacaacttagacttttctcatctcatcgcttcccagctttttttaagcagagctgaaaaaaattttctttttaccaaaaatccgtactgcgtgatgaaagtgtacatacattattcaatattcacctagttttgtatattaatgtaaaatgtaatttaatgaagatcccaaaaaattaagcattcgttgctgcatcgttgtcattttgttcaattatcgcattcctatcatagcaaaaatatgaaggttattagtctgaaaaaggattcttttaacaaaggaggagcagtgattactcttttaccggaggacaaggaagatctgtttactgtttatcaaatagtagacaaagatgacgagttgatattcaagaaaaaattcacctctaaacttgatgaagctggtaagaaaaaaagtacagatttggtcaagttgaagattaaagtaatatccgaggattttgatatgaaggatgaatatttgaaatataaaggtgttactgttacagatgaaagtggagctagtaatgttgacatacctgtcggcaaatatttgagctttacccttgactacgtgtatccctttactatcataaaacaaaactttaataaattcatgcaaaagctcttaaatgaagcctgtaatatcgagtataaatcagacaccgcggcggtcgttttacaggaagggatcgcccatgtttgtttagtgacatcctcctctactattttaaaacaaaaaattgaatatagtatgccaaaaaagaaaaggactactgatgtactgaagtttgatgaaaaaactgagaaattttataaagcaatttacagtgcaatgaagaaagatttgaattttgataaattaaagactattattctttgctctccaggtttctacgctaagatattaatggacaaaattttccagtatgccgaagaggaacacaataagaaaatactcgataacaaaggaatgttctttatagcccactgctccacgggctacttacagggcattaatgaagttttgaaaaatccactatatgcttcaaagctgcaagatactaaatactccaaagaaatcatggtgatggatgaatttttgttgcatttaaacaaggatgatgataaagcttggtatggtgaaaaagaggtagttaaagcggctgagtatggcgcaattagttatttactgttaacagataaagttttgcattcagacaatattgcacaaagagaggaatatttgaaactgatggactccgtagagagcaatggaggaaaagcattggtattaagtactttgcattctcttggagaagaacttgatcaattgacgggtatagcctgtattctaaaatacccgctccccgatcttgatgaagacgatggtgaggagtagatttactatgtaagaaaaaagtaatgtacacataaaatttgcaaccctataataaatcggattattctctttacttcttccctataagcaagtagatgtgaagccgcaattaattgagttgttgtgaaatggttctagttagtcacgtgcagctttttaaaaatattttaaaacattttaaaaaatatacatttttttattatttttttatatattaatgttaaaatttatttatgtatttgtcttccgaaaagtaaaataacgttcaaatttggtatttaaggatatctgcgtttaggcgcctagcaaaaaaatgccgaactaagaaattatattaatgtggtataagttactgtttactaaaagtgccccaaacggcgctggactgataagaatgaatacggattagacagcaggtttatgctaccctgctcctagttttatgtgattaaactcaaaaccttgctggtagaaatataaaacactgcttttaattagtataaaagtgacatttatcttgaggtaagaacagaagaaaaaaaggaaaaagagaaaattttatgagattgcttttttcacatgaccatattatattcgctttatcaactttttagtgtatcttctactctaggacagataaagatgcattaaccttgtcattttgcttcttctgcaggttcatatacatataaacgttagttacaccttgacgtagtatatcgactacaggctagattttactgctaaatcagcgcgccagcccaccacaattcgatttgaaagcgctttgcaggaatttaagagcattttgttttctattcattgatatcatttgccaagtatataacataaccggtaggcataggggactcaaagcgtaaaaatcatgaagtcatagccatttccttatgtaatatatatttatataaattataaactactcattcgtatatgaaaatacgtgtttgaatagtcgcataccctgaatcaaaaatcaaattttccttagttcttactttcgattttctttaccaactccttgtatttttcggtggagaatgattttggcctttcgattggagcaccaacagccctatcgatgattaattggggtaacacaccaatagctctggcaacaccaaacaatacagtgtagaacgaagcctcagttagaccatagtattgcaataaaacaccggaatgtgaatcaacatttggccatgggttcttagttttaccatgcttagttaaaacccctggggcaacttcataaatggtggagaccaacttaaataactcgtaatctgggaaatgtttcaatgcgaattcacgttgagccgtataacgaggatcagtttttctcaaaaccgcatggccataaccaggaacaactctccctgcgttcaaagtatcccacaagtacttttcaattgtttcttttgaatagtcacctttcacttcttctctcaatttaaatagccattctaaaacttcttgattggcacgaccatgtaatgggccagctaaaccattcaaaccagcggccaaagataagtatggcgaagataaggcagaacccactaaatgtgtagtatgggcagaaacgttaccaccttcatgatcagaatgaatagttaaatatagtctcattaagtcaataaaatccttgttttcgtagcccaaaagttgggccaaatttttaccatagtcagcattaggatcggttgaagtaattttaccatccttgaacacattacgataaattttggaagcaataacaggtaatttacccagcagatctaacgaatcttcaaatgtatagctccaatattctttcttggatacaccttgagcatatgctttggcaaacttagactcgctttctaaagcagtcacggcaatagaaaattgcgccattggatgtagatcttttgggaggctatctaaaagttggataacgtgctctggaatttctgatctggcagctaaatcagcagaaagggctttaacttgagcgtcagtaggtatttcaccagtcaaaagcaaccaaaataaagcttctggcaaaggttctgtactaccctcagcctttggtagttccctttgaatttctggaatagtacgacccctaaatctaataccttcttcggggtctaacacggaaccttcccaaacaaggcctttaatacctctcataccaccataagcttgctccaaaagaacttcaccaataacggttttaccgtgttctttcttgaattttttaatttcttctgcctttgctgggataatttcagcaaatctctccttcaacgtttgttcggaggcgctactatagtggcgagcattcaatagtgcaaaaagagccttttgcatattttgacattgtcttgtggagccccttgataagaaacttttgctagttgttgataatatcgctgacatcttcgtaaatagtattatattgctatatgttttgccttattttctttttaatggttgtaattgtaattacttaaatgcaaataaaagccaaaacaaacctggtttgtattttagtaaacagcaaatttcccccttaagactagcaatccataacaggggaagggtaaagaatagttgctgcaagttttgagcatttatataatggatggatatcaattgacattttcaaacaacaagaggtcggataagtcgatagtatcggaaaagctccaaagggattgcgatcctccaataacacaaaagtatttttggtctagcgggggtcatacttttcatttccgggcggctgcggcggaaaaaaacgtgacgccttttagcacaaaaatgcaaggtaaatacataaaaaaaaaggcaatgtgaacgtaaaaacgctcatatttacaaagattaattgagccgttcaatgaaatgcgaacttcggagatttctttaattagtttaggtatactttcctgcgaaggtcttgttggaatatgtagtaatctctacccgcgtttttagttaatgctgaatggtttttgatggctccttttttcttagagtgacaggcgcggcagccccttaacgcgggtacctgaacaagtaaatccgaaaattcaatttgacaagggaatcattgggctgacaacaataagatgagctctcttatatttttgcccagggaaaaattttttgcccactaaagatatgcaatattaaaaaatttgataaaaataaatcaatgggggcgagccgggactcgaacccgggacctcccgcaccctaagcgagaatcatacctctagaccacacgcccggtagaagttgttttaatgaatttcaaaatatggtacctcaacatcaatagatcatcaaccacaacgtaaaacatgcatgtgaggcttaggtgatttttgagataattgttgggattccattgttgaaaaaggctataatattaggtatacagaatatactagaagttctcctcgaggatctaggaatcctcatattcctctgttgataattagaggttaaaaattagtattaatgaagaaataagtactgatcttcttatactaaataagagatgtatataaaacacacgctgattggtcatattaatcatgaccaatataatagtgattccggtagttactaaacattgatgtgacgactcatattcctcatatatgtacctaccataacatgttcaactaataggtctttaacacagcttcagtattgtctgagcttctcgtttaacattccttctgcaataggcgcaatcacacttaaacgtatacgaggtgtacattaatatacgatgtaagcattagattgttaccatagcaactcatgtcactattaattactctcgttccaacaaaacaattcttaaaaattcaccaatttagcttcatggcaaggcttacagatgattaaaatcgtgtagatcatggaaatcgaacctttcacgttctgcagaatttaaagtgactccatggccaagttggttaaggcgtgcgactgttaatcgcaagatcgtgagttcaaccctcactggggtcgttttttttcttatttcagatagtcttgtcggtagcaaacagtcaaatcgctatcacttacatgtgatatcatttctgtactgcttatgcactatgaagtgcggtttcttttttatgcgatattacatgtgtcaatagcaaaaggggtaaaccgtgctcctatacaacaagaacaatagttcggaaatgcatgagaacagtgttgttttataaaggattctatgtgaaataaaacaaaggccgatttgttcgacatttgctgggcttttcataaataatggatcataagaatatataataggggtaaaagttattttagcctgcacttttgtgtttttagaagaacaccttatcattgctaggtaatgcgaatggatggaccataatgtacgagttttgtcttgtggcaatacctgcgtaagcgttgtaccaggcaatgaaggctactatcacaccaaggaccccaccagctctagtgacgccaacttcgcctgtgaagtttgcaatggatagaagtaagaaggtcactgctaagaggaagaataaggcaaaaaacattatagttgatttcatggtgcagacggaaagaccgaaggtgaagagtgcccatcctaggaggtaaaaccctagcgcatttccaaggtcggattccttgtccttataggcatctagaattccaaaccaagggatgtatatagcaccgaagcttaaccaaaaaccgccgaaggaacacagggctgtaccaccgaaagtgttctctaaagcgatttcccaaataccagcaatgagttgaacgaggccaccgtaaaacatggcacacccaacaacaacattagggatagtgatgccttgggctcttgcattgaacatggataggacaaacgtagtgagggcaaaaccggaaagtcctagtggagcaggatttgcgaatttatggactggcgcgggggctaaaccgggattcagagtaccaccgaatgcctcgaacaaatcatcccttaaaaatttttgacggccgatgtaaatatactcgttgtttttgcccgcagtatatattttgcatatggactcttgcgagtggcggctctgatcgttgttttcagagatgaactcaccctcggaagaatcgagtgccttagggttctcaaaagcggtgttgccgctgctttgttctctgtcagacatgccttttatttttttctgtgattgaagattgtttttgattgatctgtagaatgttacatagttagttatggctattctagctctaggtaggacagttctcctgctttatatattttgcttgttcaaagatgatcacggctgttctcggagtgcgtaactgcttgagagttaaatccgtcgaagttgctgatcatttccagaaatgaggagactgttgatgatctactgtgaaattattgcggggctggtagcatctactgtcactattattgccatgtcggctggtatcggagttctccctccgccgatttaggatggagccgttccagccgcgtccgctcttaagcgtccgtaattggtcaacaaagcatttcagccgtggtgattggaaggaaggtcagctttcctgtattgcgtctctatctacttacaatacgaatgatacattgaattacgtactagtgtgagataggggtagtcaagaacttcaaattgtccattcatcgaaatagaccacttccttgtcgtgttttgaagccggaaacatcttgaagtagttaaagatggaaaattcttcttcatcctccaaagccttattacctgcctccggctcgccctcaccttggttcatttgtagaatgctctctaaggtcactctatagcagtcatgcgtgactttttccagcttgtcgtcgtacactaagacttcacacaaagatctgatatttgaaggggttaactcgacattggccacttgtgccgctgtaataaattccaaaatttcttgtgtggtagagtaattttttacgtttggagcataaaagacgttttttttgggtccattttcgaaattcttgaagccattagggaaggtgttctctgatatgaacctccaaacaatagtcaataaactattgataaattctatatccagctctccatctgtgaaccatggacctcctgtgatgtccacagagggttgtaagctgtacaacatgtagattttccttgtgggaaactttacactcttaacactcttcacgtatctttgggattctaaactcttcaagcatttaagaactacatgctgatggagattggttcttgccttgatagtcttggaccatatcccttctctaccgctagcctcgatataagaatataccagtgcctcttcagccgacatggtggctttcttttgcgcctcagattctaagacaccttgaaattttaattcgtcgttttgttttactaatttgatcaagttcttgtctagcaattcctgtacaatggacatcaagtctgttaacgacccgattcccatttgtttttggagttcttgctgtgtaaataatgcgcctattcctttcgacatcatctggctatgtaaggttttagcattgtccgatagctgtaacccattttctatcattccactcatattcaggatattggcgctgtaaattcttcacttgattaagattttctgtaatgatctcatctcacaaatacatcgcaaatcaacttgaaaatttttaatacaataaaagatttgaaggaaaaaaaaagtgcctgtgcgcgatgttacttaaaaacaaaaagattaaataattgcaatatcatctagttggattctaaatatactaccaaacaagggcttaaacattttaataaacgatttacatatttactgtgggtatggcaatgggtgagcgtaggtatgctacggtaggcgatgtagtgagtagtgcggacgaaccgtagccgtaacgtttaatgccccctgccttttcttctcaattgctcacatgtaagcaaagtcttccaagaatctggttttactcgtagccttttaacgctgttttttttttttgcacacctttaaaacctatagaaactccttcatataaaatgtactagttataagatgactttttatattcaaaattagaagaaaacttaactaaaattaaaaaaatagcggctattaaaaggtattaaaaagtgagaaaaaaagaaaaaaattataaacttgagaaatcaaaggagactaaatgcataagcaaagagaagaggatctcctcggatgatagatttatacaattactctaacttagaaggtttactagacggattaacggacttgaatcgaattccgaaggaatactccgcagtattggagccatattttcagaatatagcaagaaatgcacatttaaagtctagagctctaaaaatttgtcgttctaatttccataaatggaacgaagaaggtgcgaagacagtcaatccggaaattataagaagatgccttaacctgtggtatgttttgaagggcaaggaatataaaaagttgaaggatcctccgcctgctgataatatcattaaggatgagattgatgtctcatatgttaagaatttgaatgtagtcaggttggaatttgacgaatttggtaaactcataagtaatccattagagaatttgatcttggaagaggtcgaagtgaatgatttcatacaagaataaacctaaagtgtgttcactcatctaatatgcacggagcctaccttttagcttttgctgccaaactaaaccaagattgaaagatatataatcgactatctttcgtctcgtaatctgtatcatgcaatttaaattaattatcaacataaaatgctctagttagcacgcgcatatccaggaaagttcaccagtaactatgtactagacaaaagcaaactgttcggagcgaccatacaccatatgttgttgaatcaacttttcttaaggctctttcgagttcatcattaaccaacctaggtattttcccgattttttggtaatatgtcaaaacagctactttgtatacatttatagacgcctggtgtcctttgagcctcacttatataaagtaaccttcacaagattttggattttggtaatacatacgctactgctatttcttgcggagcagcagaatcatcttgctcggcctccttttctgaaaatttcgatgatacctgaaataatcatcattagcagagggaatttaaaaatagagggtgtaaaattatcaagatttttttttgctaaggtgaatgagtagtgagtaaagaactaagaacagtatgtccgttagcacgccaagtgagttagacgcattaatagaacaagccactagtgagagcattcccaacggtgaccttgatctccccatagcgttggaaatttcagatgtgttaagatctagaagggtaaatcccaaagattctatgcgttgtataaagaaaaggattctcaatacggccgataatccaaatacccaattgtcttcctggaagcttaccaatatatgtgtaaaaaatggtggaacgccttttattaaggaaatttgttccagagagttcatggataccatggaacatgtcattttaagagaagatagcaacgaagaactttctgagctggtaaagaccatattatatgaactatacgtagccttcaaaaatgattcgcaacttaactatgtggcaaaagtttatgataaattaatctctcgtggcattaaattccctgaaaagctaacactttccaattctccgactgcaatgtttgactcgaagacgcccgcagattggattgattctgatgcttgtatgatttgctccaaaaagttttctctactaaataggaaacatcactgtcgttcctgtggtggagttttctgccaagaacactcatcaaatagtatacccttacctgatttgggtatatatgagccagtcagagtatgtgatagctgctttgaagattacgatttgaagagacatgacgacagtaaaaaatctaaaaaacatcgccataaaagaaagaaggacagggactactcaactcctgaggatgaagaagagctgataaggaaagcaatagaactctccttgaaagaatctagaaatagcgctagtagcgagcctattgtccccgttgtagaatcaaagaatgaggtgaagagacaagaaatagaagaagaagaagatcctgatttaaaagctgctattcaggaaagcttgagagaagctgaagaagcgaagctacgcagtgagcgtcaaaaagcctctagacagatgcaaccccaacagccatcacctcaacctcaacctatccattccgttgatttatctgatgaggagaaagacagcatatacatgtttgcttcacttgtcgaaaaaatgaaatcgaggcccttgaacgaaattttggaagactctaaattacaaaacttggctcaaagagtatttgcttccaaagcaaggttgaattatgctttaaatgataaagctcagaaatacaatactttgatagaaatgaacggcaagatttcggaaattatgaacatatacgatagattattggagcaacagctacaaagcatcaatttgtctcagcaatacacacttccacaagtcccttctgatccgtacaattacctaacagaaaatgtgcaaaatccagcagaaagctatcaaacacctcccctccagcaactatcatctcatcaatacaaaccacaacaggatgtctcacgccaacaatcggtaaaagcaaattcatcacctaccactaatattgatcacttgaaaaccatcgatgtgacaccacacgcacagcaaaagcctcaatcgcacgttgaacttgcaccttcggacccaccttatccaaaagaagaggccgaagatgaaggaacacaggcagtgcaagatgaggaatcctccacacaagaatcccgcgaaaggccgtatccagtagaaacagagaatggtgaaacttcaataaataaacggcctcaaggcattacacgttacgattttccaactgttcctgcacgcaaattcgtccaaccggagtcaactgtaccacttcctgcaagttcctctgaaattccgatcaaagaggaaaggccgcctagtcctcaagaggaactgctaatagagctttaatattgtagccttttctatgtatttgtaaaaagaaacctagcgcttataaatatatacatacatatatatataattgcttgttacgcaacttatacatatttctgtcattaaactagtttttaaggtgaatattcataatttatgtcagtattaacattgaaaccgtcaaaaaaaaaagtatcaatatagacaaaggaaggaccattttaagaaagtggttttaaggaagaaacttgttcctgcatatttatagttaattcctatcttcttgtttatcctgttttttgaccacctggcttgcagctaatagtgaaaaaacacaaatttttaccaaccttccatggtatagtcatgttgtatactcggtgtaacactagtaataaactttaagaaaacaatcaagtattggtctacccgtaacgaatcatcaatatcgtcttgtaaatcctcccagtctccgacaccgtccagctcttgttcttcctgcagctctttccttcttcgttgtctaaccacacgaaccttatctagcaatattttcattacattagcatgcttacatggatgaatggaaacagataacactgaattcttgtaaaaaggtagcttttcaatggtggctgtctttgttctataatctgctgatatatcttcgaacatctgctcagggcttagtggtgaaccattagaattaaaccccactatatacattttagggaccctataagatgtcgagtacgcaatataaaggtcgtaatacctttcttgcgccatatctttggctaggccacctttagcattaaattcttctgtatcgtcattttcatcctcctcttttatttccatgtcttgtattagctcatcaatatcatcgatagatgagtccttggtcccccccgcaggcgtactttgcacatgttcagtttcagatcctatgtattccagaacatcatcttcatctccatcttctgcaaaacctttcatgattacatctggcccttcaacttcgacacattgctcggcacgtttatcacagggaacttttctaattatcagaaactgcttattcttcggtaaaaaatctctgtaactaatatctgacgactcttcgttccacttccaggtgggaaacatatgacataaataatcacctgcttgtacaaactcctcaggagttatttgacctgtggttaaaaaggtagatttgtgcgttatgggggtaagatattctctccaactacttagtgtagatctaatcatgataataaaattgtatttactcctttgtacttctttgttcctaacttctagctagcttgatatacgtcaagtgtacgtaatcattcaagtatctactttcctttaaatagcccttcgctctgcttcccttataataataatgtccgtgtacaaaattgaatgcccaagaaggtgaaatttgaaaaataagaaatctactaaataccgatacgaagaagcgtatagtaacagccattacaaaaggttctctaccaacgaattcggcgacaatcgagtaaaaaatgggcacactgtttcgaagaaatgtccagaaccaaaagagtgattctgatgaaaacaataaagggggttctgttcataacaagcgagagagcagaaaccacattcatcatcaacagggattaggccataagagaagaaggggtattagtggcagtgcaaaaagaaatgagcgtggcaaagatttcgacaggaaaagagacgggaacggtagaaaacgttggagagattccagaagactgattttcattcttggtgcattcttaggtgtacttttgccgtttagctttggcgcttatcatgttcataatagcgatagcgacttgtttgacaactttgtaaattttgattcacttaaagtgtatttggatgattggaaagatgttctcccacaaggtataagttcgtttattgatgatattcaggctggtaactactccacatcttctttagatgatctcagtgaaaattttgccgttggtaaacaactcttacgtgattataatatcgaggccaaacatcctgttgtaatggttcctggtgtcatttctacgggaattgaaagctggggagttattggagacgatgagtgcgatagttctgcgcattttcgtaaacggctgtggggaagtttttacatgctgagaacaatggttatggataaagtttgttggttgaaacatgtaatgttagatcctgaaacaggtctggacccaccgaactttacgctacgtgcagcacagggcttcgaatcaactgattatttcatcgcagggtattggatttggaacaaagttttccaaaatctgggagtaattggctatgaacccaataaaatgacgagtgctgcgtatgattggaggcttgcatatttagatctagaaagacgcgataggtactttacgaagctaaaggaacaaatcgaactgtttcatcaattgagtggtgaaaaagtttgtttaattggacattctatgggttctcagattatcttttactttatgaaatgggtcgaggctgaaggccctctttacggtaatggtggtcgtggctgggttaacgaacacatagattcattcattaatgcagcagggacgcttctgggcgctccaaaggcagttccagctctaattagtggtgaaatgaaagataccattcaattaaatacgttagccatgtatggtttggaaaagttcttctcaagaattgagagagtaaaaatgttacaaacgtggggtggtataccatcaatgctaccaaagggagaagaggtcatttggggggatatgaagtcatcttcagaggatgcattgaataacaacactgacacatacggcaatttcattcgatttgaaaggaatacgagcgatgctttcaacaaaaatttgacaatgaaagacgccattaacatgacattatcgatatcacctgaatggctccaaagaagagtacatgagcagtactcgttcggctattccaagaatgaagaagagttaagaaaaaatgagctacaccacaagcactggtcgaatccaatggaagtaccacttccagaagctccccacatgaaaatctattgtatatacggggtgaacaacccaactgaaagggcatatgtatataaggaagaggatgactcctctgctctgaatttgaccatcgactacgaaagcaagcaacctgtattcctcaccgagggggacggaaccgttccgctcgtggcgcattcaatgtgtcacaaatgggcccagggtgcttcaccgtacaaccctgccggaattaacgttactattgtggaaatgaaacaccagccagatcgatttgatatacgtggtggagcaaaaagcgccgaacacgtagacatcctcggcagcgcggagttgaacgattacatcttgaaaattgcaagcggtaatggcgatctcgtcgagccacgccaattgtctaatttgagccagtgggtttctcagatgcccttcccaatgtaaatgaccgacattgactcactatccatccgtgtattatttcaaagagcgaaaagaaggcgcgtcgcgtcgacgcgcctttttaggctagaaaataaacagaaaacaaaaacaaaaacaaaaaaaggcgaaaaaacaaacgaaaaaacaaacgacagtagatagaggagaaggtttttgacaggtttgtgtaattggttatttgcttttatagattatatatacacaaacttaaaacactgttttctaagtaggctgcggagagggccaattgcagcagcgacgtacgcatagaggaaaaacaaccgttcatgtccattatgaagcagaggctaccactgggggagttttccagctcgaagatcaacaaactggcaattgccaatattgcagacgctagcgagcctagaaaccatggagaaaacaacgtcgggactgtgtgtcttccctctatcaagagtttgatggttagtcctgaagtatacgaaaacacgaagagtcttcctgttcccctaatgaggagcagtggcggaggtatggcttgtgccagtaagtcctcatgccaggatggtattagtacgaaaacaacgtctagagattactctgagctttccaagaagttgcaaattcgtttacagttcgcctattataaatacaagactaagcaaacagacaaaaatttcacagacttgaaatcaaagcatagcattacgaggccttccaaagtcgcgactcacagtaaatcagaacctttaactaggagaagaaaattagtactatctcagggtcattataaaacccctgctaggtctaagatcaaaactccatcttcgatttgctctcacgataatacatcttcctttacatctttccgcggtgtcagcgaaagctcgagcactaccgcagatatgaacgtcgcagataccaccacaccaatacgcaacaacataaacacaaagcattcaaacagtcataatcgcacattgtatcagagacaagaaacacctacaagcatcaaagccgctaagtctttaattcatctctttacaagtaaccaataatcccacccccaatatttctatctttcattttcattctccttcattgtgtatataataatattattgtcttcgtatatcttccacattaccttttcacttccgctttagttctgtacgtataattagatagaatatcatataaaacctgattttattagtatcgattgcaattctactgcggccattaactgtaaccgaattgaagaaaataaaagaaaaaaagagaacatgcataaatgggaaaaagaaggcgaagcataccagcatctaccagagagacacgagcactgaaagtcgccataaaatgaatctacagaacaacgttttaaatcagatacaccagattctgctgcctacgaatcctactctcgataaacctaatgctgaggctacaaaggaagaattttcgtctgcagaaaatagagatgaaaaagactatcttaccaaccagcagccgaaaaatctgagtactccctccaccagttccaacggtgaatttataccgcatattttttattcgctgcaccaaataaggaaggatccaaacaatctctcaaatcaattggaaaccttaacaggttcgattagacatcgtttgaaactttgtaaatctttgatatcggaaaacgaagataccaaggatttattaagtaaaagtccatcagaatggcaggatatcatccatcaacgtgaacaagaactgcaaattaagagagacgtcttggatgatctttatcgcaagttacaacgataaaatctatgctatctatctttagtctatatatatatatatatatacatacgcataccacatcttcaaacgtgcatatagaatggagcctgcgtttctagcaatacacatacacctgtcaaaaaaccttcaccgcctccccctatttgttttatcgtcaattaaatctttaaagatttgtggaaccatgtctatcaaccattcttccttagggataactagacagtccctgataaattccttcgacgttagcatcaattgttgataaagcacatatttgcttggtctctgcgccttttccttatgattaacgaaaagtatactggtaggatgaacactaacgttcagcccacctgatgacctacccatggtttgatagccggtggggcctaattgtacaatattcatcggaaacccgctgatgaagcatcgagttattctagcatttatgtagcccgctatattgcctatcttcatcctggcttggtcgttcttttcaactaatccaaccttttcactgcacctgaataattggtttctaatatttcttaccctcaacatcgttttgaattgaattttgtggtcttgacaccaacttctggaaaatttagagtttctccattggttgaagatttccaaatacaatatgtgatcactttccacttcgcttaacacacttgccgcagcatctcttttttgaccaataaataatgaaggtgtttcatgtagcatcgaaactatggtcaaacactcttctagtacaccttgacattgttcgtgcgtagcagctgtataaagcacttttgcaaattcaggttcacaaggaaactcgcacatcattttacctaaccgagtgattgtccctttgctatttaaggcacctaaaatgtataaattttccaaagacttccgtaatgtggggatactgggcttatccatcaggggaaactttattaggtcagtaacgccaagcgataataataataacaccgtattagaaagatttgttcttgtgatctcaggcttaggcataagttccaactcgtgcaaatatgaccatttggtaaaaattctaaaacattttcccggcccaacacgaccagccctaccggcacgctgatcaactgaagctcttgagcatggaactgttaaaagttgggtcattccagtggagggtacgtacgaattttccttaacaaatccaggatcaatgacatatctaataccatcaatggtcaatgaagtttccgcaatattagttgccaaaacaactttcctacaattttccggagtcggctggaaaattttcaattgctgctcttggggtaaatttgcgtatataggagttataatcatttgttttgttctagaacctaatttagacatgatctcctccagtttggtttttgttctttcaatttcttcttgccccgttaaaaacaccaatatatcccccggtaaactttgcgtagtatgaatttgaaaaatagttgttatagcggcatgtatatagtttgcctccggctgtaatgtgtagtggatatctacaggatatcttctcccaggaacgttgaaaatgggacaattatcaaaaaactctgaaaatttttttgcgttcattgttgctgatgatataagcaattttaaagtgggcctctgcggcaaaatatctttcagcaaacctatcaggatatctgtggctagagtacgttcatgagcttcatcaatcataatacaagaatatttgcttaatttggaatctgtaagaaattctcttagtaacataccatccgtcatatactttagaaccgttttatttggggttgttttgtcttcaaaacggatctgataacccacttccttcccaagcacaacattcatttcatctgctactcttgcagcaacagaagtggccgccacacgacgtggttgtgttatggcaatctgtaactttccctgatcagtgaatccatcttctaccaaatattggggtaactgtgtggttttaccagaaccggtttcacccattataatcaaaacttgattttttttgatctcttgtagtagctcatccttgtattgatgtacaggcaaaagttttcttgcctcttgtatagtcagtatacgcttttcctcagtttctaaagcttgtgctagacgtgcctcatattgaagtttctcttcaggtagtaaatcgtcctcctcattagtataatcaatcattgcatctgtgtcgaacacataatcgtacttgtcagagccttccaatgttatatcatcagggtgatcgctttgccccgccatagcatttcgcaattgttgttcttcccacatgcgttgtctgtttattttgtcaatttcttttgcattctttattttatgagtaacttctacgttaaatttagaattagaagaggcgtacttagtttcattctcggagtcacctagtagacccttctttgtagtaagttcattatttgacgttattttttcatcatactttgatgactttttttgtgatccaagttgttctccttttaaattgttcttttctggaccttggttcgtattagaaaaaactttattggggtcatagcgtgatcgttttagctgcaaggcagagttcttatccttggcctctttgtcttcttcctcacccaaggaagaaggctctattcttactgcattgtcattctgtcttgtaacttcatacgttcgtttcactcttcgcttaccggtttcagatgtaatacttgacatgtgttgctatacacgcttgttatctatatagatgccaattaaacatatagcagctatccgttattacttatacaattgattaatatcactttttaattgtccgggtaactaactgtcttccactttcagcacgttctcgtcatcaggttgtatgggctagtactgttttggctacatttgagatacgagcacttaaagaattcttgcatattttcgatgattagtctttaattttcccacttgttctcactatttcctctattgtcttaatacgctcacatatcgaagtttttttttcatgcgatgagcttcgagatgaaaaaaggaaactgaaaaatttagatcgataagataagagatgtgattttttttttttttcgtaaggctgtaggccttggataacgtcttatttactatttatatgcgacatcttcgataatttcatacgtttaatttcgaactcgcatttattttatttattatgtcccatcgtatagcaccttccaaagaacgatcttcatcatttatttcaattttagacgatgaaacaagagacacattgaaagctaatgcagtcatggatggtgaagtagatgtcaaaaaaacaaaaggaaaaagctctcggtatatcccaccatggacaactccatatataataggtataggtggtgcttcaggttcaggcaagacaagcgttgctgctaagattgtgtcgtcaattaatgttccctggacagtattaatatctttggataacttttacaatccattaggcccagaggacagagccagagcctttaaaaatgaatacgatttcgacgagccaaatgccatcaacttagatttggcatataagtgcattttgaacttaaaggagggcaaaaggacaaatatcccagtttatagcttcgtccaccacaatagagttcctgataaaaatatagtcatatacggggccagtgtggtagttatcgaagggatctacgccctttacgatcgccgattgctggatttgatggacttgaaaatttatgttgacgctgatttggatgtctgcttagcaagaagattgtcgagagatatagtttccagagggagagatttggatggttgtattcaacaatgggagaaatttgtgaaaccaaatgcggtaaagtttgtgaaaccaacaatgaagaatgcagatgctatcattccatcgatgagtgataatgctacagcggtaaatttaatcattaaccacatcaagtcaaaactggaactaaaatcaaatgaacacttaagagagctaatcaaattgggctcttctccttcacaagatgtgcttaatcgtaacataattcatgaattgccgcccaccaaccaagttctttcgctgcatactatgcttctaaataaaaatctaaattgcgcggactttgttttctactttgacaggttagcaacaattttgttatcatgggcacttgatgacattcctgtagcacatacgaacataattacacctggtgagcataccatggaaaacgttattgcctgtcaattcgatcaagttacagctgttaatattattcgatctggcgattgttttatgaagtctttgagaaagacgatccccaatatcacaattggtaaattgttgattcagtccgattcacaaactggggaacctcaactgcattgcgaatttttacccccaaatatagaaaagtttggcaaggttttcttaatggaaggtcaaatcataagtggtgcggccatgatcatggccatccaggtgcttttagatcatggtattgatttggaaaagattagcgtggtggtttatttggccactgaagttggtatccgacgtatattaaatgcatttgataacaaagtcaacatttttgctggtatgatcatctccagagaaaagttacaaaatcatcaatacaaatgggcattgaccagattttttgattcaaagtattttggttgtgattgagaataattagaggcaatataaagtaaaattaaataatagtgcacgtatacatactatattagtaacctttcattctctctatggataatcttaaaatcccattactttcaatatgccataacctactgtaacaatagcggcataacttaacaaactggctggtacacctctcgtaataaatgtacccacggtcaaatatctatcaccaacttcatcaatcattgaaatggcagtcacgttggggaaaccagaggttggaagacccatagcactagagcataatagggcggctataacgatcaatagtctagaatgatcacctgaaggtagattggaaccgatctcactcattaatggtacgatgatcattgccgcgacggtatgggagacaaaagtggccattacaagaatcactagaccgaagatcaacacaataatgaagattggttcatgctcaacctgcgccttaattaactgtgccattgtagacaataaaccggatgagcttaccgccttacctagggtggtacctcccatggccaaaacaacgattgtccacatgaaattattgaaatcatccgaagttagaagacctgtaccgaagaagactactataggtataatagatatgattcccatttcaccaaagataccggagatttggtttgaaagacaccaaagaacaattgttataatgcaaactaaagtgacaaaccattgcttcagagtgaatggatcacgggatggatgcaattgcaaaattttcacatttggctcaggagggaaggttatgatcaatagcacccaaattgccatgacacaaataaagcacacaggtagcgcaatcataaaccattcagcccaagatggtgaagggtccattataccaatagaaaaaatgttttgaggagaagcgatgggagaagacataccaccgatattggaggcaagagcgataccaagaattagagctttggcataggaacaatttcttggcagtgttctgagcaaaggttgaacaattgaatagcaaagaacgggggcagcaacattagaaacccacatggaaacaaagagcgccacaaacatatttgttaaaagaataaaatgtgggtttgtaccggcggatgccaaaatatgcgtagaaaggactttggcaatgttgtacttggaaagggcggctgctaaagtaaacccacccagcaaaagcatgatgacactcgaccacatcgttgataagatgaactgagaggaatcacggggagacattggttgggaggtgatagggtccttgataacagggaacactacaataagcagaggaatcattagagaagtcacgaaaagggggatggtctcagtggcccataataaagatgcatatattaagatggcgaaacagtttttctgtaaggaatcctgcgtaaaaggagtcaaattaaaagttaataatgcaatgaaacatgaggtgattaacagaaacttcagcagggaagtttggcccatgataaattgcaaccattgcttgggtggtaaatgcatgagttcacggaaagttagggaatccgttgatggagcgatgataccggcgccaccactcgacattgccatggattcagtaatgttggcattggggcgcaattgactggaactcaactttgaaaacttcttgttgtcagtcttggcagattggtactttctctccaaattcatcatatctttccaaacggtgtttctttcccaaactacgtgatctctcaaatgagaggataattcacgctcagcatcctggaaatcgaggacttcttgtctgttgccatcttcgtcttcttcattaccgctgctgttttcgtcattgttgattcggtcagcgtccaagttaaacgtattagatggtcgacgcgtgcccttgttcaagctagcgtaagtgaggatggtctcggtaatgtgatgctgaatcctatttattgtagcaggattgaaaacatgcgaatggaatttgatatagttcaagtagttctgcttcaagttcgtatttaaggacttgtcaaatttcttgcagatcttggagaacccggtctggttcaactcaataaagtccttcaactcggacaactgggtgtagatcgatatcaatcttttctttaaagagagcctatgttgggtaaaaggagaaagatacacagggttagagttagaaagcgacactgaagcggaggccaggttttgcattgagttaccattattagtcgtgttcgagacctgcgtgtggatgacgggtgcagagtcaatcgacatgtctgtcagagaggggttggagtccgtggaggagacactactaaaccttctttggcgttgttgtgacttagacttcctgtttcttgcaacactttgcagttgatgctgttgctgctgattaaacaattgggtggccttgttcgtgttttccagttccatgacatcgtccttcaattcgttgtagttggcgataagacctgtttcttgagatatgtagaatttatcaatttttttcaattcttggtttaaggcagcaacaaatttagagatgtagaattgatcatctggagaagcatctgccaatagcggcagattttcatcgttggcgtcatgtggctccacaacatggtgcttattgttactgtacagcttatctttttgcaaagaatagatcaattttttcagctgcgaataggccagatacttggtagaccattctggtacagaattgaattgtaaggaatgcgagaacttcatgtcagtctgcaagttaccgtgtcaccttcacagttttctttttatttgactaagtaaaaaaagaaaagaagttatttttactaagattttgagcggcatttttcctagttacttatcaattttcatacatgcaagacatactcaatttttttttttttttttcagttttaaaattagtcctgatcaaaaagccatcacgtggatccccgaaaaaaaacggatccgggtaaccagaagtatttttttcaagggaataaaagttaccctaccaaaataaaaaaattcaagtagggtaataaagttccaccccccatcaggattatcgttctctgacatcacccactctctgctcgctctctgctcgctctctgctttctttccccacgccggagtgattaaggcggataggcccacctgaacacctcgctcagaacatcagcgagagttccagcccctctaccccttacctctcgccgcccctcatttcggatcaaaagcaaaagaacaaagggccttcgcagaaacggaaggtttcgacccctcggtgccgttttaatttctttttctggccagttaagctttttgactttctcgaatcagcccagtgcaaaacagtacgcatacgagcacacaaatgtatatatatgtgtatgtatatatgtatataggtatgtgtgtgtacatccgaagcgtaaactaatgatctgcaagtttcagattttttctcgaaaaatataactaataaacgttccatgtcgtccacggatatcaagccttgtgccgtgaacatccctgtttccgctcacatcaccttccactacaagtcgatcgcggacagaagcagcagcaggagcagcagcagcagctcctgctcctctgctacatctaaagcctgctcccccagaggcagctccgtcggcttaccgcctgctttatcaactgacaatgaaatcgtcgagactgtacttaatgtttccgctcccgttgtagcagaccctacgcggccctcattgttcaagagtaactacaccgcagcctcgtgcttgacttctgacccaacctcgccgtcactactgccctcttctaggcgcaactctgtattgccggcaagcgacttccaccaatgcgcgcatcacaaaaactttcaaagaagggccagtgagccacaactgccctccttcgataatcgctcgtcgtccgagatgaaaaggtccgtctcgtacgcccagcatagcatgatgttccccatcagtgaccaacaggagccgcaaacatccgcgtctcctaacgaccactcagacccgtcttgtccttgcaacagacatcaccacagaagaaactcggtcgccgtcaagtttgacaaaccattgtatgagagactagagacgtagttatccattcgtccatccatctgtctatcgtcacacagcatttcccatccctcctctatacatacatacatatacagttctgcgtggtctacgcagccatgtatatatatatttccgtcgttttatatattcattactaaaatcgacaatgcattttttgccgctttccatttcctctactttgctcatcacttcgctcgaagaaaaaatgaaaaccgtcttgaaaaacttttgctatttcatccatccaagccacaccaaatagcgcagtcacacagagatcatggttacatatgctggaaaactggttctagctccaatggtaagagccggcgaactgcccacgagactgatggcgctggcccacggtgcagatctcgtctggtccccagaaatcatcgacaaaaagctaattcagtgcgtcaggaaggaaaacactgcactccaaactgtcgactacgtcgtgccgtccaaggttcaaacgaggccggagacgctcgttttcagaacatatccaaaactagaatcctctaaattgattttccagatcgggtctgcatccccggctctggccacccaggctgctttgaaagtgatcaacgacgtcagcgggatagatatcaatgcaggctgccccaaacacttctctatacactccggcatgggctctgccctcttgcgcaccccagacacactgtgtctcatcttgaaagaactggttaagaacgtgggtaaccctcacagcaaacccatcagtgtgaaaataagactcttggacaccaagcaagacactctacagctcgtcaaacgtctgtgtgccacgggcatcacaaatcttacagttcactgcaggaagactgaaatgagaaacagagagcagcccatcacagattacattgcggagatctacgagatatgccaggcaaataacgtgtcgttgattgtgaacggcgctatccgcgaccgctctcattttcatgatttacaagcgaatcattggaaaaacactaacattggtggtatgattgcagagtgtgctgaacgggaccctacagtttttgatcacacttctaagccttcagaagacggtccatcttgggtcgttgcttgtcgcgagtttattcagtgggcaacgaagtttgacaaccacatcggcaatacaaaatacatgttaagcagaattgtccccggaaaatcagtcttttttcagtactttgcccgttgcaagagcccggaagaagttagtttcgtactaaagcaattgaacgatgatggaagcgctcaaacagatccttcagagtacttggaaaactgcagagctcaagaaaaagctttgaaaaacgccaacgccatcgccaagcaaaagaggaaacagaccgatcacataggcagtgacactaaaaagcaaaaggttgtaccccttcccacagatatataatatattctaagtaaaaagaacggattatgaaagaaaacgcgcataatatatatatgtatgtattttctaatttatattagcaactaaattaaattacatcaatactattttttttttttactttacaaggtttatttcaaagtcttcaacaatttttctttatcatcggtagataacatcttgataacttcagataatccatcaatagcattgtcatggtcgcttctgatctttttagctaagtcttgagcgaatgactctaatttcaaaccctttagtttatcgtccaaagttttgtagttttcttcaatccatgttgcgacttgcctatcatcttcatggtccactgaagcagggtaccacgatctaattcttgcgatcttttctaatcttgatgcttcgcctacctgatggctcaaccttttaatcaaatattcttcgttcaatcttcttctcaatctccagaagaagaaacgacgtgcctcggtccattccagttccttagaaataacacccttggccaccatacgtgaagacctatcgtgcaaatcagcaaattgaagactgatttgtccgtaaattggcaatagttctctctcacgatcagctaattgcttggatatttgctgatgtacttctggagccaaactcttgttggataattgagatctcaattctctgtacttgtcatccaatctgttcatggtgtccagcaatttttctctacggaacttgataccaaccataccttgtggttccaaaacaccagctctagcgttgacgtcggcatacatttccatttggtcagcgttgatagttggatcgacaacaacccatgaaccacctcttagttcaccggtaggtgggatatagataataattggttgtttgtaatccaccaatgcgtcaacaataaacgaaccatacttcaagacttcgttgaacatatcacgttgaccaccagagaaacctctccagttggccaaaatcatcattggcaattgttcaccgttgttaaagtcattgatagcttgagcagtcttgaaggcggagtttggatgccaaacttgaccaggttcttgaattaatgtttcagcactatttggattagctggatcagcaggaatcaagttctcgacagttcttgtttcaacaccaataacacccagtggaataccaccaagacgggctctaccaacgacaacacctttggcccatcctgacaaagtttcaaagaaagaccctttatcaaacaaaccatattcaaatccactttcagtctcacgaccttcaatcatccatcttacatcgtaagtttcatcattagttggagtgaaatcaactggtctatcccatgtgtctttagtttccaagataggaactggcatattacgcttggctggaacataagacatccattcaacaatcttctctacaccagctaaatcgtcaacagcagtcaaatgtgaaacaccgttgttatacatgatttgagtaccacccaattgtaagttagaagtataaacttctctacccagcattttgttgattgcaggagcaccagttaaaataattggctggccttcgacctgaatagctctttgacccaaacgaaccaaataagcaccgataccgacggatctacaagtgactaaggtgatagtgaagatatcgtggtaagcccttgacgttgcaccagcaattaaaccagatccacgtagacattcgacacctaacccatcttcagaaccaataattgtcttgatgacaaatctttcttcaccgtttataacagtacgttcagtgagaacagaattttctttgtcaaatttctttaaagtttccataccttcacttgttaagtataagtattggaagcccttgtccggattggcagcatcattccatgcaacttgaaatagtggaacaatctcttcagccataccaattctggcacctgagtttgcagccaagtaaattcttgggataccacgctttctagcatattcagtaaccttattgaagaattcgtcttcttgtggaccaaaggaaccgatcttgaatgtgatatcgttagcaacaacaacaaattgacggcctcttggatattcaggagtctttacagtaatcttaaaggcaaccataccaatagcgttggcaccaggttctctttccacctcagttaattcgccgttttcatcttcaatcaactcgttggaaataaagaaatcatctgttaacttaacatctgcagagaaatttttccattgggatgacgatgcttggcggaataattctgggaagtcatagacatatgtggtacccatcaagtgtgccttataacgttttggttgcaaccattccttaacagggtaaggagtagcaataggtcttaaatgcatggatccaggtttacccaaagacttaaatacccattcaccttttgcgttcttgacttcggtgtacatttctgttttgataacataaccagaaacgttattgatcaaggcacgcaatggtactggggcacctgtttgaggatctttgatgatgattctaatttcggcagaagaaacacgcaatctcaacaatctcttaccaaatctttctaagaaaccaccgaaggcggcttcgacatcttctggagagatatcaaacaccgcaatgaagttgatgaagatatgattcaaatcagaatttgaagtgtcggtgacttctaaattatccaatatatcactcatcaatctgttagcttcagaagtcagatattcttgaatagaaatgtcatcacggatatgacccgttctaataatacctcttgtaaagaatctcttatccaatggagaagtcttactaacagcttcgtagacatggatgtttctattatcagtgaaaattggtttaatgttgaagttggacaatcttcctaattccagttggaaggccaaagccggctcaatgtgacgaattgtttcattttcgttataatttggaccgttaaaagtataatactttggataagacccatctttaaaaccgaacataaatgtgatacgacggatagaagcattgattaattcctgcttattcaaatccaaaatttctctcaaccttaccaaaatttcctcttcagattcgaaaccttctgtagaagcaacacaaacattagcaacattactcaacgatgcggagctaccagaacgatcaggagcaggtccgttagaagaagattggtgacgaggaataacttccaaactttgtgacaaaatttcatcaacatcatctaaatgatccacagccatcaaaataccttctcttaacggagatgactgactgtttgcaacatatgacaaatctgaaacagaaacagccctgttcatacccattttagatttaacagttggaaaggtggagaacgcagctgaaggtagttggaatttccattcaacaattggaactgtgacaccttcgtgaactctaatatctcctatggtgtaagcacgataagcacgacgaatatagacttgagcagctgcagcagtcacaactgggtcttgatgggttaggaattgaagtaaaacatcgaacacaacgtaattagaatcgatcaagtccttcaagatattcaaatctggttcagagcgctttggattggatgagccataggcaaccttcacaacagaggattttaagatatgttcaatttgttcagttctttccttgaccgaaggtaaagcgccttgaatcaaaatttctcttgcttgtagagcgaccttagcggtagccttagattctagttcaacaatatgttgtagaggagtagagaaaatggcagaaactttagaagataacttgcacaatggttgataatgtttcaagatagctaggatcaggttattcttcgctgaaactttcgaatgagacaaaacagttagcgcaactttatctagatctttagggttttcatcacgcaatttcagaatgatattttcctcacgaacatttggaccattgaataacttttcaacttcgtaatattcttccaagaaatggacaaatatagaatgttcatgggcttctaacccgttagagtacttatgagcaatatccgccaatggttccacgacggcgcccagcaatttgtcggggttgtattcaggattcttcacggccatatcaatcaatttacttaattgtctagctgggaaaacagcaccacgtctcaaagaacgtgcaactaactcttccatttgttcatctagcttagcaggcaatcttgaatgtaaagcagagatgtgtagtttccattctgagtaaggcagttttggatttctcaaaacctctatcaattgttgcaaggaagcgttcataataacttggttgtcataacccttcaaaatgttttccaaagtagacactaatgacttgaatttataggcaggtttggttccttcgataactggagaaccaaaatctggcagcataccttcaaatggtagagcgtgcttgaccttggatggatcgtcaagagtcataatagccatgatatcacctgcaacaatggtagaaccaggttgctttaataactggacgataccattttcttgagaaaccaaaggcatttgcattttcataacttcaatttctgcatatggttggcccttgataatgtgttcaccattttccaccaagaatttaaccaatttaccaggggatggagtacgcaactgggttggatcgttttcaacttccaacaaagtagtcatagagtcaacggataatcttgtagcagcaacttcttctttccaatagatggtatgcgatttaccgcctatggcaatcaaaagaccaccatcagatagttgacgcagtatgatatcacatttagaaccattgataaataatgtgtaacggtcattaccggatttagctacggtgaacttgtatcttttaccctcatggataaaatctacagggaacatagtttgcagtaggtctttagatagaacttgtcccttttgtaaggattcgatatacttgtggcgggcttcttcagatgctaagaaagcctttgtagcggcaccgcaaatgacggcaagagttggatcaggcttttcagcggtcattttatgagtaatcaaatcgtccaaccaaccggtggtaatagtgttatcctcgaaatcttcagtttccaaaagtttgatcaagtattccacagtagttctgaaatcacccctaatggacaattccttcagggcaacaaccatgtgtttcctggaagcttgtctattttcaccaaaagcaaaaatatggccgaactgagagtccgaaaaggagtgaatattaccattgttacccacggagaagtaaccccaaacattagaggaagaacggaagtttagttcatgcaaagtaccacccgatggcttgaatccatcgtttggatcttctgatgtgatacgacaagcggtacaatgaccctttggaataggtcttctttgtttcttggtggcatcttgagttttgaattcgaaatcgatttctgaggcagaatgaggattcataccatataaagttctaatgtcacttattctatgcatagggatacccatagcgatttgtaattgagctgcaggtaagttaacaccggagaccatttccgttgttggatgctcgacttgtaatcttgggttcaattctaaaaagtagaattttccatcatcatgagaatatagatactccacggtaccggcagagacataaccgactagtttccccagtctgacggcagccttttccatctcgtgaaatgtttcagccttggcaattgtaactggtgcttcttcgataattttttgatgacgtctctgaacggaacagtctctaccgaacaaggaaatatttgtaccgtactgatctgctagcagttgaacttccaagtgacgcgctctaccggccaacttcatgatgaaaatgggggagcctggaatttcgttggctgcctggtggtataaagcgatgaaatcttcttcacgttcaacttgtctgatacctttaccaccaccaccttcggatgccttaatcatgacaggaaaaccaatacgcttggccttttgtaaaccatcttcaggagaggtacaacaacccttttgatagatgtcatcgtcgacagagaccagaccggttttctcgtccacgtgaacggtgtcaacaccggtaccagaccatggaatacatgggactttagcactttgagcgacaatggtagaggagattttatcacctaaagacctcatggcgttacctggaggcccaataaagatgactttcctcttagactgggacaatttttcaggcaatagtggattctcggaggcgtgaccccagccagcccatacggcgtctacgtctgctctttcggcgatgtctacgatcaagtctacgttagcgtagttgttattattagtaccacctggcacttcaatgtattgatcggccatacggatatattctgcgttggcctccagatcttctggggtggccatggcgacgaattggacggttctgtcatcgccgaacgtctcgtatgcccattttctgacggatctaatttctttcacggcggcaataccattatttgctatcaggatcttggatatgaccgtgtgaccaccgtgactcttaacaaagtcccttaacggggactcctctagtttatctactgtattgaggccaatgaaatgacctggaagttctgtatgtctttctgagtagtttgtaatttcgtactccatcttctgtggagaagactcgaataagctttcttcgctcatggtagaaacttgattttttctaattttctgcgctgtttcgggaacggaaaaaaattaagctagaagacgaatcggttattatactattatatttgtatagtatagtagcgtgtcgtatcgtatcgtgtcgtatcgtatcgtatcgttaaaagaaaatacacgaataaataataatatgtggagaagaaaaagggaagtttcttgtctcttgctctgaatctgaattccaattcaagttcaaattgttctctagtttattgtccaaaaataaggatgaagcgggagggaagggcagagggaaaagttcgtatagtagaatgaataaacttttataaacacatgcaccgatcactcacagaggataaaaaaatggcacaacaaatatatatatatagatgcaaatggcgattgcaaattagggaattggctttgttgttttttatcttcaggtaaactgtacgaaagggataaaaagagtagaataaggaaaggaaaattgaagagagcagaacaattgtagaaccgataacaattgtgacagtgattgtgctaggctatactgtgccagaatacgactgggagtgctgttcttcttatatatcttggcgctgattgagcgtatagcctagttcaccaagcagtagagagagtggcaatgagcggttgaatttcgactgcgacttgttggcacaacgcgcgcgcggccgggccatgtgaagattttaacgggcgcaacgattcggtgggcagtggaaattgttgggcgttgttcaacaagatgaagcattcccctttggataacgtcaacgcatatcgggccaacctacaggcaatgagcgaaagcgactgaagccgagagatgtgcccggagtttgttgttcttgttcttgttcttgttcttgttcttcttgacggatgatactagtcgcagtcgtggtgactctggagggcgtaacggccgtgatgcggcctgagctcactgtgacgtcgatgcatgcgcgggttcgttgcgttcaggcctgacgggcgattccccaccaagtataagtgtcatgatatacgcggcacctgagcagcacattaggtcccaattcaacccaacatatataatggttctgtatgggtattttaagtgtgcaaacaaaatgtgagttacccggctgtttgctagtcgctgcgtacgaactggcttgctaaagctgggtaaaaataatttaatcgcaaaaggaagaaaaggaaatcgacgattcattgaaaaaaagagaaaatactgaaaaaaaaaagacaccgacaaaaaaaagagagaaaggaacctttacgtagagcaaaagggaaacatttgttgcgtttaattaatagaaataataggttattgcattcgccctccattgcagaaaaaaaaaaaaaaaagaccattttcctcttctactctctttgcctgtacatactacacgttatagcgttaacaaaagcagatagaaaaaaaaaaaataaccaagataatataggtatacttgtttaacagatcacacacaatcatgtcgtggctttttggagataagacacctaccgatgatgcgaatgctgccgtgggcggccaagatacaaccaagcctaaggaactatcgttgaagcagagtttaggtttcgagccaaacatcaataacataatatcaggtcctggtggaatgcatgtcgacaccgctaggctgcatcctttggctggtctagacaagggtgtggagtatttagatctggaagaagaacaactatcctcgttagaaggctcacagggtctgatcccttcccgtgggtggaccgatgacctatgttacggtaccggtgccgtctacctgctgggacttggtatcggagggttttctggtatgatgcagggtctgcagaatattccgcccaatagtcccggaaaattgcaattgaacaccgtcctgaatcacattactaagagaggtcccttcttaggtaataatgcggggattctcgcgttgagctacaatatcatcaattctacaatagatgcactaagaggcaaacatgacaccgcgggctccattggcgctggggccctcacgggcgctttgttcaagtcttcaaaaggtttgaaacccatgggttattcctcggcaatggtggccgctgcgtgcgccgtctggtgtagtgtcaagaaaagactacttgaaaaatgagcaacacaagaacctactctctctctctctttctctctctctctccctcttcgcttttcccccatgcactgatggcgcttgtatatagcatttgaaaaataatagtacgtaacgcagaaaacaaaccaatgaaagtagaaacccggagaaaagatctaaaaaaacaaaaaaaaaagatggaaagagcgcatgtatgtgtagatatgtacatatatacaactacttgtatgttatttgccttttgtactgttaagctattgttttcgatggccaattaaagtaaaacaaaccgctcactctcgggtatttcccgaaactgtcagagccgtcccggcccaccgattcgcccggcaagacctgcttggaagcagcacaaagccctgcggcctctgtacacctcacgctaaatagctgctaacgatcaacacctgaccgagataacagcagcaaagaacccgcaaaaaactgcgccgtctaggcctcaacccttgcttcctacaaccaaacaatggtaaaatatacaaaaaaaagaaaagaatgctctttcttatttcccttttaacctaaccatcttttgttttttgtcgtttaacctggaaagaatgttctattatataaacactctttactacgtctttagcttgaaaaaactcttgacaagtgcaccgatactcaccaacatcgcacaatgaagattttaacccaagacgaaattgaagctcatcgctcacatacgctaaaaggtggtattgaaggtgcccttgccggatttgcaatctctgctataattttcaaagtcctaccaagaaggtacccaaaattcaagccttcgactctaacatggtccataaaaaccgccctttggatcacccctcccacggtcttgactgctatatgtgcggaggaggcctcgaacaatttcgacgctacaatgtacggatccggttcctcctcggaagacgcactagatgagcacagaagatggaagagtttgagtacaaaggacaagtttgtcgaaggtctatctaataacaagtataagatcatcaccggtgcctgggccgcttcgctgtatgggtcgtgggtaatcgtgaacaaagaccccatcatgaccaaagctcagaagatcgtgcaggcaagaatgtacgctcaattcattaccgtcgggctgctgctggcctccgttggtttgagcatgtacgagaataagttacatcctaacaaacaaaaggtcaacgaaatgcgccgctgggaaaacgcactgagggtcgccgaagaggaagagagactcgagaaagagggaagaaggaccggctacgtttctaacgaagaaagaataaactccaagatcttcaagtcgtaaacctcgtcggtttatctgcctcaactttatttccgctcctcgtcttttataaaattcctttcatcaatacatctatatattcgaatatatagataaaccaatacaaaaacatactgaaattttttgaaaacaactaaaactattcattgcagttacacgtgaatgctaaactttatatcgctcttgtcggtcccgcggagttaacatttaacggcttctcgcgcaataaccggaaaaattccaacagtttctttgtaatattattaagccttcttttttcccggaatctataagaggggacgaaaattagccgctattaattctggtattgccacctagacaagaagtaaacagacacattacgttagcaaaagcaacaataacaaacacaaccatggacaagaagaaggatctactggagaacgaacaatttctccgcatccaaaagctcaacgctgccgatgcgggcaaaagacaatctataacagtggacgacgagggcgaactatatgggttagacacctccggcaactcaccagccaatgaacacacagctaccacaattacacagaatcacagcgtggtggcctcaaacggagacgtcgcattcatcccaggaactgctaccgaaggcaatacagagattgtaactgaagaagtgattgagaccgatgataacatgttcaagacccatgtgaagactttaagctccaaagagaaggcacggtataggcaagggtcctctaactttatatcgtatttcgatgatatgtcatttgaacacaggcccagtatattagatgggtcagttaacgagcccttcaagaccaaattcgtgggacctactttagaaaaggagatcagaagaagggagaaagagctaatggccatgcgcaaaaatttacaccaccgcaagtcctccccagatgctgtcgactcagtagggaaaaatgatggcgccgccccaactactgttccaactgccgccacctcagaaacggtggtcaccgttgaaaccaccataatttcatccaatttctccgggttgtacgtggcgttttggatggctattgcatttggtgctgtcaaggctttaatagactattattaccagcataatggtagcttcaaggattcggagatcttgaaatttatgactacgaatttgttcactgtggcatccgtagatcttttgatgtatttgagcacttattttgtcgttggaatacaatacttatgcaagtggggggtcttgaaatggggcactaccggctggatcttcacctcaatttacgagtttttgtttgttatcttctacatgtatttaacagaaaacatcctaaaactacactggctgtccaagatcttcctttttttgcattctttagttttattgatgaaaatgcattctttcgccttctacaatggctatctatggggtataaaggaagaactacaattttccaaaagcgctcttgccaaatacaaggattctataaatgatccaaaagttattggtgctcttgagaaaagctgtgagttttgtagttttgaattgagctctcagtctttaagcgaccaaactcaaaaattccccaacaatatcagtgcaaaaagctttttttggttcaccatgtttccaaccctaatttaccaaattgaatatccaagaactaaggaaatcagatggagctacgtattagaaaagatctgcgccatcttcggtaccattttcttaatgatgatagatgctcaaatcttgatgtatcctgtagcaatgagagcattggctgtgcgcaattctgaatggactggtatattggatagattattgaaatgggttggattgctcgttgatatcgtcccagggtttatcgtgatgtacatcttggacttctatttgatttgggatgccattttgaactgtgtggctgaattgacaagatttggcgacagatatttctacggtgactggtggaattgtgttagttgggcagacttcagtagaatttggaacatcccagtgcataagtttttgttaagacatgtttaccatagttcaatgagttcattcaaattgaacaagagtcaagcaactttgatgacctttttcttaagttccgtcgttcatgaattagcaatgtacgttatcttcaagaaattgaggttttacttgttcttcttccaaatgctgcaaatgccattagtagctttaacaaatactaaattcatgaggaacagaaccataatcggaaatgttattttctggctcggtatctgcatgggaccaagtgtcatgtgtacgttgtacttgacattctaaggcatcctgcaactgttctgtggagctattaaatctttatagtaaatttttttttacttttttttttttttttttttttttttattatttacaagcgtctatatattttctattatagaatattgtcatttattacattggttcatctgtaaatctcatcaaacggtctcgtatcggcgaagcaactgtcccaaacttcatctacaatttttgctgcatgttctttgctttggcagttggggttccccgaaacactaattattgccctccttctaacacaatcttggtgtccccttgccacatggaatcctgtcctaaaccctcttctcttgaactcttcccaaaacctgcattccccacttaacgaagaggctctgatttcagaacatgcatgatgcttcagatttaaccaatctatttgccattttagatcatcgaaataatgaattaattcatgcgaaagcgtatcctctaaatgccacttatcacgtaacctgttctggcacaataggattcccaattcaggatgaaagccaccgcccttccagtcgggacagtaatcgcagatgatcttcgaatcgtcgaatttactgtcgctacccttattaagtttcgtaatagcttgtaccataaagcgaactgtgggagagtatttaagcatccaatctcgatactcataacatttcagacattccttttttagttctcgagctttagagtcgtcttcgtatcgagttttctcctccggtgtcaagcctataccagtcttgtactgcatggtccgtctccaccactcaaacccagcattatccccactgctattcatatcgtgccaaaaaaaaaaaaaattcggtactatcagctttccttggttttggttgtacaaattatgccttactcttctgatcattttgatattagaactcttatttttcttatttgttcgcatcgtcataaatgataattggcgaaaacgcgccaaaaagtgaaaaagtgagaactacttgaaaaaaaaaagtttgatattataggtattattgctcaaataggtacgatattgttgtaggcataaaaattagattagcagaacccttttccatttcattaacatgtctagttcaatatttggcccacttacgggttttttggagcgtgtcaattcactcaatgcgccctaccaagcattatcatatgacgaacaaaaggccatgactatttggcaaagagtcaaattctacaactggacttttgaattgtgtgctctaggtgtgttgttcttggtttatgctttctacaaatttggtaactccgttaatttgaagcgcggaaatcagattttccaatctttgcattcatttttggccaacgacttaaagttctcccgtgtagggttcaatatcaatgattccaaaatctttacagtggaacaccaaaatacatggttctcttcttttgctaccggtagatccgccatcaagagcatcaacctaaaccttcatctggtagcccgtagcaaccctttctctatgtgtctagagtacctgcttggatttttttttgcaagtttgaaaagtaagcaattggaagaatttatggagatcgtgatcaggccaaatggtattttagttactagtgaatctgctcatcctaacaagaatgcgcatgaaattttgaccaaatttagatttgtcacttctattgttaacaaagaattcatgaatcaagctagaactgaaaactatttcctgtctattgcacacactagtgaaaacgataaactaccaaataacttcgtctacatgtccgatgttaatcaattatcagggttcatgtttcattactccaagccctatgaggttttgtcccaagctggtaatcttttgaaatatataagtttcaccgatttgcctgtcaacccgccacgcgatgataaagaatgggaatcttcaattgaaccaaaggctatcattcgttgcgctgttccccaaaatgagaatgaattgaagttgttaaaccaaattatttccttagtcgtagaaatctacgatgggttcactcaagatttagtccaacagtctccaaacttattcattaccaacgacatcttgaaaagaactaccaacttgcgtcagcaagaactgaacaagatcaaaaagtttatgaaagaaactgaattggaattggcaaaggagaagaaattagaattggaaaaagccaaaagacgtcaattgaaggcctctggtcaacaagaaaaggtagatcaaaaaatgaaagagaaaagagaaagacgtctcaaaaacaagcaaagaacaagatttcagtaagaaccactttgttcttctttcctccttataattttctgaacctcttcagtttttgtatacgaacgttttccatgtatccatacatttaaatagtaagtatgtaaattggtatgtggtgttttgaattgcgatgttgcctatatacaagattgtacgctatctgaatacatactctttaccaatcaaatgtcaagaccggggatcttaacctcttcgatagtaatcccagaatccaataatcccttcttttcctcttttggcttctcttctttcttgtggccaaaaacagattctttacgtaactccatgttcttttgaacttccgtttcatggcgtttagagagctgttgatggtcttcctctagctttgcctcaagtgtttggtattgttttaacagttccgtatttatgtcgtgttcttcgctgagtatgtattttgcaccattgaagttatgtaaatagtttctcattaaagatggtttgacatttgcaacttgtcctttatataattgaaatcgcgggaaatccttcaggacttgaaccttgaccctgtgggttctctttgtcagagcgctcagacacacctgggtgcaatgtagcatctttggtcgacctgtttcgttcgttatttagttagccttttatattccttacggtataacgtaacttaactgccctttgagtttgctttttcatcggaaagaacaaatgaactaaaaacttgcaataataaacaaaaaaaatacaaaataacgtggatgtattaaaccaaaaacaaaataagacaactctaaagctgtcaaacagagatctaacggattgaaccatgtccaaagtaatgaaacccagcaacggaaaaggttctagaaagagttcaaaagcagccacacctgatactaaaaatttctttcatgcaaagaaaaaggatccggtgaaccaagataaagcaaataatgcttctcaaattacgccaacagtgccacattctcatccatcagatatggttatccctgaccatttagccgaattgattcctgagctgtattctttccaacaactggtggattccgagaaaagattagatcattttattcatctgcgaaacttacatatgaagcgaatggttgcgcagtgggagaggtcaaagctatcccaagagtttctttatcctcatttaaattttccaaatgtaaaatttctccgaatcttcatttcaaatgttagtgaaaaccaaccctggcaaatggacacaaacaatgaggctgaccttatggcactggagaatgccacttggacgatgagaatcgaaggtcgattattggacaatgtgcaagctaatgatccagcaagagaaaaatttagctcattcatagaatcgatagtggtagacttcaaaaataaggaaaacgataatgtgccatcgactaaatttaatgcggcccctgaagaaaatgccaccgaaggacccagtgataagaaattgaacttaaacttaccgttacaattttcactgccgaatggtgacaactctactacgactaataccgaccaaaataatgccacgatgggggaggagactgccaaaaaggatatgagttctacaactccaaaactagaatcagtgaaatggcagtatgacccgaataatcctgtagacttcgatggtctcgatattaagagggtagggtctgaaaatgtagaatgcactataagcatcctgcgaaaatcatccccagaagagccatttatgagctactctccacaactaaccgcaataataggattgaagagcggtacatcacatgatgcaatattttccatatataaatacatccatttaaatgaattgcttaccaatgatgagtctgcattcgaaaatttgatgggcaacaggaacaatcacaatagcaacaccagtactagtaagatgcttgatgcagcctccagtcaagtttctattgtaaaattagacactcagcttattaccttattacccagcagtcttaaagaatcttctccagatacaatgaaattaacggatttactgtcccttattaatagtactcacctgctcccattacagccaattgaaattgattacacagtacgcgttgataaagcttccacttatggtgagttggttcttgatattgaagtacctgatgtcaacgctctaaaattcaataatacacaaagagaaagtcaaattggggctgctgaattgaatgaaaatgccagggaattggaacaaatcaaacccaagatagctttacaggacaaagaaataacgtccgttctctcgaatctacacgagagcaacaaacgataccgtttcttcaagaaaattagtgaggacccagttaaagcattaaatgaatgcattgcttctacctcgaatgctttgaaagttttatcgggagatgagggctataatgaagatatggtaaggcgggctaacttttacaaggaaaatgaagctatgttgcgcgagaatatagaagtcatattatcaaatggacgaatgtaggcttctttacattgatacacaatagactgaagatttatgtagttttctttgtatataaactctagataggaaaagaaaggtcaccattcatttataataattaaagacgaacagacaatgctgatttgtttatagcgcctacaagtaatggcggctgtctgattccattgtctctttctaagaaaagcgctgaaaattttctactggaaatttcagaatatgaaaaagtagtagagatgagggccacttaaacacaataagcatataaggaaccaagggaaaagcaacaaatgagtgctaacaatggtgtcactggcaaactctctagtagagtcatgaatatgaagtttatgaaatttggtaagacggatgacgaagagagttccaactccaatacgccgtctaatatcaactcagatgtggaacctatagagcagaaaggtaaactctttggtctggatgactcagcgtgggacctcaatagctacaaagatgatttaaaaaaaatttcaggtaaggagaagaaaaaggtgaaaagagtagtatataagaagcgacccaatctcataatctccaacgttggttacagtgaactgcgaaaacctgagggtgtgataagtgggagaaaaacctttggcgataattctgatgatagtggttccaggaagagaaagtttgatgaaggcgaacaaaatgaagacgagaaaagggatgctaaggataaggaatttacagggagccaagacgatggagaggatgaatatgacctagataaattatttaaggatagcatcaaaaagaaaaagaccaaccataatggtaaaaataaaaatagaaattcaaaaaagtagcgcagacaatgcaccagcagaagtacgtattcgtatataataatgagaacataatataaagcattgtgtagtatttttttcgtatttgtcataaaccataaggactgccgtcctttctattacgctcaattccaaaacatatacaaaaacatgtaaatacaccacttctaatttatcagataaatctctatcatcaatatcattgagatcgtttttgtatctttgcgttttttttcatagcttgagtgtcgtcactctccttttcgctacttcattattgctacctcataactttctctcaagctcaagcatcatctatttctcgaaaagttgcgttggtgatctcaaactctgcccctccagtattaataatgttactttcagtacataagacttcagttccattcacagaactcgtctcatgcacgccatgcacttttatggaatctacgctaggtacagatgtttttgtaccgtggttgccaaacaaagttgtttgatgtaagtcttcatcaactacgtagggcgaagagatggtgtctcttttcgttagaaaattgtccttcgcgtaattgaaaagcatggaatgcaaattgtgcttataggagaactgtaaaatgtaagaaagcagcacaataaggatgaagttggtgaaaaatttagagattttttgtttcattgaggtgtagttggcgtagttaagcggtaattttattatgtggatagtgttggctgccgaaacactcgccacatatgtagagtccggagagatagtgacctctgtaatggcaaaactatgagcttgtttgaatattttagacattgacaggtcttttagtttcacaagagctatggaattgtcattacttgccagtaccgccaattcacccttcatgtcgacatccatagaagtaatccctttgaatctgtttgtcacttgtttggatcttaatacggaagtgtttcctgatttgatgcttattttggtcagcacaatacctttccctttttttaaagaggctgctatcaatactgtgtcatcggctatgaagtttattttagataaactccaattcttatcaaaatctgttttcctagcaatgcaacttccagtcactgttgaaatcacttccaagctagaaccggtgatataagcaacaaccttaccatcagtggaaaagtgtaaatcctttacttcacccctagtctcgatctcaaacttctctgtcaagtcgctcgggtcaatgattctcattatagcaggtactttagatgatgcgatagctgcaacggtaccttctcgtgaaatataaaccagcttcgtgtagtcatccgcatttgtagatgcgtcaaagtctacactagtgaggaactccaattgatcattcactttatcgtatttaaattttctcaagtgcttattacctttaccttgggtaatcttagtgctattttcattgcagccaaccaaaatgatacccttggaagcgtcaattgcagtaggagagtcgtcgttgtcttccaatgcaaactcgctcaatatatgaaactgttccttctcagtatctttggtaggatccacgcgcaagaccgtcagcttgtttggtatgccattgtttccttctcctccaccgcctgccacaagtaatgtgtcgttattcaaaaattttgcaccgtacgcaggatacccgacgttataactagctgtcacgaacttcatagtggctcgattgtatctcaaccttgttatatatctgtatttctatcacgtatccttctaggtttctgtacacgtttttgaattttttggattttttttttttcaacttttcttttttccctcattcttactctattgtcatcaccattcaagataaagataataactagctttgagaaattagaccagacgcagtggaaggttgaatacatgcctgtgtgagggtggtgccaatgaccagtacattacatacgacaaaaaaagtgctctccattcaatcacacgtcatacatggctacgtgggaaacaaggccgctacgttcccacttcaatacagaggttgggatgtggacgtattgaacacagttcagttttctaaccactcggggtacgcccacttcacaggcttcaaatgcagcactgaggagttggtagacattgtagagaagggcttgattgggtctcttagaatcaagtatgatgccgtacttagtggctatttacccaatgttcaagccctgcaaaaggtagcaggaatagtgggtcaattatgtgaggggagtgaaaacgtcaagtggatattagatcctgtactgggcgataatggaaggctgtacgtggatcgagaatgtgttgcggtataccaagacattttacaaaacttcaaaatttttttggccacaccaaatcagtttgaaatggaactgttggtggggatgtcaattcgtaccttagacgacgctaagcaggcatttaaactatttcataaaaagtaccctcgagtaagccgaatagttgtcactagtctggaattatctgaattcctgagcaacgacacttacgtagtagcagggtttgattgctcggccagtgaagagatattcttctatgaaatccccaagatcaacgcaaaatttagtggaagtggtgatttaatcagcgccatgctcactgactcgttactaggcgaccgccgctgcacacagctgtcattaagcgcatccttgggccaagtgctgtggctcgtcaccagtatcctacaaaaaacgtatgatttaaacatagctgagcggggcccacaagattccacgatagatatcaaggatttaaagctgattcagtgtagagacatcctaaagcaagatctcataccctccattggcaagccaaaaaccattaaaatatgattcttacgaaacggtatgctccttcctcattggggtgcggctgctgcaggaacctgcctaaataggaaaatacattcctgatttggaaactgtaggcacacgacgcgtccctttggagaagatcgatccttctttgggtctttcaatttgattggaaaaaaaatatttaaaaaaatagaagaaaaatatagaatatatagaatatatagaatcaactactgcagtagataaataaagaagactattcatattcagtatcacaattgaaagattattacaatttgtatacattggttcccaatgaagagcttttttctttatctttatgtggcattcatgtttagttgcataacggctctgccattacctgtggataacaaaagggcttcttcagactccttagacctaaagaaaaaatacgcaccagaccctcctattacacataatgtaaacatcggaattgttttcacagatcctgaaagttcggaagaagccggccgtctcataacaatagacttatacgggactatggtgcccaagacagtaatgactttttgccagtatgttgatagtgtaaaagatcgccttgcttcccgtcacagttactcgccagaacgcgattttgataaaattctaccgaatggagctatagaaggtagctccgtttcttcctcctctattgaagaaacggaaatgttggctccaaaactcccggaagaaaatcatagtttaattcatgataggccaggcagagtttccatgattaaggacgataagggtcttaagtttataattgagaccagtgagacgccacttgaaggtgaaagtgttgtgtttggccaagttaccgccgggttaaaagatctgatggataaactagctaatgtgaaaactgacgaaaatggcaaaccagagcaaccaataacaataggttacatttcatcccaggaacacaggattcagcatgcaaaggaagctcacgaaaagtatttacaaaggcttcaagattaccaaaacggcgatttggagaaaggtattacattgaagaattatttataccagggtagtcaaagaaagttagaagacgcaaaatataatcagcttcaccatcctttaccaaagattatgcttggtatttcggtattgttacttttctacgttttggccaagtacaggaaaagaatattcaacagatcgtctaaaatagtttctattagagaggattaaaatgtttcgatccatccgcttaatattcattcattttgtatcacatacatacgtataaatatacataacttacctcgtctttattatgccaaccatcattccagggttttacgtaacagttcctctatggattccttttctaggtacttcccaatcagcacaattttacactctttattggatccgtcatatttgcctggaaagacatcgtaggtgtcgcggacgccttggattacacgagcaatggggttctctccttcaataagtatcagacctttagttctttgtacttcccaatcacggccgtcatctcggcgacgccctcccagcactgtcatggctccaaaattcttccacaataaaggttgcaaaaattgcttaataaacttattattatattcttcctcgttttttaatggtctgaaagtaagcattattgtgcccattcgatcatcatgaatggtaccgtttccgctaccactatctaagatgtcagatatccgtacactgtcgtatgcatgaatatctagtaaattttgaatcggcgtatcactatacttggtgaagaacatcggtgcgatagaatttatttcccgtactctttcttttaattgtttgaccatttctggtgaatgttcgatagtatcgtatttgttcattataattcgatcagccatggctagttggaagtgtgcaatagtcagattcccctccaaaccaactttgtcaccatgccaatgggcatcgatggaaatatcatctaagcattttagtatatgctcacaatccaaaaccgtgatgatcccgtcaatgtaaacgctgctattcaatccttcgtcctgccagaacattttcgcaatgggggcgggatctgcaataccggaggtctctaaaaggatataatcgattttaccaggtgaacgctccaccatatcttcgatggctttaacacctatatttttcaacgaacaacacagacacccgttacccaaatccaaccattcttggtagctgttcgatccatttttaatggtcatagccttttcgatttcactagaatctccaaattcatttaaaattacggcaatttttttatctgcaccttttaatgcaattttttccagcaacgtcgatttacctgatcctagatagccggtaataatgctcacaggaatacgctttttctcgtgcacatctgttgcgcctgcagaagtgttctccacttgcttgtttaccctttcaacttttgcatcgctaacaatatttccaccatcatacgagacattttccaaaatttcttgtagattattttcttcacctgttacgaggcagggtagttcaccatcttcttcttcattgaacttgatgtttctcaatgcagacattcttccgctttaaaagttgaaaattcctcaatgaaaagggtgttcttggctttacaagcgcattaaacatttaatattatataatatttataatatacatgttattccaatagtgaaaaaaaaaaaaaaatgaaaatgaaaatgaaaaattcggcccttaaaaatgaacaaccttttaccagccggcattaaatgtcgtggcacttcacagtttataacgcaaggaatttactaatagcaagtgaaaccattaacgattagtgttgttaaaagagttgaataaagccattaaacaacgattcagttgacaatgcgttggtctgtccttgatacagtgctattgaccgtgatttcctttcatctaatccaagctccattcaccaaggtggaagagagttttaatattcaagccattcatgatattttaacctacagcgtatttgatatctcccaatatgaccacttgaaatttcctggagtagtccctagaacattcgttggtgctgtgattattgcaatgctttcgagaccttatctttacttgagttctttgatccaaacttccaggcctacgtctatagatgttcaattggtcgttagggggattgttggcctcaccaatgggctttcttttatctatttaaagaattgtttgcaagatatgtttgatgaaatcactgaaaagaaaaaggaagaaaatgaagacaaggatatatacatttacgatagcgctggtacatggtttcttttatttttaattggcagtttccacctcatgttctacagcactaggactctgcctaattttgtcatgactctgcctctaaccaacgtcgcattggggtgggttttattgggtcgttataatgcagctatattcctatctgcgctcgtggcaattgtatttagactggaagtgtcagctctcagtgctggtattgctctatttagcgtcatcttcaagaagatttctttattcgatgctatcaaattcggtatctttggcttgggacttggttccgccatcagtatcaccgttgattcatatttctggcaagaatggtgtctacctgaggtagatggtttcttgttcaacgtggttgcgggttacgcttccaagtggggtgtggagccagttactgcttatttcacgcattacttgagaatgatgtttatgccaccaactgttttactattgaattacttcggctataaattagcacctgcaaaattaaaaattgtctcactagcatctcttttccacattatcgtcttatcctttcaacctcacaaagaatggagattcatcatctacgctgttccatctatcatgttgctaggtgccacaggagcagcacatctatgggagaatatgaaagtaaaaaagattaccaatgttttatgtttggctatattgcccttatctataatgacctcctttttcatttcaatggcgttcttgtatatatcaagaatgaattatccaggcggcgaggctttaacttcttttaatgacatgattgtggaaaaaaatattacaaacgctacagttcatatcagcatacctccttgcatgacaggtgtcactttatttggtgaattgaactacggtgtgtacggcatcaattacgataagactgaaaatacgactttactgcaggaaatgtggccctcctttgatttcttgatcacccacgagccaaccgcctctcaattgccattcgagaataagactaccaaccattgggagctagttaacacaacaaagatgtttactggatttgacccaacctacattaagaactttgttttccaagagagagtgaatgttttgtctctactcaaacagatcattttcgacaagacccctaccgtttttttgaaagaattgacggccaattcgattgttaaaagcgatgtcttcttcacctataagagaatcaaacaagatgaaaaaactgattgataatagctaacgtcaattccaataaaatatatagcgagcgttttacattaatccacctcgactagacttcaaattttcacttttatatcttacctttataaatttctgttctcaaaatcaaaacaattataaaaaaatgctatcattaatcttctatccttgaattaacattatatactctccccccactacattatattttgattttacatataatacaacaaaccttctcaacttaactactctctttcctcagtatctgtagaggaagaatcgtcgccaaaggctatttctctaatttgtacaatccaaggatccatcaacagctcaaccgcactggctctcttggaggggttttgaataagacatctttccagaaatttcataccagcagacgacacttcatccttagtagggaattgtggggtatgtcctgcagcaacatggtacatgatagcccattcattatctaagttagcccatggccgtctaccagtgatcatttctaataccacgcagcctaacgaccaaacatcgtctgccccaagtttgcctttggtggtagatccagtgatggattctggagccatgtacataggagttcccatcatgtctaatagagcattttcgttatttttcactgcctttgaatcagaaacatgggtaacatcttcgtgttcaccatctgcgttttcgattttgttcatacttgccaatctagttccattattagcaatttttttagcagcaccaaaatcaacatacttaataacaccattaaaatctagtaggatgttttcgggtttaacatcacggtgaacaatgccggattcatgcaaatatgcaagtccttctagcaattgtaaagtgtagacttgagtgaccatttcatcttcaatacgaccatgctccaaaagagctgctagggaaccgccttcacaatattccataaagatgttaactttatcacgatgaacttcaacaccgtaatatgaaactatatttggatggttcaatatctctaagacactcatttcctccttgattaaggggaatattttttgcattgatttgctatcttgaatattgatttccttgactgctaaaatctcaccattatccaaatcaacagcagaatatacccttccaaaagtaccgccaccaataaagttcctcttttgccatctcatagaaacgttcgatatggaagatgccaaagaaacaaggtacttgttacctttgtcactatcatcaattactttaccagtttgatgaggattccgctttatcctttcttccaattccattatactttgtactcggaactcggaattcacttgtagcatcatatcatcgtcaaacacatcttccaaatcaagatttgatctagcttgttgattgattttctcaacttctatggagcgtgcgcctattatatcaaaatgagaaataagtaatgacatgcattctgaaattttttgttttaaagaagaaaattggcattcatcaagagctagtatgttccaaccgcttaccatatgcatcgcgaactccattgacgtgacacaccacctaaataccctttgatcagtcggatcacagtcttcagctaagaacttcagccatccgatacttaaccgcatcattaaaagtattataatggatcttttttcattgttggcaacattaattctcaaaaagttcagaccaaaatccctcccaaaaaggaaaatattattcaataaatcattgacaggacttaccttcttgaacgtggtcacaatctttgtatagttcttcagaacactgtacgtgcatctgaaatatgctttatttatcctttgtaagttgtttttaaccgtttctgaggaagattttttttccaagaaagaaactgagctaccagatatctgttggaacctgtcacattggtattctaaggcataactggatccttggcacatcaaatctattgaattaggaattactttcaagttcaatccctctggtttaattgttttgttatcggatagattatacatctcaccctcccaaagtaatggctcttgcggagtcaataccaatacataaccaagagagttcaatcttgtctccagttcataaaactcttcctccgtgctcctgctgttttcaaaatccggttcacgattgactctattaccgttataagatctaggctgggtggtcaaatcgtttttgatataataaaatggggtaccatcattcgagatatctgaacccagtgatgagttggagttccaattatcatccaaagcattataaattgtcagactgttattaatttctagcttaggcactaaatcacaaccgatgtctgaattcttaatgattcttaaaatatcatcatctttacagcctaatagctctgggctaccaattaaataagtaccattttgctctaggtaacctcctgtgtatataagaaagtggcctgtttcttttagttgctttagcagatagttgtgatcttctatcttgtagcggacaaaattttgaaatgcttttgtcaaaatattggtgaatctattgagttttcttttcatggatccaagtatttcgaatatttgcaccagccatttttcagcagcagcttcattctctaattttggcggagtgttttgctgccttaaaaggtaagcgtgcaatctgtgaaccaatctaagtgtcaacttcgtaaattctgctgcgatcagttcgcctgcatcatcaatataatagccgacgtttctaaacatttcccaatattttaataacagatcaggttctttagaagtcttgaatgagtttttgccactatataatattctcagttccaaaatggagaaaaaatattccaatccttcaacaacggtatgatcaaattcgggatcgattttcactttaaaaaaccagtcattacagtaagaagcaacagtgaatttcatttggactgccaacttaatatatgtactaaaatcgtccatcatttgatcgatcatcatcaaggttggattctgtattttcttcgcgtaagataggcgaattagtattatatcttttaccaaacgcattggaaacatcaataaaaattccagatcttgatccaaataagatagattcaattcattccaagttttttggtatttcaagaagaaaaatttggccttcaaaatccatggtgctaatggaaagaatatttttttttgaaatatcagttcaatatccttttccttcataatttgctccgcaaagcgtttacaattagtggcgaaaacggctggatcatccaaattcacggtggtgttatccacttcggtagtgctttctagctctttattgccaactatccattttttcaggtacgcaatattagtatcaaagttaaatttgaaattaagccaactattcaaagtatctattcgattcctgaatgcttctgttttagtaatgggtttttcagcatgcattcttttaatgttaggccatagatttaagactctataatatttgtctactagtgatttgatagtctctgcagcctcgtcagcgctcatattatcttctagtttaaaggccatgatttcttgaaatacggagtcagtagaatccctaaaaatcctcagagatttgttctgatcttccacggtcctcccattcatccatgccttcaactcaatccaaatgtcatctgaaaactgagtattgaagccagggcctttcccttgatttgcaatcttcgttttttcattcctcacaatatctcccttcagtaccttagataacattgtttgccattcaaatcggttgttcaccataggattttgtaacaattttgacagcaaatcctcgctccccagtatggaatgccactcctcatcttctatttcacacggttgatcattgttcacatccctcaaccaatccaatttgccctttagataatttaggctcatcgaaacaacattttcattattttttgtgctcgacgtaataaaattataaccaaaattgaagtcgttatctttatcctcaccttctacctttaaaagatcatccatttctagttctaagtcatcttcacctttgttactaaaattttcttcgtcatcttcaaagttggatgatgcgactatacctctagtgtaataatcatcattagcacggtttctcatttttcttaaatataactgttcatttaatacatattgttttttgtatgttcggaggctcgttgtgcttccaccatggtggcctacagaccgttgcgagctatttgtcgtgacaatatcctgcaaagtggaggaacttgttgacccatttggttgcgatctggtgggaatgtgtttgttcgaagtttggtttgtaatattttgtggcgttgacataatcgatgtattcgttgtatttagtgaagccagttctggtgatatcactaacgttggggtcgtcaataatggatcttgattactattcacgggagcgggcttcttaataatctcgctctctgttttactagcctcaactttcttatgtacaggaacaggttgagtagacaacttcggtagagactgctgaggattttttggtagaggaagaccaatattcgagggccgtctactagatcttgccgaggagctggaggacccagaaatggcattttgatgaaaaaactgaccttgaggtatacccggaagacgattgaatagctgtactgtatttaatggagactctccagggctgtaaacagcgtttggtgatctaaagtactgggtagaatgcagccctgggctgatgggcgatgacgctactcgagcctgcgtagtattggaatttcgccctaaactttccgaccttagtctagatgaagatgatgaagatgactgcctcatcttggagctgctgggcttttccgtggaatcgccgtaaggcttataattgaagtagtctgaatgcgacattatttgtgcctgtcaaatagtttacgcaaaggcttctcttctttttagtaatggcagactgtttgtacttgaaactgcccaatagtaacttgaaggacagacggagctcacacaaaagttaacaaatatgctggaacctttttttttcctttgaattctttgtaaaccagtaattcgttttgaaaacacccgttcttagctgttctttaacagtactactctctaaggcaataacacactggggcagcaacaattacaatcttctaacctcttctaatctgcagatttggcttctttctatctctgtttacccacctttatcactcttttcagattaatcaattctttccatacaaagaaacgcccgaaaagtggcgcgagtttcccgggtgatggagcagtaattaataatgcaaaactgctaaaatacccactgtttcagggtatgaaacgcggtattttcagcgagttgtaggtaatttggaacagttcgtgactgtttattaagttccactcattgcagttgtatccccactgtgtacttttatttttggttagagaattggcccagtagagatggaattggacgaatgtttagaaaggctatacaaggcccagttactacctgaagtgactgtaagggcactctgctttaagctgaaggaaatgctagtgaaggagtcaaacgtgattcacattcagacccctgtcacagtcgtgggggatatgcatggacagtttcacgatatgctggagatcttccaaataggcggccctgttcctgatacgaattatctgttcttgggcgactatgtagacagggggttgtacagtgtggaaacaattatgctattgattgtgcttaagcttcgatatcctagtagaattcatcttttgaggggaaaccacgagtcacgtcaaatcacgcagagctatggtttctacacggagtgcttgaacaagtacggtggcaattcaagagtttggcaatatttgacagatatatttgactatctagtgttatgctgtattatcgacgacgaaattttttgtgttcatggtgggctctcgcccaatgttcaaaccatagatcagatcaagattattgatagatttcgagaaattccacacgatggcgccatggcagacttggtttggtctgatccggaagaaaacaataaccccacgttagatcatccagataactctggacaacatttccaggtgtcacctcgtggagcaggttatactttcggaagaagcgtggtggagaaattcttacgtatgaacgatatgaacagaatatacagagcccatcagttatgtaacgaaggttaccagatatattttgatggattggttactactgtatggtcggcgccaaactattgttatcggtgcggcaataaagcatctattctggagctgtatagtaaagatcaattctacttcaacgttttcgaagaggcacctgaaaataaactgttgaaagagaacagtatgaacgacaatgccttagaagatagcatatctaatccggtagccaacaggaaattgattgcagattatttcgaagacgactctgcctccgcagatggctccacggaccctgaaatgtacatattttcagatgtataccaagccagatctgcttctaacagacatgttgattacttcttgtagcttactaaacaatagaaaagcattatagagacaacgccatcttattatttctacatattctatctctctcggttgcaaatgtatgtattgtgtatttagatcaaaaaaaaaaaaacagcgcattttctacaggtaatacagctccaaatttgtctgatcatgtacctcataatcttccagagagatatggtcttttaaaacacttccacccttctgcaacacaattttgtttggttgggtgccaatttgcaaggacaatacttttttgaaatcacctacactatcttcagcaaggcacttcactctgacttttttgcctaatcggtcattcacaactacctcaatcattttcagagtatttatttgcaatctaagctttgccaccgctcctctttctcaatcttttcctctccctcctcatctctctcagccaaaaccgcgaatatataaaaacaagcaagtctcccgtagaacttttacacgatgacctttcgagatttcacaagggggataaaggaatgctgtccgatacaattgacacaaagcaacaacagcaacagcttcatgtcctgttcatagactcttatgattcattcacctacaatgtagtgagactaattgaacaacaaactgatatctcaccgggagtcaacgccgtgcacgtgacgacggtacatagtgatacgttccaatctatggatcagctattgccacttttgccgctttttgatgctatcgttgttggcccaggacctgggaatcccaacaatggtgcacaagatatgggtataatatctgagcttttcgagaatgccaatggaaagttagatgaagttccaatattgggtatatgtcttgggttccaagcaatgtgcttggctcaaggtgctgatgtcagtgagctaaatactatcaagcatgggcaagtgtatgaaatgcatttaaacgatgcagccagagcttgtggccttttttctggttatcccgatacgttcaaatctacgaggtaccattcattgcatgtcaatgccgaaggcattgacacccttttgcccttatgcacaaccgaagatgagaacggtattcttttgatgagtgctcaaacgaaaaataagccatggtttggcgtacagtaccacccggagtcatgttgttcagaattgggggggctgttagtcagtaactttctcaagttgagtttcataaataacgtgaagacaggaaggtgggaaaagaagaaacttaatggagagttttccgatatcctatctcgattggataggactattgatagagaccccatatacaaggtaaaagagaaatatccgaagggcgaggacacaacttacgttaagcagttcgaggtctctgaagacccgaaattgacatttgaaatttgcaacatcatacgagaagaaaaatttgtcatgtcatcttctgtgattagtgaaaatacgggtgaatggtctatcattgctttaccaaactccgcatcccaggtattcactcattatggagctatgaaaaagactacagttcattattggcaagatagtgaaattagttacaccttgttgaaaaagtgtctagatggtcaagattcggatttgcctggctcccttgaggtaatacatgaagataaatcccaattttggatcactttgggtaaatttatggagaataaaataatcgataaccacagagaaataccttttattggaggtcttgttggcattttaggttatgaaataggtcagtacattgcatgcggccgttgcaatgatgatgagaattcccttgttcccgacgccaaactagtttttatcaacaatagtatagtcattaatcacaagcaagggaagctttattgtatttctctggataatacatttccagtggcattagaacaatcattaagggacagttttgttagaaagaagaatattaagcaatccctgtcctggcccaagtatcttccagaggagatagacttcattataactatgcccgataaacttgactacgctaaggcgtttaagaaatgtcaggattatatgcataagggtgattcttatgaaatgtgtctcacaacgcaaaccaaagttgtaccatctgcggtgatagaaccctggaggattttccagaccttggtacaaagaaacccggctccattttcaagtttttttgagtttaaagacattattccccgccaagatgaaacgcctccagttttgtgcttcttaagtacttctccagaaaggtttttgaagtgggatgcagacacatgcgagctacgtcccatcaagggaactgtgaaaaaaggaccgcaaatgaacttggcaaaagccacacgaatcctgaagacaccaaaagaatttggtgagaacttaatgattttggacttaatcagaaatgacctttacgagttggttcctgacgttcgggtggaggagttcatgtccgtgcaagaatatgccaccgtttaccaactcgttagcgtcgtaaaggcacatggattgacctctgccagtaagaagacgagatattcaggcattgatgtccttaaacactcgcttcctccgggatctatgacgggagcccccaagaagattactgtgcaattattgcaggacaagatagaaagcaagctaaacaaacatgtcaatggtggagcacgtggtgtttacagcggtgtcacgggatattggtctgtgaattccaacggagattggtctgttaacattagatgtatgtattcctacaacggcggaaccagctggcaactcggtgcagggggggccataacagtcttaagcacactagatggcgaactagaggaaatgtacaacaagttggagagcaacttacaaattttcatgtagatatttgtatattattagatatgtatgcaaacattttctttagaataatatactattcttgtacgatgcagaattttttttttttttcgctttaggaaaatgacgttttgtgccgtggaaaaccctggaaaaggatattggaaaaaagttaaagcatggtcatttagggaagactttccttccaatttacttatcaataggttataatgtatgcttgacggagcagaattctttcaaaccataagataatagatattataacattttagtacataaaagaggcccgagaaaatagattttaactggaataattttttgcaagatgacaacaaccgtacctaaagtgtttgcattccatgaatttgcaggagtagctgaggcagttgccgatcatgttattcacgcacaaaactctgcccttaagaagggcaaagtctcaaggtccacacagatgtccggaacgagccttaacggaaatggtaacacagaatccaaaacgatggagagagtaaattctgtaaggagtaatgcctccagccgtggtggtagtgaagacggcgccactaagaaattgaaaaaggagaaagaaaggcgcttcaagattgcgttgtccggtggttcgttaatccaagtgttgcacgaaggattgttgaaaagagacgacgttcaatggggtaaatgggacatttactttgctgatgaaagactagtgccctttagctccagtgaaagcaattacggtcttgctaagagaaaaatattcgatttaatagatacggagaagtacggaactccgaaaatttatcacattgatgagtcattgattaacgaccctcaagagtgtgcagataactatgagaaaattctaattaaaggatttgccggtagagattctgtgaaactaccgatgtttgatctgtttctgcttggctgcgctcctgacggtcacatagcctcgttattccccaattttcaagagaatctacgtgaaaatctggcatgggtcatacctgtagaaaatgcacccagcggaccttcgaataggatttcactgaccatcccagtgatttgtcactctcatagagtcacctttgttgtagagggcgccacaaaggcgcctgtaatcaagacaataatggaaaggcctgaaaagggattgcctagtagtattgtcaatgagggcgccgccggtcgtgtttcatggtttgtagacgacgatgctttgaaagatgtctttgtaattaagaagaagtacaagttttatgatgatgagaatttgactgagtaggtgtttaattttttgggttctttttctttctgatgataatgacaactaatgacaatactatgatttaaccttaaccattttctttttttagctctttctatccccacccttccctttagtaatcgcaataaatcaccctatgtttttgaattttctcgagaagtaactttatataaaacaagtcatcttagtgacgtagtgtgcatatataacatacaacatatataatatatacaataaccctttagaaaaaaataataacaaccacagtggatatttcccttttggacctatggcttccgctaagagaaaagcatgcttttaagttttcttttctttcaaggagattatttggtcttaagcgaagtgagagattgaaacaaaatgttaattacagagtttacgaagaatcagtttgcaagaccaccttattcgtatggcattatcaagctttgtgtgtagactatccacacaaacatgattcaacatacatagcagtggtaggtatacaacggatataaaaaccttaactctacgtgtagaaaatgtaaaagggtagagcggttgcaaaaaagcaagttttagtaggattccaggaacagcttctcatcttgctagataacatacggcaataatgacaaaatacactgagccatgcggttgttacactttcccaaaatagtaatctacttctcccattttttatattttgcgtatcacaccacatcgtccctcaacacaaaagtttttgttcttgttgacaagactgtcattttccccttgagtgactttatgtcgctgattcattcatttcggcattgtttgctgtttattccccagattctttccgctttgcttggctgcccctttccccggaagcctcgagattaagatgaaaagactaatagccaggctgttaaccccttgttgatacagtttggacaccccctactagttagctgtgtatcctgaatctatgtcaagcaaaaattgcttacatacagtaaggtattttttataatcccgccaacactatgtcgactccttcattttggacatcttctttacatggacgaaccagagaaggaggtcggctcgaagggaatgtaaagctatcataggggtataaataagagacacattgttctattatagagaaaaatattttatagatcttgtatctcatcttgcgtaatataaccaaacaaaggttttccttatactatatcaaaccaaaaaaaaaaaaaagcaaaacaacaaataatcataatatcatgaagtcaagtattccaatcaccgaagtattgccaagagcagtgggttcgctaacattcgatgaaaattacaatttactggatacatcaggtgtcgcaaaagtcatcgaaaagtcaccaatcgcagaaataatcaggaaatcaaatgccgagttaggtaggctgggctactccgtctacgaagatgctcaatatataggtcatgccttcaagaaagctggccattttattgtgtacttcactccaaagaacaagaacagagagggcgttgttcctcctgtaggaataaccaattagctcagaacagaattagtgttaatagcggtgacagtagttttattgtatctcacctttttttatgtataatcatataatgacttaattatttttgaaatgtttctttttttttttttagttataaccctttttacggattcttacgtacttatttaatctttctagtagacaatctttctaccggtgaaggttcttcttgcctgttgtctgccttctgcactcaattcatcattttcatcatcttcgtccaccttggctctatttaagactttgatgaacgagtccactctgaatctcattctggagtgcatgtaggctttagagcactttatgtgataatggaagtagtttctaaacaatgttaactggcaaattgaatggaattgcaactcttttgtctggaaatgacgtgggaaaagaacaaacgtgataaatcttctactttgctctgcaactttaggtggttgatatagtctcttcaactccaatggtggttcatgtgagtataaaacttgtggagcggattggatttgacggtttctcttacgtgcatccacgaattcttgtaaaaagaccttgccaaaaattttatctgtttcgtcttgaaaaatagtctcgaagattatggtaactctgtcattggaaggtttgatgaagatgttctcctcgtcacgatacttgattgtgaacaaagtgttgtctccattggcagcaacctcaccgccagtaatttctgcttcgacaggtgccggttgctgctggcttagttcaataaacttcgaaatggccaattcgaagggaaaactcaatataatggtcttcaaaacagacagttgtaaaatcgattcttgaaccaattcggccaacgtaatctgaagagtgtagtcatagccgggctccacttcacttgggatagtcaccccacccaaagaggagtagtggtcggccagaaacttcagtaacgtcaaagaaccgtccaattggcactcagagacacttacccaagctttggtcttaacactcaacaacagaatggacttatcttctgctgtgtttgaaatgtggtaggtggtatagtcgaaatcggaaacaattctgtccatggtcaacggcgaacccttgcgaagtgcctctatcgcttcattcagtgtcttttggatgagaaggttttgtggttgtaagtgtagcattgcggattaccgttttgaggcaagaagattgctagtcttgtatctacactagttcctttgaacgctagttagcccctatgcttatagtatttcttgtcaatacaagcgtctgaaaattcagatcgctttatacgagtaagtatgccaaatacaccaaatataccaaagcattgattgcgtatactgagaatacatatatatatatatatatatatatatgtatggtcattgctatttacaaaaggttgtatggagtgggaatattagagaaaagtagtcgagaggccaaagaaaacttagagcgtactgcgcatcacgatttacttggcttcttggctccatatttcgacctcgaagaaatcctgtttaccacaccactcaggtcaccagcacctctgataacatggtacttcacaccaggcaagtcctgacaacgcccacctctgacatatacaatcgaatgctcttgagcatcgtggccctcacccggtatatatgcagataccacgttcccgttagtcaaacggaccctgcacgcctttctctgcgcagaattcggcttcttgggctttaaaaccattacacgtaatacgacacccttccgctggggacactgatccagttgtggagctgtacttatcttcttgcgtcttggaggcccggagcctcttttaatctgattcaatgtcgcttgcattgtcgtagtggaggaaaacaatctctgcgcctgtctcaagggcgtacaccatgtgttggacataaacctcgacaacatggctcttgttggcctgcttcaattctggtgtacctgtaagttctccgtcttttccctggttatatgcgttttttctccccaaatcgttttgtcgctcgggtaagactgaaatgcttttaaaagcactattactgtttattatgctatatatatatatatatacagcccgagtctggcttgatcttatttacatgatatatcatctagaaatctatatacactagatccctcatttgttcttggtttgagtatagctgaaacgcttcctggtaggtgcgaactcgcccagtttgtggcccaccatatcttctgatatttcaataggtacgtactccttaccattgtgtatttgaaatttcagtcccacgaactgaggaaggatggtggcggcccttgcgtttgttcttattggagtgcccttagtcatggcctcccttatgggtaatggcacgatgttggggcccttccatacggaccgcgataaaagtctagctgccggttgcattttatttttggtggacactacttctgccgatgctgtactgctcttgcaatgaacctcaccgttttaagtcatggttagattcttactaggcgcttccaattgccatttcttgctcagccataaccgtgaatagtgatccaaacgctaatgccgggtgatgcttaaaatttgaaaaattattgcagatttgtattatatagaaagcataactggcgatgagatgtgctcgaaactggacacctttaccattggtgaccggtagtgacaatgtttgcatcgagatttgaccctagccaattgactgctcctgcagctagcgcaccagaaggaatcgtcggaactactcccccggccattgtgcctttaaagaggcaggctactgaatctgataatgaagaatatggctctcaccaagattctgatgagagttccaactctagttcagaggaagacgaagaccgtatgcaagtagattatggggctagtgaagaggattcgagtgaagtggaagaggaagagagtaagccaagtactcacagcacagtgctatcgagattcaagcaaacagtatcattgcaagaaaggctaggtgcatctgatattgctgagagtaaggaagacgaaggtattgaagacgaggcggcctcaactcaccaactaaaacagattcctcaacctgaattcgtcaaaaacccaatgaatttgaatacaaattcattacagttcaaatctacgggttggttaaatactgagaagatatattatgataattccttgatcaaaccgttctcggattacgcaaatgaattagaagcaaaactactgcagaatatttgcaagaatttctctacaaacacttttcccatccaatcgatcatcctagactccatattaccggtattgaacttcacgttgaacgtatctaagagaaacttcaccagaagaatcggtgatattcttgtaaatgctgctaccggttcaggtaaaactttggcttactccattcctattgttcaaaccctcttcaagagacaaattaacagactgcgttgtataatcatcgtccccacaaaactattgataaaccaagtttatactacgttgacaaagctaactcaagggacgtcgcttattgtgagcattgccaaattagaaaattctttgaaggacgaacacaaaaaattatcaaatttggaaccagatatcttaatcactacacctggtagattagtagatcatctaaatatgaaatcgataaatttgaaaaacctaaagtttttgattatcgatgaggctgatcgtcttttgaaccagtccttccagggctggtgtccaaaactaatgtcccatttgaaaacggataaattagatacacttccagggaacgtgatcaaaatgatcttcagtgcgacattgactaccaacacagaaaagttaaacggcttgaacctttacaaaccaaagttgttcctgaagcaaaccgataaattgtaccagctacctaacaaattgaatgaatttaacatcaacattcccacggcgaaaagtgtttacaagccattgatattgttgtattcaatatgccaatttatggcacattcccccattgctgcaaagattttgattttcgttaaatcaaatgaatcgtctatcagattaagcaagttactacaacttatctgtgaatctcgctcacaatccagcgtattgaaaaaccttcaaaatttggcggtgagtattaattctgtcaattcaaacaactccaaagcagaaaataaaaaaattgttgcgaacttctcgcatcactcggaaagcgcaggcattaccatcttaattactaccgatatcatgtcccgtggtattgatattaacgatatcactcaagtaataaactatgacccaccaatgtcttctcaacaatatgtccatcgtgttggtagaacagcaagagctaacgaacttggttccgcttataacttactagtaggtagaggtgaaagaacgtttttcgatgacttaaacaaagatctagatagagacggtaaatctgtccagccattagaactcgattttaccctattggaatctgattctgaactatatacttcgtctctagaaagtttgaaaaactatcacaataacaccgcacaagcttaatttctcactttccaccttcgcatccattcatttataacattcaaacatttttttttttagtctcattctaataactcctgagtatagtaatattaatatgtatgtattgatgggtatgtaactgtaaaattatattcggtctatgtctattgtagtttcacacgttggaatgctcgtttgaatgcacttgtcaatggctaaccttaacatcaattcgtcatcgtcggagcctcctttcattgttatcttgatcagtaccacataaagcgtaaaattcactttgcttattactatatcatcgtaatttaggatgtatctggatttaaactcacttaatctctcgatttggtccttgatcatgttcttaatggttgttggattttcagtgaaacctgcagaattcaaaaacccagttttccgtatctttgtattctttgttgctataggtagtgagctcattgatcttggtcgtacagatggtttttctttagcagctttagactcgacttgttgagtatgggcggtcgtatcagtgctgtcattattattgaataacgctgaattggataaagatgtggtggaaaatcccattagtaacactgtcgaggtccaccgtgctatagtcagcccatgccatagaattaaactcgaaataaccaaagtagcaaggtaatcggatatactcgataacagatccaatagtaggggataaatgaataggtatgctgtataagtgatggtaataatcgggttcttcgtctttaaattactgtatttgttagcataaaacgtcttataaagtgataacgtcgataacactaaattgatcattagtatgctataccataaggtaatattctcgttttgtgaatcattggcattggcaatgtgggaatgaggaatttgctcattaatttcatcgtgatcatggttattcgtcaaagaactaccagattctacaaagaggactatgaattcttcaattatatggaataaaaggtccagcccaacaaagcataacgaaacggcaagcgcaaaacttagtagaacgtctattctatttaacccgaatggaaatgtgatagtgcctgtaaaccatacctggaactgagacaaattttccacaaatatgattaccagcgaaccgatgatatcgtaagtaataaaatgcgatagtgtaataaaattactccatgagtacaggtgtccgacttggaaagtaatcagacatgcaaagatttgtagagcggcaatagataactgaatataagcctttggccatggcaaatttgacagcaaatcattgaaatctggaatgggaagagatttggcaatgttcaaaggaattttcacctcaggctcttgaaaaaaattcatggatacagaggaatgcttataacgatgccccttacgaaatgaggtccttgatgcagctgaagagggtggtgtctgttgatgcggttgcagcgttgatgtcgtaaaattaaagggagaatccaaggtcatagaagacctcttactgctgccagcatcgggggaaatgcctcttaccggtgatcttgttctgggaggaggcggcaccagctttggtgctggtatatatttgagtgattgccttcgtccttcgttgccttttcccttcatcaaagcagcttcattgatattagcattactagaagcgttttcaccaaaagtgaacgaaggattgtagatgatactagaactggaattgttaccttccttggcagaataaaatagggaactgggcctaggtgatgcaaaaaatgtcctgttttgggatggtataccgtctacattcccgacagcgttcatattggacaaagaaaacgatgaagcatcggaatcattcaatttaggagtctggaaagcaacttccggagacaaattgtcctcctcttgtatagcgttcatttgcggcgtctccatagctctttccctattctataatctcgctcacaagtcactaaatattcactttttctctcttagtaacaaaaataccttcaaggttcatcattttcagtaatgaatattcttgatattacgcaataggacacttgtggaaaactttttgaggttgcgttacccgcgctgaaattcgagaacaataaagatcatcatctctcattttagctacattataacataagaaggtgcatttagttatcttatgtggactagggtatgacaaacatggctgccaagaatcagttcaaaggaagcagcttcacactagcgcagctaatcgaagaagtcggacgtaacggaggaaaaaagcctgtgttccagtataaggtaccacggtcgatacgatgggcttcaactgctctagctgtagtgtttctcacatatggcgctgcatacactgatatgtcgtggagaactgctcgagaagtgtacggaaacgctactgaggaagaaaaacacagcccgtggttcaagtgcaaaacttttgggcctgtggctttaggggttttgcctgtgatcctcgctgctgccacgaaacacgtaacgtcaagactagtcacagaaatgaaatatctgccaccgctcaagaatagtacggtgccacggtgtcaattgactcgacgcacttacttgttaggaagaccagtttctatcacgagggagatcaatgaactgtctaaaaataaggccaccaagatcttcacaggagtaggttctcaaggtatggaggataaggccacctttgttttcttcacagtggatgaaaaagcaccctcatttttcaataaattttacattttctcgagatctggtagcgttgtgaagaatgacgccaggatcttggactgctttttcaacagtgtggcagaaaataagctattgaacaggtcaatattaactcagatcctttcacatacgtctgccaagaccctatttcactcggggaattctagatcatccatcaagaatatcgtgaagcccaaataggtacggacatctacgtaagaatgcatgtaaataataatcgaataaaagaacaattaaacacttgtatatgcacgctatatctacaagaatccaaacagtctcaagatgtagtcgactgccaaggcgtacgtaaagtaaagtccggtgttgatatttgcattaaaatacttccagcagtttttaggattgtcaagatccactttctttatcatgctgaagagtctataagcgaagactcctagtccaccaatgaacccaggcccccataacaacccactgttcaagccggcgacagctaacagtgcgatttgagacgcggacatggccttcatgatagactttgtgcgtggaccccaagccaaagcggtagacttgattccagccttgatgtcaaactttttatcctggtgtgcgtatatagtatcgtaagtcatacaccacaagtaactgctcaggtacaaaggtatcattgtaggccagctcattacacccatggcaggaaacccaagtaacgctccccaattgaaacatgcacttaatgcagcttgaggatagtacgtaaaccgcttaaacaaagggtatgtgaacacaataggtaacgatgcaaggcctagccaccaacactgcgcaggaagcaaagatagaacgcccattccaacaagagtttgagcccccaagaatactaacgcccgacgggggctcactctaccagaggcgataggcctctcgacggacctgataactctttgatccaactttctatccaaaaaatcgttgatggtgcagccagcacctctcattaccaatgcacctacaccgaaaatacccaacataccagctgttgcgctcaatgtagcaccttgcatcatggctcccataagtatagaccaactgcagggcaaatataacagccacgtgcccacgggtttctctagcctcatcagctccgcatacggtatccatttcttaggcagccgagacacgaacggtcccagtccatccaatctttcctttcttgcaacttccaactctttcgacgtaaacacaggtgctgattctttcgaggaaggggaggaggaggaggaggaagaagacgtatatctctttctgctgcttccaatgattccagcaacggtaactcggccgctgcccagaatggacctccctagtaaaatactctttctctgccaaataaacattagttgacactgttattctacgacagttatttctactgtaatctatagtatactccgcccttctgataaccttacttttaattttggcctgattcttgtgaaacttttccacgatgccgaaatcgccgaaatggctcgtttagccttttctcgaagattgatatataaagagcatccatcgtgctggtaatggtgatgcaagattgaaaattcccagacagtgagcaccagcacaatgaccgtttacacagcatccgttaccgcacccgtcaacatcgcaacccttaagtattgggggaaaagggacacgaagttgaatctgcccaccaattcgtccatatcagtgactttatcgcaagatgacctcagaacgttgacctctgcggctactgcacctgagtttgaacgcgacactttgtggttaaatggagaaccacacagcatcgacaatgaaagaactcaaaattgtctgcgcgacctacgccaattaagaaaggaaatggaatcgaaggacgcctcattgcccacattatctcaatggaaactccacattgtctccgaaaataactttcctacagcagctggtttagcttcctccgctgctggctttgctgcattggtctctgcaattgctaagttataccaattaccacagtcaacttcagaaatatctagaatagcaagaaaggggtctggttcagcttgtagatcgttgtttggcggatacgtggcctgggaaatgggaaaagctgaagatggtcatgattccatggcagtacaaatcgcagacagctctgactggcctcagatgaaagcttgtgtcctagttgtcagcgatattaaaaaggatgtgagttccactcagggtatgcaattgaccgtggcaacctccgaactatttaaagaaagaattgaacatgtcgtaccaaagagatttgaagtcatgcgtaaagccattgttgaaaaagatttcgccacctttgcaaaggaaacaatgatggattccaactctttccatgccacatgtttggactctttccctccaatattctacatgaatgacacttccaagcgtatcatcagttggtgccacaccattaatcagttttacggagaaacaatcgttgcatacacgtttgatgcaggtccaaatgctgtgttgtactacttagctgaaaatgagtcgaaactctttgcatttatctataaattgtttggctctgttcctggatgggacaagaaatttactactgagcagcttgaggctttcaaccatcaatttgaatcatctaactttactgcacgtgaattggatcttgagttgcaaaaggatgttgccagagtgattttaactcaagtcggttcaggcccacaagaaacaaacgaatctttgattgacgcaaagactggtctaccaaaggaataagatcaattcgatatgtaacatttttcttttcttttcttttcctttttttacaatagctaatttacgtttccctacggtattggtcggaacgaccaagcttcaatttataaatatcttaattttaacagcagttaccacttgaatgagaaactttttgatgcctactcttttgctttttcatatcatgacctccctacatgcttcggaatttccttattcgtagctgtctaacagcaccacttagcacaagtacgtccacccgtttcatacttaaagatctcagcagccacccaatctacatttagggtacctgtcacatatcttctcaaattttaggttagctttcaattgtaaagtctctttttggatattgcacgtttcaagtcaaaacgcggctgtaacataattttctgaaacaatattaaaacatagtaatgacttaaaacaagcgactatcgcaaataagcagttcccagcaagcaattaaaacgtatataagcgcagaataatgatctatcatcaataattatcgtgaacttttccagtatttacgttcatctttgaaaaacggcgagcattaacaataaaagctaaaaaaaccaaaaaatttcagatgacattatctttcgctcattttacctacctgttcacaatattgttgggattaactaatattgccttggcatctgatccagaaacgattctagtgacgataaccaagacaaacgatgcaaatggggttgttacaactacagtttcacccgcgctagtctccacatccactatcgttcaagctggcactacgacattgtatacgacttggtgtccattgacggtatccacttcatctgctgccgaaataagtccttcaatatcgtacgctactaccctatccagatttagtactttgacattatctacagaagtctgctcccatgaggcatgtccttcgtcatcgacgttgccaaccaccaccttatctgtgacttccaagttcacttcatatatttgccctacttgtcacacaaccgctatcagctcattatccgaagtaggaactacaaccgtggtatcatccagcgccattgaaccatcaagtgcctctataatctcacctgtcacctctacactttcgagtacaacatcgtccaatccaactactacctccctaagttcgacatctacatctccaagctctacatctacatctccaagctctacatctacctcatcaagttcgacatctacctcatcaagttcgacatctacctcatcaagttcgacatctacatctccaagttcgacatccacatcttcaagtttgacatccacatcttcaagttctacatctacatcccaaagttctacatctacctcatcaagttcgacatctacatctccaagctctacatctacctcatcaagttcaacatctacatctccaagttctaaatctacttctgcaagctccacttccacttcttcatattcaacatctacatccccaagtttgacttcttcatctccaactttggcttccacttctccaagttcaacatctattagctctacttttactgattcaacttcatcccttggctcctctatagcatcttcatcaacgtctgtgtcattatacagcccatccacacctgtttactccgtcccttcgacttcgtcaaatgttgcaactccttctatgacttcttcaactgttgaaacaactgttagttcacaaagttcgtctgaatatatcaccaaatcctcaatttctactactatcccatcattttccatgtctacatatttcaccactgttagtggagtcactacaatgtatacgacatggtgtccttatagctctgaatctgagactagcacattaaccagtatgcatgaaacggttacaacagacgctacagtctgcactcacgagtcttgcatgccctcgcagacaacaagtttgattacatcttctataaaaatgtccactaaaaacgtcgcaacttctgtaagcacctcaacggttgaatcctcatatgcatgctccacatgtgctgaaacgtcacactcgtattcttccgtgcaaacagcttcatcaagttctgtaacacagcagaccacatccacaaagagttgggtaagttcaatgacaacttcggatgaagatttcaataagcacgctaccggtaagtatcatgtaacatcttcaggtacctcaaccatttcgactagtgtaagtgaagccacgagtacatcaagcattgactcagaatctcaagaacaatcatcacacttattatcgacatcggtcctttcatcctcctccttgtctgctacattatcctctgacagtactattttgctattcagttctgtatcatcactaagtgtcgaacagtcaccagttaccacacttcaaatttcttcaacatcagagattttacaacccacttcttccacagctattgctacaatatctgcctctacatcatcactttccgcaacatctatctctacaccatctacctctgtggaatcgactattgaatcttcatcattgactccgacggtatcttctattttcctctcatcatcatctgctccctcttctctacaaacatctgttaccactacagaagtttccactacttcaatctccatacaataccaaacttcatcaatggtaacaattagccaatatatgggcagtggatcgcaaacgcgtttgccattaggaaagttggtcttcgccatcatggcagttgcttgcaatgtaattttcagttaatatcagaacaatttaattcatttatataaacatatacaatcaatcgaataaaaatacaacaatgtaatgaaaacgctctctattgatatgtatttgctgacgcttataaatttattaaagttttattttaaaccgttctagtgacttcacgcggggagatacatccaatagtaaattacaaaataaggaaagtataaaacaaacggataacaacagtagcttggagacagcaaaggcacccgagcaggcgtggaaacacacgatgcatttgaaaaaggggaagaggagtattagcacagtatggcgacttttatggaagcgtttttattccgtaaactctaagacgaatatgcatttttctcgaagtaggaagaaaccagtgacaaacttcacaaggacaaacggacttctcctgagctgtaatggtgatacattcccatatctgcgtacactgtggagatacttcaatgcgcctggtaatttgatgtttgtcacaactaatattgtcgcatttatgggcattgttacgtataatacgctggttactatcagcagtgaaagagcattcgaagagcagatgatggcggcacaggtgagcctggcgaaacagagagaagagctcgagactacggccctcagcttgccacgagatattgaattgaggggtgaagaagatgatattaaatgggagcaacctgatgtagcacatgtccgggaagatcccttagtcgaggagcagaacgcaaagttagacacccctataaaacagtatactttaggagatttgattttgaataagagggaaaatgtcactgattatgactcgcagcgtgcgaaggcatctatattccacatgctatatgcttatatgctgtatcgagatgttattcaacccacgaccatgactcaaaataacaacagcgaggaatggcggcgtgaagtcgagcttttgactaagggaaaagaggtacaaggtactcatcgaaggatagacgtgttctacgacctgtggaataaaaatttcgataagatagtgacatcacctgagaaagtgcagaattttcaactgccgaactggtctaaatacccaacgatattgaaattcatctgcacagaacttcacgacaacagtttgaagaccttgggtgagtttaagcaattctatggaaaggtgcgatctaacgaggtaaaaaaactgttgggtctttggctgtacgaccattccttccttttcccccataatatctacgacaacagaaccgaagaagatttttacgatatattaattaatgactccatgcaggataacaggatattccagaaatactcttcaattgtaatgaatccctacaacgaacgtactcaactttttttccctaatgtaaattctccatctgtcaacaagccagtaccgagcatatctctggaaacatacacacgactactcaagggatatatcaacttgcaagaaacaggctgcaaatacgactataatgacaatatattcaaactaatcagcatcctcaaactaaattgtttcctacaacgcaacaagaagaaacacgcagggccaaccgtcagaatcctactgccgagagatgaagaccgctctcaaatacttggtaccatttcgcaggcagagaagagaacctgttatcaaattctaagcaaaaatagggacgtggttgcgctgctgaaacgcatttctgatatccaggcggactcttcttaataaaacatgtaaatatgtacctcccaaatcacactcatcatctcatacgaaactgtatctttttgggtaaaattttcatcgatgagctttaaaagcaaaactacttcaccagcaatgaagctactgtagcatcctatgatctcttcggctctacacatcatattactagcctagtcaacatgaagttcttaaccaccaacttcctaaagtgctccgttaaagcctgtgacaccagcaacgacaacttccccctacagtacgacggcagcaaatgccaattggtacaggatgaatctatcgagttcaatccagaattccttctgaacatagtcgaccgcgtagactggcctgcagtgctcacggttgctgccgaattgggaaacaacgccttacctcctaccaaaccatccttcccatcttcgatccaggagctcaccgatgacgacatggccatccttaatgacttgcatactttactgctacagacgtccattgccgaaggtgaaatgaagtgtaggaactgcggacatatctattacatcaagaacggcattccaaacttgctgttacctccacacctggtataaatcaagcgagatctctgtgtgtgggcacgcaagacgaaaagacaactatatacacagctatatatgtagtagtagcctcatatacgtatggcatcaaacatgtagcataaacaacctaaaaggaaaacaaagactgagatctaacccaccacagtttctatttgagccttcccgtcgcgcgtgatttggagatacagattctaagagctttaaagaacgagatactctcctgttttaaggactcaccggcatataaggcagcaaagtcgccggtttgaaggttcaggggccttgaaggtagtatcatttggaaaacagcaagagaatatggctggacaccatcacgaacatgaacaagagcgcgaccacgagcaagaacacgaacacgattcccttcaacggcctactactggatcagaaaggactagaagtatatccttttcgaagttgcttacgcggtcatggaaaaggaatgcgagttcatcgaacaacatgagtgtgtctagcgtgaatctgtattcggatccagagaactcgagagaatcagatcacaataatagtggctcagagggccagtcttcacgattttctaaattgaaaagtatgttccaatccggcaatagcagcaaaaatgccagtgcccataacagcagccaaagcagtcttgaaggtgactcggcgtcatcttcatctaagttaagatacgttaaaccaatgacttctgttgccaatgcttctccggcatctccaccactttctcccacgatcccggaaacggatgttcttcaaacaccaaagatggtacatatagatcaacatgaacatgagcgtgaacactcgaattgcgggtctccaataatgctttcatcatcctctttcagtcctactgttgccaggactgggacgggtaggagaagatcaccgtctactccgataatgcccagtcagaactcgaataactctagtagcacctctgctatcagaccaaataattatcgtcaccattcaggatctcaggggttttcttccaacaatccattcagagaaagggcaggtacggtacgcagtagtaacccatattttgcataccaaggtctaccaactcatgccatgtcttctcacgacctcgatgaaggattccaaccatatgcaaatggcagcggcattcactttttgtccacccccacctcgaagacaaattctttgacaaacaccaaaaatttaagtaatttatcactaaacgagattaaggaaaatgaagaagtgcaagaattcaataacgaggatttcttctttcacgatattccgaaagatttatcgctcaaagatacgctgaatggctcacccagtagaggtagttccaagagccccacgattactcaaacgttcccttcaatcattgtcggatttgacaatgagtacgaggaagataacaacaatgataaacatgatgaaaaggaagaacaacaaacgacaaccgacaataaaacgagaaatctttcacctaccaaacaaaatggtaaagctacccatccaaggataaaaatacctttaagaagagcagcttcagaaccaaacgggttgcaactcgcatctgccacatcgccgacatcttcttcagcaaggaaaacatcagggtccagtaatataaacgacaaaatcccaggccaatcagtgcctcctccaaactcatttttccctcaagaaccctctccaaagatttctgattttccagaacctaggaggtcccgacgtttgagaactaaatctttcagcaataaatttcaagatatcatggtgggaccacagtcttttgagaaaataagattgctgggccaaggtgatgtaggtaaagttttcttagtaagagagaaaaagacgaatagagtgtatgctttgaaagtcttgagtaaagacgaaatgataaaaagaaataaaatcaaacgtgttctgacagaacaagagattcttgccaccagcaatcatcccttcatcgtcacactataccattcgttccaatctgaagactatttgtatctctgtatggaatactgtatgggcggggagtttttcagagctttacaaacaaggaaaaccaaatgtatatgtgaagacgatgccaggttttatgccagtgaagtgacagcagcactagaatatttacatctgttgggttttatctatagagatttaaaaccagagaatattttgctgcatcaatcaggccatatcatgctttctgacttcgacttgtctattcaggctaaagattccaaggttcctgttgtcaagggttccgctcaatcaacccttgttgataccaaaatatgctcagatgggtttagaaccaattcctttgtcggaactgaagaatatattgcccctgaagtcataagaggtaatggccacaccgctgcggtcgattggtggacgctagggattttgatctatgaaatgttatttggtttcactccattcaaaggcgataacacaaatgaaacttttacgaatattttgaaaaatgaggtcagttttcccaataacaatgaaatctccagaacttgtaaggatttgatcaaaaaattactgacaaaaaatgaatctaaaagactgggttgcaaaatgggcgctgccgacgtgaagaaacacccctttttcaagaaagtccaatggtctttgctgagaaatcaagaaccgcctctgataccagtgttatctgaggatggatatgattttgctaaattatcatctaataagaagagacagactagtcaagacagccataaacatctcgatgagcaagagaaaaatatgtttgaagaacgagttgaatacgacgatgaagtctctgaagatgatccattccatgacttcaattcaatgagtttgatggaacaggataacaattcaatgatttatggtaataccaattcttatgggaaaattgcatacactccaaactccaacagatcgaggagtaatagtcatcgaaccttttttaagagataaagggggctttgacgtataagtgtcggtattttttttttttttattgatttttttttcactcttattttttccctcatttattcatcatacatttaacgaactctatttcttttcaaaatccttatctacctatttttttttctttattttctttcctctgtcagttagtcagtagtgtgtaacttaaataaatcatatatcggtgtttcaatttctagcattctgtgtaaacatcagatgaagcattgcctttcttttcaatgaactctatgtagttttttcgatttgcttgcgtactatttttcacgcgatagttgaagaaacgatagaaggatggcgcaatatacaagttaaaagcaaatagatatctaatcaatagttaacatctagaataaagtgctggaacttagatttttttgtgcaatatgggactgatattaaggtggaaagagaaaaaacagttgtctagtaagcaaaatgctcaaaaatccaggaaaccggcaaacacatcgtttagacaacagcgcctcaaagcctggcagcccatcttgtcgccacagagcgtactgccgttgcttattttgatggcatgcgtcttcgcacccattggtatagggctggtggtcagcacgataagtgtccaaagactagtggtaaactacacagaatgtgatgcattggcaccggcgaagcattttgaaacgattccctccgagtacgtggactaccacttcagtaagaaagtcgcagtccaacctcaatggatggtacttacggatcctgaattaggcaatcaaacttgtcgaatacagttcgaagttccaaatcatatcaagaaatctacttatgtttattaccgcctaacaaatttcaatcaaaactatagagaatatgtgcaatctcttgacctagaccaattaaaaggaaaagcattgatcggaaatgatctggatccaaactgtgaccctttaaggacggtagaaaataagaccatattcccctgtggattgatagcaaattcgatgttcaatgatacattcggcacaacacttactggtgtaaacgatactgcagattatttgcttaccacaaaaggtattgcgtgggacaccgacagccacagatatggaaagaccgaatacaatgcatccgatatcgtaccgcccccaaattgggccaagttatttcccaatggctacactgacgataacattccagacctacaaaactgggaacagttcaaaatatggatgagaactgctgcattgcccaacttctataagctagcaatgaaaaatgagaccaatgggttaggtaagggtatttacattgctgatatagaactcaactacccagtaagatctttctatggaacaaaatcttttgtattaaccacaaacagtattatcggtgctggaaacgaggcattagggattgtttatttgattgttgccgggattgcaactcttttcgccatactattcctgataaaagtcatcttcaaaccaagacctatgcatgatcatagctacctaaattttgagaacagcgataccccattcgatgagagtagtgtcgttagtattccattgagagaaattttatgattgattatcatttactataaaatccctgcgtttgattcggtctctagggaagcgttgtaatttcatgtatattcaaaataaggacgaggttatataccatactatattatctccttgcattctgtatcaaacactttattcagtacatatacgatacctatatattcattaaatgttcttttcgctttatttcagcaaggtatagtgctatttaaaatccataatcgttattgcgtctctttagtctgtccttcattgccattactccactacttgcgtctggtggcggcgttggcgtgctggaggtgttgaaactgttcgacgttttacttcgaccgagacttgccctgaattcttggcctgctgaaggtctagtcggccgtgatgaagctcttctcggtgtcgcgctagaggagcttgtatgattattgtatatatcttgaaacgatttactcgcaggcgtgtactccggtgtgttcccgtttgaagaaggtgtacccataggatcttctgaagaagccttccttctgttagaaaaggatggcgagaaatgacgcgagttttgcttcttcatatcatgcttcacttgagtatctaatattttacgttcgttcggtaaatcttccttctcccccaaccatcctgggaacccctggaaaggatgctgattttcatagaatttcacaagccctttatggaccaatgtagtatttacagtatcaccatctttttctgctttaatggataaatgtgccaacgatgtagataacgatttggttgacgacttaaacttgttccaaaatcgcccggatccttcttgggaatgcgatacttgactcatcatatgcgtgaaatcttagttatactggtagttggtattagggcctagcgtctaatagttagttggcgttttatttttttgcacctttcctaatagtattaatctctaaaagtgaaaaactcctaagagtctttacgagctcatttaatacgttctgatcagaagcaagactataaaatgcaatagccaatactttttagactaaaggtagacgacttactagcggttcaagcttcaggaactacactctcaattacgttctagtccattttgtccctctttccggtttttttttttttacgtttccttatgaaagtataagtaatactaaagaaagatttataaagtgccgttactgttacgtatgataaaccttttgatacatttcttcttatttaagccactgtcttttcctttagatagatgccgtacttgtcctttagttctttcatgattggatcattaatctctggtgagtatggcgctagtaagcctggtcccttgattgtaccatctaagacgaatttcgttgcaatggcaactggataaccaacagtagcggccatagaactgtaaccaccaaccttaccatagtcaactaaagtggatgttcttgtttcggtagttccatcagcccattcaataccgaatttgtgttgtagtacaaccatatctctttcattgtcttcatattgcattagttcttctaaacgtgcacatagagtgtctaaagcattacctcttggtgtgatctttgcgtcagagaacaagcctaaccaagcaaacccggaaaggattctttctctatcttcatcatctttccaagtagcctttgagtcaatggaagcaatcaaatcttctttagaagtagacttggcacctaaatattgttttagtgcttcgttccaggcaattggcttgctgaagatttcgttagcatcatccttcaacatacccatgtcaactaaagccttaacaaattctgggaaaccttgatatctcaaagtacctctaatgaccgtttcggcttctggaatatgataaagatccttgaaaagggtagagtctctatttgggtagcaaacgaatgcataacctgggtagatgaagtaaggcttagcagtggccattaagtcttcggaagaaacagtttcaatctttccgtctttccagtatttagcagagtttcttaaagccagtagcacacctctggaggaccatgaaaatttgtatcctaatggattatcagagtcttcaggagctggtaaaccaccacagtatgacaagaatgactttagcttaccaccagctctgtgaacttcatcaatagtcttgaccgcatacaagtggtcgatacctggatccaacccaatttcgttcataactgtaatacctgcctttacgatttctggttccaattctcttaaggcaggtgagatgtaagaggaagtgacgacatcggtctttgttctgatggcgctctttaccacatttggatggaaggtgtatggaatcaaagagatgacaacatcgttatcagccagaactttgtctaaggcactgtcatcggtaacatccaatgaaatagccttggatccagagggcttggccaatgcttgcgcattggctaatgttctacatgcgacagtgacattgatgtcatcattagcagccaatgtgtcgataacaggttgtgcaacaaaaccagatcctagcaacaaaacgttctttcccatattaaaatatataatacgttaatataactcaattgtcctgataagttttccctactgcctaaggatccttcccatgtaattttaccaggaccctacggtttatataccattaagccaaattctgtgctactttctatcatctattgctgataattccattggaaattctcaataccctttattgacatctttatttttcactacaaagcgaatttttccaacggaatttcgattccagagtatgagtaattcttttcactactaaacgcattgcttcgtggtcagtagtaaccgcaatcacactcttcacttctgttgtggtgaatatcaaaagaaacaagagatcatccacaatttcctcagcttgacttgtctgcagttgcgattaaaatttgacttttgctccaccgctctctacaggtattatatttggaaatcatcaaatgatgggaatcccctacgtggcacttagatacgatacataagactcttgcatatgtagctaccaacgtgggaaaacctttcaagtaacagtttgtttgctcttagcaacttctagccctaatgaaaaaaaatgaaaaataattgccagcttttccccgcgacttttcaaaatcggtataaaagcaagtcgaaaatcagtcaaaaaacttttctctcttgattgcttattgcaatctcacttgttttttccttgattttactttcaatttagtttacaatatcatgggactttatctccatgactatgccatttctaggtagcctatggtaaacgaatcccgtagattattcacacgtttgttgtctttgttgacaacaacacagagtaagaaaaagcaaaagatttatctcttttgtccatcttttttttattttgaaggcgtgtaacatttattggttacaacatggcttgttttcttgtccctaacaatcgccaggagaattttttttgaaaattttcttctattttaattatgtacataaatgtcgtcagttaactacaaatgagctatctatcaatatgcttttttttttttttaattactgctcaagcttgctatccccttctacctccgtttcctagcacagaagaaagtgcccatatatcattatattcaatttttaacttgtctctttttcttttctgcctcggtttcgcgcatctactctacgctatattttcataatcatctcatttaaatggcattcattcccttccgcgccagtatattagttactaatcatacagtttcttgtttcaattttttagattttaattagcggtttttttttggtttttcttaagattggttttatgatttttttttttctttttcaaatttttttattattttttcaatttttctttttaaaaggcttgtggttgactagtcctttctttttaggggttgctttctatgagaacgtgttccattagtaaatatgccaggaggattattgctcgtgggcttctttactgtttttctttctaagcatacttcaataccatcaattgactttttcttcttctctaaagcatcgatttggctcttttgagtttcaaagtcgacgacggcaaaattgtctgcagctgttatcctcataactttaccgaattctttttctaaggcacttctcaatttttcttctcttaagccatttgtacctctaatgtagattggataaaagccgtccttgttaacggtgctgaatactggttttttcttatttttgctgttagcactagcgttgtccctccgattccccatttcaaattttctttcagtcggtttcttgggtagtgtttcaggtctgatgtattcaaccgtggtattatttttgctaattctgtcggagttttcattcatcaactttgaggcccatgtcatctttggtggattcgcaacgggctctggagaagatgaaggtgttgaagcgttattgccggattctttggcgtcggaaacctgtggctctattggtttaatttcagtttcagcttcctttacgcccccaggtaccggtttttcatcactaacttctttaccgttgggcaaagaagagttattaacagcatttatggcctcaacagagccttcctttgtcttgattggtgcagctttcttttcggctttgtgagatttttcatttagtttagtaacgtttcctaactcttctgtagagacctcatcttgtttgtggttgcccttagtactagatggtaccgtttcggtgtgaatcttggactctttagtgacgggtatagcccgaggttgactatgatcgacaattggtttttcctgagttgacgattcagttggcgcagttgtgtctttgaccgtttcctttttggcctttggtttcgatatttctggtgatttttctttttctttttctttttcaactccggactcatgccttattttatcttcttcaactgcactgacagagttctcctcgttagattgtgacaaagaagcatctgttaagacataaggcttgaatgaattggaaataaatctgattatatcattggtaatgtcaaacgtagacccattgctggatggtagcaggataaatgtttgacaaaacttatagaccggagttcctgtccaaaacatttcacccgtggccatgatcagaatgcttttgtgcaagtgcccagtgtactggaaatctatagtatctaattttagtttcaagctcctaactttggcatcatttctagaaaaaaacttattaatgttttcacgtccagtaactttcaccgttggaagaacgtcatctttttcgtttgttgacttggactgataattagtatgcgtcaactcggctgtacttgcataaaaatatgccaatttggaagggtcggtcctcattctttcgtagtagttttgcaaaaaggcaaaacatatgtcttgaacggtaacacccattttcttttatttgatacttctattcgagggtatgacttcaaatgcaactattagtgacaaggtaataaaactataacacacttgaaaaaaaaaatgcgatggttttgtagtattcttcgtgatctttttctctttaaaaatcaacgaaaaataaagatgtatcagtaaaataagttttcaacagattctctgtaaaatgattgactaattgaatatttgaaagaaaatgaggtttgaacgaaaataataaaacaaaaaaaaaaatgtaattaaatgggcaaaaatgaattaaaatgtagggaaaaaacacaacttgaagaattaaacagagtaaaaaaacgaaagcttgtggtaggtgatataaataaattaaagcaatatcttactgtttattcttcctctagaatagttttggtactaacggtaactagaaaactgaagaagtttttcgtattcttctaatactcaagcaaaatatcctatgtcaagtactaccacttgtacagtcttcgttttgtacaaattaggtatgaattgctcttttttgaaacagtaatgggataaaaaacaaatgacttagtttaacgtccgccggttgcgatagaacttttaaccgtaacaatagtaacagtggacaggaaaaaaaaacggtacgaaaaggtaatattgcctaatctgaaataatgtagtcactctagaactattaataaagaagcttgtacttcctcttatccctggaatggacggttatgctgcttgcaatatgtcattctttcattaatcgccacctgatgtttttcgctgctttggacgaaaaaatttccaagaaaaaataaatggttaaacaaactacagcgcacgtgaccgataactatacgggaataacgcatcaatctcctgtggaagagtgcttattgcatcgaagaaccaatctgtattactacatgtccaatcataagctgatgttgcttttaaacttttttttttaaaattgtgtatacatatagtacataaatgatcattggtccccatcaataccgtatatgacaccttggtacttggcgaaatccgtaccgtttgggaacttatgcatagacagcttgctcaattggcagaaggatagaagcatcaatagactctggccgcctgtagtagtaaatatagagaatcttggtagccctaactcatcggcaagtgtggttagtgaatattgctgctgctgttgctgttgtgaagattgttgcaattgagggttcttgaactcctggattattttatacaccaggtttaagtcgtagaaattgggcatgtattgatggacccaccactcgaaatcctccttgttgttgggcatggagtcattcattagaatgttgatcaggaaacctagatcatatgccgcatggtatgtgatccaagtaacagaatcatccatcattaaaccagagtccattagaagctgcgaaaattcaaatacatcgatgcctaaattttcgtgtttttcgaagttgatacctgattttctgagtaattctaacgattctgtggacatgatttccttctttgggtcaaattcaaaattgaactgccacgttgagggaccgttgtcaggcttattgccgttggcgtcactcaaggaaagaccaagttgtattgggtttaagaagtctacgttggccctcattgtctgatagtggtaatcgaccttcgacctgaaagtgccgatcggcctagccaaagtccccacaaactcagtactgattgacacatgattatactgcgagaccagttgtcttataacggcgaattcactgtaaaggttggacttccagacatcgcgaacgaaaagataatttgggggtggtaaaaagatcggtggcatactttggttggttaaatgcttgggtagctgggaagccaagggacgattgagtcccactccctgctgctgttgctgctgttgttgttgctgctgttgttgttgctgcagaacgttcagtccgggcggcaaactagccaccgaaacaggcgttcctatattaaatggctgctgttgttgttgctgttgctgttgttgctgagttaacagtggctcgttcttctgcttcaaaagataggcattgttcatctcctgattaacagagccattaattgtatttacaggcatcccttgaggaaacattcttgctctattaacctttggcgaatacacctgaggtcccatgttttgctgctggtgttgttcagaagcctgcctctgagagaaaaactgctcacctcctacagctaataccctcggttgtacattcatagattgcataatcctttttgaccctttataaatgtataaaattgagttgcctgtttctaatcgttcgaagtatttccagtatgaaaaacaaggaagccctgataacgagacacgctaataaacttcaaactgatctttcttgtcagttatcattctactactataattgaaaagactcaataaagaaaatatcataatgatgaaaaaagagcgagcagcgggtaaggaccgaattccgtttggaatgactggtataatgagatttaccttatactatagagagggctatatcattaccgaacttaagttttctattggaatattatactttataaactaaataattacccatctatgttgtttccccaagaatgtttgctgccatataataagaacaaaaaaaaaaataacaaaaaaaaagaaaaaaaaaatcacttgtaatcttaaattaatattatacaccggttgtccgtttttacctctatgccgtcttctcaacttctttcttctttggtttttcttccccttccttttcaggtggaaggacgaaccaagggattttacctctattaaaatcattcaatatttgcttagaaacaccagactcatcaggctcaccacccttcagtaatctaccttgtttccttgccagaatttcaataaactccgtggcatccttccatcctgagatctcgtaagttctttccaagtgctttacctgacaacgttttaaaacacctggaatatattgttctgggtgtgtgacgtgttcgactctgacaacacctctgaataaaatgtcttcttcggagtctttactagaaggcggcacaatacctggacaatcaatcaaaaaaattcttttcataagagtaatatattgccagaccttagtttcaccagggattggtgcaacttgacacacctttttctttctcaatgtgttaatgatggacgatttaccagtgtttggatagccgataaaccctacagatatttgctttctatcagtatgcaactgtgagaactgacgtagcaactgaattaacgaacctttaccgaaagagttggtaatagatgcgtgaaacgccaaagttggacgttcctttgacaaatgtttgacccaagctgcctacttgtaaagttagaattgaaaaaaaaaaccttctgttagtaaaaaatacattttgtttcataataggtaatcttttgccccaagagaatgtaataatcattgttatagccgagattgattgtttcgaagagtggattaaactaaaaaaaaaaaaaaagtagaaaattgtgaggatctttactacgaacatattgtatggagcccgagataaagtctcaaataacaaaagctcaactcataagatcctcgctgttctaaaaagcgaaggtatacctttaaaacaaaggttgtccttctaatttacccatgaggcttccccagaacggggaaatatggataagcgaacagtattactcttccaaaacagtaacagacacttctgtagataagtttatcctaaaacggatagagaagcaccctgacaaaaaggtttggtaataaaaatcatactctatcgaaaaaaaaaatctctcgtgctatcctcttggttggaaagaatcaaaaaaaaaaaaaaaaaagttaacatactgcaacccaggtaggtaccaaatcacacttattaagaacataaattaaatgcttgtgtggtgtttccttcttcatatactcttccacggacttacaacgggtacccaatggatcccttgcatctagaacatgtattaccacgtcagacgaatcgatgactttatataattcgttccaaatacgtttggattgacccttactgaaaatagcttcttttgctgcggaggtccacccattttctttgtcttcctggttccccattagtcctaatgtggcatctaagacttgcttttcctcatacttggtaatgtcttcatttgtagccttgaccaagtcctctagattggatgcagcaagacgtggtctctttctttgggctttgggcccaaacgcatcagcataactttcggtatccaaaattctggcttttggggattcatctgcgtccttttcttccaacaatgacatgggaagcttatttcttctcagaagaacttgatatgtatctttttgggtttcacccaatgcacttctgaaatgctgcagtgcgtcctgagatatcactcttgtgttaccgaaccaacgacgatctggttggaccctcgcatccggtattgtggagtcctggaaagaagcggccctaattaaattacctttcttattcctgatctccttcccactagtgtacatattcaggaatttgactctcttggagtctctgtagaaattttcacccttcacacgaagattaccatctttggtgtcaccttcacgaatacgtctagatttctctttcttaccagtacccattgtattattcctcccctgatatttagtggttttgctgcaagtcaacagatcttcaaagttaacacttaagggaaagtactaacaagtagtaaatatcttttatatattctacgcttctttatatgcccaaaaagaagaaaagtgaaaaatttttcttcaagcgaaaaatttttgcgatgagcatcgggcaaaaaaacgtgctaaatgacaggttgtgtttatatatttgttattgattctatattatagtaaattggtgagaacattacccaagtctttggacccagaggattgctgcttgatatcagagggagcattggcacggcttgtttccacacgacgttgtttaaattccctgtgagggtgagaatctgcagactctccttcttttccggcgcgcttcctagagttcttaatgttttgtatcatcttactttgctccacgtttctaatgaattccgcgttcagtttgttggcctgcgagatttccatctccaacttggcctgtctgatatcgttctcgcgggcaatctgttcagtcaaatctgcccatttgaaacctgggaggtacttcacgttcaggatatcatcatggtagaaagtacctttcttgccaccaataatgttcccgttcaacgtctccgcacacaatttggcgtctcttttcctaataaactcggcccaaccttcttcatacttgtttttcttgtttcctccacctttaactctttgcttgtacttttgatcgtcctctttctttagaaatagtctatctacctcaccaaaacgagttaatatttgtctcatttttgcaggtttcatgtaaggtggaatactggagaagtataccaccccagtcttgtgtttagacttcttggcggcctttgattttaccagttgccttagtttttctgtttttaaatccagtgaagtggtggacgaagcttgttcttctacttctcgatcgagcttttctccattctctttatctggttgttctacatcctctttttcttcttgtttttgctcttcttctatgtctgactcgttttcactttcgatgtcttctaccttcttactgaagatatcatccttactagaaatttttttcttggtctgaattaagacgttatgttgatcggtttcctcatctgaggaaaagtcttcaaagtcactatttactttttcactcatgcgtaaaaatttacttcactctgctgcagtaaactgtttgctttgtacttacatagcaatgggtagtttgtcaggttgaaatttttcaaaatcttaatagcgaaagttttactgcgcaatgtgagaaaagctggctataacgaagtaattcaaaataataaaacaagagaaagaaaaaatttacacgtcattgcctttggaaatgtgatcagacagacccaatatcaccgtttaaatattcttcacgagataatgtagtttgtcaattgaaacgctatttggtggctggctaatcaaatatggtcgatgaaggggttgtcaatccagcagcccttaaagaattgtcgctatctgtttgttcctataattaatttgcactgaaaagatacatgtgcattattgcagtatattataaggaattccggagttttctagtaactttctagtcgcgcaaccgagagatgagtactacaacgcaacctatttggtagtgcatcctacacattgtgaacgtttttggttcatattacaatattacgatattacgaattttaccctttctttaatactaactttgatcagaaagcacctttatcaatatggccacgtctgggaagtcggtcataatcaaaaggctacaggctttggggtttgaaatatcaatatacgaattgtgagactttgttttatcttagggacgaaaatggatgtgtgaaattacttatggaaggatcaataatagcaacgtttgctaatgtgttaagatggcaaaatgctactggtacgcctcgttgagtatccatcattattaatagcgccaaaattgaaacattaattgcggttttagaacaactttagaattacagagcaaggtgataagatctcaatagcttatgaaaaataataattttttagaacctaatgaacgtgtcgaaactttccgcaaaatattatgtacatctctactcaaccttctattaggatcatgagaaatgtgttaaaacagaaaaaatgcaccctcataataaaaaacttggccaaaccaaaccctttctagtacatcgatatgtatatcacacaataaagtcaatgcagcataacttagaatcgaggtagcgactccccgtattgctcaaaatggaaaattctatggaaatagaattcatatgactctgagaactaaaggaacattatgacgaacaaaattgctatgatgtgaggaataagatgatacagtcctaccaaataccaaagatcgggtcgtcgagggcggtatcatatctagggagatttcttttcaattagagcatattcattatcaagtaaccaccatttgtattttttttttcttctcaaggtagttattctgttctgacgtgcagaagatgggcgtagcattgacacaaagattcagtgggaaactatatatccatatctcatcctggtttggaaaatgaagagctgcatacttatatgagggaaagaaggctaaacaaaatatacgtaaagcaactatcaagagccaatggaatctattttcaaaatttgcgttcttccaaaacatttatcccgtttgatgcattaatgaaaattatgaacatttatttccttaccacacgtacattgggtgctctactttcttttttatttaagcatataaaatgtacacagtagtaaaataccattttaaaatattatttgaacaatcatagaacactacgcaggtattcttcttcaaaaagatagcttcaatgtatttcatgtatctgaaaacgctttgtcttgccattaaagatctggtggccccgacaaaataaaaaaaaatactgaaggatgcgaggttcgaactcgcgcggacaaccgtccaacagatcttaagtctgccgccttagaccactcggccaaccctccaaagatttatactttttgttgtatctcaaaatgagatacgtcagtatgacattttgagatcctaaacgttcataaaacacatatgaaacaaccttataacaaaacgaacaacatgagacaaaacccgtccttccctagctgaactacccaaaagtataaatgcctgaacaattagtttagatccgagattccgcgcttccaccacttagcatgattcatattttatataatatataagataagtaacattccgtgaattaatctgataaactgttttgacaactggttacttccctaagactgtttatattaggattgtcaagacactccggtattactcgagcccgtaatacaacactttttatcgtatttcaggtagtataccacatcattatttgaagagtgggtgagttttgagataattgttgggattccattgtgattaaggctataatattaggtatgtagatatactagaagttctcctcgaggatttaggaatccataaaagggaatctgcaattctacacaattctataaatattattatcatcattttatatgttaatattcattgatcctattacattatcaatccttgcgtttcagcttccactaatttagatgactatttctcatcatttgcgtcatcttctaacaccgtatatgataatatactagtaacgtaaatactagttagtagatgatagttgatttttattccaacattattgtactcagcaattgttgcgaaacagacaagattaagtatattattcaaggccttgcttacctagatgaaccattgagaaatatacatattgagcaatacctctaggtccgaagttccgtgcctacaccctttagtcagatttagattatatgagataagtggtattttgtggaccaagtttgtgattaatctgatatcaagttactttcttaacgacattaggacgccagggtagccagtattattcaagtccatagaacagcctgtataccttcacttcattaggtatattcttggttatgcgttatttaaatcctcatctgccgctgcttaaaaaaagcagctaaagtgttgcgtaggcacttcgaacaagtagtcagtaatatcaccttttaacatctaatcatcaaaagagacattttttgggattaattgtttataaaagctatgaacttaggtctacagaatgtaccaaaagttatcctgtaggatataggaatctacgaaaggggcccgatacttctatataatatatatttttatttctccttcaattttatacgttgtcattccttatcctattacttcatcaattcttgcaattcaacatccaataactttgataactgtttcccatcaattatgtcgtcattttacactgtatatgatacaagtagtatgagtacacaccaatagatgattaattttttccgacaatcaaatattgggatcataaacacacataatcgccatatccgttaattcgggtttcaatcacttcgtttgtctatcgtatcgcagcctagtgaatatttaattctttcaataaaaaaggcttaaaatcaccatgaaaatcacaagaggaatctttcaacaagaacaatagtatacaatccatgaatgaaggagttcatatttgactagaactatacaaaggttttgtactgtttttactgtgagggtagcatctcatttatccagaatctcagaagggagaaacccaatcgctaaatcgatattatcacccagaagtttcaaataggcgattgtagaatatacacagggacaaccactcagtttatggcttcagtgcgcgcccagttctggaggaaagcattatcgaagtaataaaactttaaaaaagctctccgcaactaatgaggattgcagtatccagatacccttgttttctgccaaatgaacacttttactatgtcatataaacaaaaagtgccatttcttggtactgcttcagtcttaggaatggtcaatacgttattattacttaaatatacgattaataacatgctctgttgcgtatttagtaagtgtgtaaggaaactgtaatattacctaaccggtatcccacgtgtttcacgaagggcgcttttgttgttgcaattataatcctagttaggtaaaaaaaaaatacttaattcctatcatctactagatacaagaaagacgtctctgaattacacaccgtctctcaaattgacagattgcaaataccatctcttagtccaaagtcttatcctcttaccatagtagtacattggtaaagcaaatgcagtaatcccaaagttgatgacagctaaagcaatgtaagtattttcagtaccagatgcagctagccaatcagaacaggtaaaggtgaaaatgcaagatatcgtgttgttaataatagcagtacaaaccataccttccaaaaccatatcggggtaacaatccattaaatacgccatcgcaatatcaccagaacaaccccatgcaaacccaacaaaacccaacccgacgtatatagcttgccaaggccattgtctagcggtaccgataccaaacatcagcaaacccgctggcccaataattgcagttgcgatagagaagtatagtctaaattctgcctctaaaattcctctattgtgacgagccatccaaagaacaaagtagtcactaacaatgccagcacagatacaaccgatgactgctccaataagtgtgggaacattcataattgcgacaccaaaatcactatagttccatggaggttcgtagtaggcgctttcttgagtggtcaaataaaacgtcaggaaaacgtcttgaataccccaaaacataccagacaaccacactggcgggaataagaacattctaaggttgatctttagatatttgaaatactgtttaaaaccgtagcctttcaaattagtagctttggttaatattgctactctttttgggtatggtttcaaatgctcttttgaaccatcaatcaattcgcgagtctcaggtatggtaacttcctcttcattgttaacttcgaattcagccgtctctgaaaggtctacacctttctcacccatggctccaggagttgataatttagcgtcaagatgacgtttcctgcgcgacacggccgtattgtcagagttttgtaaagtggtaccgtcttcgtatcccgattgacagctggtcaaaggggtcatatactggcctctgtcgaagtacgtttcttcgcagccaaatataatagttattaaaaggccaccagatatgatcactgcgacccaaccgacccaacggaagttggtaaatgcagatatgtacccagcgatcaatgggcccaagaacgtaccgatactagtgcacatgatatacacggtcaatacggagcccaattggtgctggaaaaaaatgtcgctcagggacagttgcacctgggcttcagcacaggactcactaatacctacaaacaactgagaccatattgtgtcgctcgttcttttggccaaagcaaaccaaagcgcaccaaagagacctaatgtggtgcaaactatgtacgtaatcttcctgccatacaagttagcaaatggagccaagaataaagtggaccaaccaatacctaggaaaagaacaccagcccctgtgttcatggaatcgtaggatatcccataaatctcattcaatgagtcttgagcagcaccagcgtcgttactagtagcggcggtaaacgcagttataaaggccattagaccaaaatgagccaatttcctccagctagaccagttcagtggatcatttggcgagtatgatggttgagggattaggacgactcctgaggaggttttcttcaattttgattcgtatataataccattttccaaattttgggaagaatagatgttaaatgtgccaggaatatagtccggatgatccctgttggtatatttgtccatctgttaaaaatttaagattcacactcgcaaactttcttctatagtagttcttttctttatattcgttagaaatgcaaaagttgcgaagctgttttgttatatcctgtagattgtaatatgatacttcgattctttcggatttagtgtttacttgctattcttctagtttcaaataaataagataataagggatgtcaacttggtagtaatagcatgaaatagtatcgtaaaattaaggatgctagcgctttcgacaacaaaatgggcttgttttatttttgcagaggaggttcagtaaatattacctcagagactgatacagataattctttcttattcgactgcgtatttatctttatcgtttagattgaagacaatagacaattaaatgaatctatagaaaggttaggaaatagtctaaactactatggtttgttaacggcgaggtctttagtttaattttctgtctggaaaataactttatcctaaaaagaaaattttcatcaactgcaactttttttgttatgcttttgttctcgctaggcgaaagctccctaaaaatatccgtagaatttcatatgacacaaccaggccttgatgtaaacgtcaaactacacatttctcaaagcttagagagctgatgcatgaaatttttgcattgtgtggtattatatgtgacttaagaaagtaattgtacatcataagagagaaaaattctgttcagagaagaactatttgaatatattttaaaagataaaaaaatgtcttggcaaaaataagtaagtaatgaaaaagaaattttctcgaagaaaaaaatgaaaaaaatgactaagtactcaatatccttgattttctagttttcattttcctcaaaaaaacttgtccacattcattctctgaatcgttcttctttggtatatactatcatgcgaatacgtcttttttcttttgatattaaaatatctacagactattttgtgcacctataaaataaattttgtcatgacttgtaattttcccataatcgggactatttaaggaccaaaaatacactttcgcccaacttgctgcttgaccaggactttcgataatctcctaattacactagctagtttttacttgttatggtttgtgcagttgagatagctcagtaaaatggctttatgtgttctgatttataatgaatcgtaatcgaaatccacatatttcattcatactgacggagaataggttaagcgctgctgctatggtacctacttttactctttgtggtgtgcgattagttttgtaatacaagggtacttctggtaataaatatacaattattttatgaaactatgatacaggagggcagaagttctgacgatagagctacaaaaggtagtatcgacctaggaatttataaggactgtttttctttcaacagcatcttagatgcatgtagggaaaacaacgatgctgataatgcagaaaactactgcatacactactgaggtgtaattcatgtttcctgcagtaaccggtagtgtatatgggaaagataaaaataccaggcagaacaaggtccatagaatacatataatatgaggaatcatagacatacgacgacggttaggcctgctgacacaatttacgtcactctcgattctatgaatgaatttttcctttttaataacgaacaggaatataaaagaaggaactgcgtacgacattagtaacagggtgatgcatgcagtgataattgcgttgaaagcggtactagatcccataaatatacagccaattatcgttacacatatttgtgacaaaaaatgggcatataatggagacttaaacccaggtgtcaacactgctagcttcttcaaggatttgtttcccaaggaaccctctttataaaatggtgcgtaacttttcccgaatgattggaggattcgactttgccaggttccacttgcaatgcctgaaacaaaacctgttgtgatacacatacattgcaggaagacactgagattcctattaccagtggcctggtaaaatatttctacgataggtaaaatagactcaacgactgccgtttggtcagtgatgcagaaaaacaaaccaacgcaataaataaaactagttacaaagcccacaatgatggtagtgataataactttgggaactaagaaacgtgacttactataacccacttcatcaatcatgtgcgtagcagagtcaatgccaacaaatgcccagatcggattgaccaaaccgacaacaaacgccattccagacgaattccagcctgtttgattatcaaagctcccaaatatattagaagctttgggccatgggtctacggtgttgtcagatcttgaaacaatacaaataatgaaagtcatggcgaaagacaatagagacgtatagagcccaaactgagagatatagggcaacggagttgaataaatgttgaaaagtgtcaaaacggcattgatacactcgtaacccacaaaaacatgccagtgctttaactcgtagtccggatgcaacaacttatgaataccgatacagctcattgacaaagatgagcagatacttgcggtagtaaaaatggcaccgaaatagttcagcaaccctacaaccatggaagaaaccttttgaaatttagaagaaacttccacgttgaaagtttgacaataattctcgaggaacacttcttcatcatcgtcagaagggtcctcgtactcaggggttttcaaagtgactgattcttgttccaacattttaagaacccaaaatgaaccaccgctgctgtttggcaggatagcagcaaaatctcccagagatataccacacatgagactgaaaaaagcagcaattatcaacccatagatgataagcagtggccctccactggcaataccaacggccatcgacgctgagataccgacccatgagcaacttaatgagaacgcgatacctaatagggaccaccaattaaagtgcttgtcaaacttgacttctgacctttctgaactagacattcttatttccgtcctgtgacgatctggaacaatagacaaaaaaaaatttctttcatatacaaataggaacactgcccctactctgttcataccatgctacttatatatagctgatgaaagccttgcaacttttttatttaaactattctacgtcttgttgggtcattaatgactccaccgatggcagttcatgcaactccatatcctgatcatgtgccgtagtacattgtgcaacctgtgccataatattgacaccgaacttcttcagggcctgcacgttgccttcattcggttccccattgagaatgaccccaaaaaggtggcttctcaagccattatcgcaaagatgattccaagtcagcaatgtatgattcagagtccctagcccgctgcgtgccacgacaactacgtacactggatggccgctagtctcaatcagatgtttaattagatccgtcgtaatttccaatttacgagtgataggaacgcaaaccccgccggctccttctacgaccaatggattctctgcgctccactcttcaggaactacgaaatccaacaacctgatgtcgacattaggttcgtactccatggcctggagcggagatagaggcttctgcagcgcataagtgggcgtgaatataggtggttgccaagttgatgcggctattttgaaatttttcaatgtctcggagtcaccttgatctgactcaattccagtttgtacgggtttccagtatgcagctttccatttgtgtaccaataatgttgatacaaaggttttaccaacatcagtgtctgtaccggtgacgaatacaattggttgttgttcttgttgttgagatttgctgttcatgacctgtgcgctagtgattttttgagttcttttcactggcctacttgtggaaaaaagtatatctctttatatacttcagtaaacgaactaccagcgggattttattttgttttgcccaataattttgaattataaatagccattgtttgtatatttcattttcttttggtcgggaggatgtcaacagcgcaattcgttttctattgctaggataacaactaatgtcccaagaaatttcatatacaccagatgtcgcggaactgctagactttgataaaaaacatatttggcatccttatacgtcattgagttcaccattgaacgtttatccggtaaagagtgctcacggatgcaagctggtgttggataccgactcaccagtggacgtcgaggtgatcgacgccatgtcgtcgtggtggtgtgttattcacgggtacaataatccagaactaaatgaggcccttaccaagcagatgttaaagttttctcacgtccttcttggtggattcacccataaaggagctgtgaatctagtccaaaaacttttaaaagtgattgatgaaccctctttgcagtactgtttcctcgcagattctggctcagtagcagtggaagtagctttgaagatggctttacaatcaaacatgtcaggggaagctactaaaaatagaacaaagtttttgacaatcaagaacgggtatcatggtgatacatttggcgctatgagtgtttgtgatcctgagaattctatgcatcatatctacaacgatcgactcagtgagaacatcttcgcccaagctccctctattgtcgatggccttccaaccagccagaacggtttcgaggaccattggaatgcagaagaagttaccgatctcaagaagcaatttgaattgcatagtgataagatctgtgctgtgattttggagcctatcttacagggtgcaggaggtttgcgaccataccatccacagttcttaatcgaagttcagaaactatgtaaccaatacgacgttttattcatcatggacgagattgctacaggatttggtagaacaggtgagattttcgcattcaagcactgtcaaaaataccaggaccaacatggcatcagtccttccgatcagatcaaagttgttcctgacatattgtgcgttgggaagggcttaaccagtggatatatgactatgagtgcagtggtagtcaacgacaaagttgcttccagaatctcttctccaaatagccctactggtggctgcttcatgcatggccccaccttcatgggcaatgccctggcatgcagtgtggcagaaaagtctatggatatactactgcgtggcgagtggagaaaacaagtgtctgcaattgaaaaccaaatttatagagaactataccagtacatcaagaacccagataatgggctcattggaactgttgttaagcgtgtgtcagttattggagctgtaggtatcgtagagctatacaagaagacagatcccgagtggttccagaaaaagtttatatccaagggagtacatatccgacctttcaactgcctgtgttacattatgccaccatatgtgatcacgacagaggaattgacgaaggttaatcaagtcttgattgaagtattacatgagtggaaatcccacataaaccaatgatatacgatctcatcaagtcatttgccaaggaattcttatttcttgcgtaaaatgcattcttttacgctattatttatattgatataactcaaaataaaaaatttatggttatttattctagcggacctttatatcttacttttcttatcataaaactatgtcgaagcctgctgcacaagagaaaattgactagttcagggcaagaacgtatcacaggaagtacgagttgagaaatctggaccgaaatggtccgtggtcgcctacccgccttctgtgccatcacggtactctcttctatgttctcccattagcgctagttacactcctcagcagctgacacatctcacgatcctatcttttatttattatgagaagaacggaaaagatgggatattataggctcagcttactcttcaagcaactactgttgaaccgggtcgtacaactcatacctttgaaccctctggtaaatttttccggcagagtcaagattattattgaggcaaacctgtaaatttccttcagcatttgattatcttccgctacttgaaattttgcactatatcttcctctattaacctatccgcagtaactattcacaagaccttgaatgtagtaaacgatgtctatataacttaatattgtgtaagatcttacaagatgtactgggcccaggcttttcacggggatcaaaccgttgctctcctagatgagaaaacgctttgccatcacactgaagtagcatgggcagtattttccctcgaatattgttattatcaaagcaagcaatatcagcagtagtttttatttcaacatataagatcacctatgttgcaatctctgcaaaattagtaatgttaccctccaagtaattgtatgacctctcttctgaaggtaaacattgcgcctctttgtttaaagcagcagcactagtttatcatggtttcgttacctaggaaaggatcggtagtgctatgtaacacttggaaaagatgaaatttgttaacatgaaattgagtcccttgtgttaaggtaaaagtgccatctttaaaaacgtactctgcaaaaaatggtattgcgcatacgaagaattaagaaactggcaccattgatcttcacatcattgttgtctctcattgttctttttagggtctaccgacagtatccattctccgaccatttcgaaacacgcagagaagatgatcgctctggcaacgtgcactgcttttctagactgcgtcaaatagaggaatatgaaaagccggaattgacaagtaaattctatgaaccgaatagatggaaatcttttatatcttacgtgaccaggagtcgcaaggatgtgaaaactgtgtcccgatcgctatccaatttggatttgtatcaaaaatgctcaaaagaaatccgtgctgatcaggatatttcccttcttcatagcatagaaaccaagttgttcccatatataaacttcacagccctaaatagtgaacaatctcataatttttggcctgttcatacccgatttgatggaacaaagtaccgtggacaggtattacaattttcttctgagaacaattcgttcattggaacttcacccattgaattcaaggctagcgaacctttttgggagaactggttgaattcagctcttcaaaggaattcaaaaggtgtggtaatgagcgtatcggaatatctggtggctgatacaattcgactaataagagttttgcggctgttaaataattcccttccaattgaaatcgttcacaaatcggatttacatgagagttctcaacagctcttgatagcagcagcaagagaatctggatccttaaattatccccctcaggaattgtggtttctggatgtgaaagacatgttaaatgacgaatatttagcgagattcaagagattttcgaataagtggctggcaattaccttttgttcatttcaaataccaatctttttggactctgatactgtaccttttgtcccgttggatacactctatgaaattgacggatttaaaagaacaggtacactgtttttcaaagacaggagttttccaacctccaagttaagtccactccaagttaaagttttgaagcagataatcaataatagtctggatgtatcctcggattcggagcaaggttttgaaatcttaaaacataacctaaacgatgagatggcaattgatgcaatagaggccttgattttcaagaaacaaaaacattacatggacagcggcttagtgatattcgataaacaaaaacactttttctgtctaccaatcgcaataatgctgcaattttcgcctatccaagagtttttccatggtgataaggaatggttttggcttagtttgtttatttccaaaaaagagtttactttttatccaatagaggcttcgaatgtaggaagattagagaagccggagactctagaaagcagtacaatctgttctacccagctatctcacacggacgtgtacggtaatcttttgtggttgaatggcggattatccgtttgcaaaaaaaattgttggaattatgattttacaaagcgtaaagagattgcggccaaatacaaaagcgttgatgaattacggaattactatcaatcacctgtgaaactcgaagctgtcataatacccgatgtcagcaagtccccctggtcgcaacagagcgaatgcgttatgtacagctattgcacacattataggaagggacagtacggaaaattgatagagtttacagattctcaaaagaaatattacgagaaagttgtagaattatggaacaaggttgtatagagtatgtttcagtatgagtacggtgaatttcctataagtttttaaacttttagatttttctataaagcatgttaaacccttcttgacatcgttttcaaacggcatctttcctacggaactaggctgtttttgagatatccttatttaagttcctcttggcacaatgttattcccgcatttatatttagttaacattatgtgaaattcgctcataaaaagagccttagctctttcttcattttgcctcaagaaaactttaaaataaagtaggaatgccaacaatacttttcttcagtaaaagacgaatattggcgtagaattttaccggtaatcatatatacttggcttagaacactgacacatgcatttttctctggacccttgcacaaatcatcagtagcgcctgaatcaaaaactaacaaaataccatatctgttttaaacaaataagtatatcgcatgaagtaagtttcccgcacgtaaaactactacaacacattttcgcctagaattataagaatgtttagtgcattggctccaagcgagtaattgtacgatgcacgtgcataaaaagtgctcagtacccagttccgctattagcacagggaaattttccttacaagcgagcccttcaatagcttaggaagtaaggttactttggcgacggccatagatgcctgagtagcctttttcctttttccttccctcaagaatgtgtgaaatgacgttttcgggataaagcgggcgctagcaagaaacttctactaagagtaacgtggctgagaagagaagaataataaaggtatgccatggaataattttagaagagggggacctgcttcttagaaacacgtaatctgaatcccagagcaactgcgtacaaaacaagatcttggctttgtaagcaggaacggctttttccgatagaagaacgttttttgtttttttatgcaagaccgtctaaaaatttgcaccctatttaacatagacactcaacgaataccataattgcacctggtttcataggaccctgagggaacaatactcaaaagaacaaagactactggtagaggtcccgatatatcccttcactgccggtgactatggtaaaaatgaggttacaatttctgtatcgttagagaaaatttttttcgttaaggcaaacgcatcagcgtttacatagggaattcctagcgtagtttaatgagcaaggtacatcaaaccctagtagttcttgcagttacacaaaatattcgttaaaagccagtttttctcctctttcttagtcttggctgactctcatataaaacaactagagaagctgagaaagactccagttaatcgtgtctccccagcgtctatttcttgaacctgagatggctaaataagcttaggtaggcaaaaccatgttgttggtacatattatatctttccttctgttcttccagctttcggccgcaaaggccccacccagtaaaacgtctctaataaatactcatgagagaaggtcgatatattcatgctacgttggtttacgtaaagaaacatgggggttcaatgggtccgctatatgtcggtatgaaccagcaatccaatcgatgctttactgtctttacgaagacacgcatgagaaagggtattcaaataaaactttggagaaaggttttgaagaaatgagacaattttgctatacaccaaagtttttgaacatgactgatgccgagttttacacctcattggataatggaacatactatatacaagatcaacctaaagctggcatcaatatcacttatcctatcagactgaacactacactaagaaaagcatactatgatgcatactatggttactactataaccatgacattccgtattatttcgggggcattatctgtgcatactttgtgggtgtcatgttgcttgcaggtttaattcgttttttgaattataccccaataaaaaagattatgtttcagcaaaagctagtcaattacgtgagaggttatactactctacccactctttatgaaaagcatgcagagcccttctcgtacttaaaagtgataacaggctatcttcctactaggtttgaaacgttggttattttaggctacctcatacttcataccattttcatggcctacaaatatcaatatgatccataccacatcatatttgccgctcatagagcagaagtggcacattttgttgcgtacagaagcggtatactttcttttgcacacctgccactcattgttttatttgcgggaagaaataactttctccaacttatttctggcttgaagcatacctcattcattgtgttccataagtggctgggaagaatgatgtttcttgatgcaataattcatgctgccggctttacgaactattatttgtattataaaaaatggaatacggttagattaagagtctactggaaattcggtattgctaccacctgtttagcgggaatgttaattttcttttccatcgcagcatttagaagacactactatgaaacgtttatggccctccatatagtattcgcagcactatttctctatacttgttgggagcatgttactaacttcagcggtatcgaatggatttacgcggcaatagcaatttggggagttgatagaattgtacgtatcaccagaattgcactcttaggatttcctaaagcagatctacaactggttggatctgatttggtccgtgtaacggttaaaaaaccaaagaagttttggaaggcaaaaccaggccaatacgttttcgtttccttcttgcgtccattgtgcttctggcagtcgcatccatttacagtgatggattcttgcgtaaacgatagagaattggtcatcgttctgaaagcaaagaaaggtgtgacaaaactggtaagaaactttgttgaacgtaaaggcggcaaggcatccatgagattagctatcgaaggcccttatggctccaagtccaccgcccatcgctttgataatgtattattgttggcaggtggctcagggcttcccggtccaatttctcatgcccttgaattaggaaagacaacagctgcaagcggtaaaaactttgtacagttagtcatagcagtaagaggactagacatgctcaacgcgtgtaagaaagaactaatggcattaaagggcttgaatgttcaagttcacatttataattctaagcaagagctagcttcggctgaaaaaatttcctcaaatgaagtcaaaaacggtgaaacgacagcagagaaggccccatctagtctaagcaattcagaaaaagctccttctgaaagtgaaaatacagaactacctctttccctgaatgacacgtctatctccgatttagaatttgccactttccatgttggaaggccaaatgttgaagaaatactaaatgaatctgttaaccattctggttcacttgccgtcgtatgttgcggaccacctattttcgtcgacaccgctagaaatcaaactgccaaagctgttatcagaaacccatcaagaatgattgaatacttggaggaataccaagcctggtgaacaatttttcatatttaagtaaacactcaatgtataatatcctctaactgttgtaatttcattaacgtagatggtttgcgccttttttaggggactcttgttgattgattctaactactgaggcttaagttgtttcaaataacactttttcagaaaaataatcgtattaaaaagcagaaaaatcatacgtaagatgacagaagcttcatatttagtaactctgaattgtataacacaccaattgccgatagaatatgaaccaatcgatcttcagcgttcatgtacttaatttaactacctgtattttcttataaagataaaattggtgtataatgtaaggaccaagagaaaaaggaatcccgcatcccaagcaatttctagtggactatttcttcaaaaaataactcaataaacacctatataatgttcggaggttatactttagtgttttagaatgcagtaccaaaagtaatatattgaattaataactatatgatgtgtagctaagaattaaatagtaaacgtcttctgaaaccttttaagaggtaattattggtattccaaattcatatgtggaggtaagggagacacaaaattatctggaatgacagcgtgctgacacctataaggttccgtaacttcaaatgccttcattactcaacataggaaaagtgaaagtgtgtgcctctaaaatatacggaacatcgtcgaactaaaaaaatccattaagcaaagtcagaaacagcatgcactacaagacatttggttcatcatgaagaatgctcaattgaaccatcaatcactttctcttgttcgatgttagcattatcctcactatcagttgaatcctcaatgctttcggtttcagtcctcgcatcttcctgaacttcaagatctaaaagaggctcactctcttccagactggtctccaagcggtccacggtatcacgtaatgccttcacacaagccttcaaaacagatcttgtgcttgacccattttccttagcttgagataggactgtgatataagaagcatatgtggtagcgagaaatagtatgaataaaacggcttctggtaaaatatctattttagcaatcttacaagaacctgaataatcaaagtttataccccgtggcatacttgagcaggacatagaaccaaattttgaagctagagttacgaaagcggtaaaccacaggacggtctgaacaatttccatcacgaatattaacagaacaggcaaaaatctcacaatcccaaaataaactgaagatatgattgaaacagctaagctcaatctaaggattcgatccactttatagtttgtgattatggcaaaactagctaacaacaagttagttacagataagccaagttggaaatatcttagtacgtggaaagtaacggatgttgttgttaactttaacatatatgtattgagttattattatagatcttgacttggtaacaaaatatcaagctgtaagcaccgcctgtattctcctatttatggttgattatattttacttctgttgaaccaagaaaaaaatagcaactcgaaaagtcgcttattcattcacttttttaatttttttacatatcgcatacgtaattggaaacacgcaattttaactttgggcaaatacataaatcattttgagaagttggtttttagtctccgagagattataaaccaacatccttaaaagatagtattcatttctcacctgccaatgcaagagcagatattattcagcaagcagtacagcaaatcggaagcgaattccaatgacaatttgcagaataagattagaataatatattgagattaaagaaaaggttatgcgaattgcctaacgtctttaactttgaagcggccaaactctaaaaaaccttggttaaaatacaagctttggcgtccatgcaaactgattacatcattcagtataaagtgccatataaaagaggcacacacttttccacaactggtttgaatataatagaagaataaatcagaaggaaactttaaatattagtaatatttatttatggccgctaaaagattagtccggatatatcactatagaaatggtaaagataatacactatcatttccaaatgtaaaatttgttgatagaacgccataaaaaagaggctgactttttgtcgtccaagttcttcgaaaaaatatacgtcaatggcacccgatatatagctggatttggaccagtatatgtctaaggaaatctaacacctttttttcctgagccaaataagcggtggaattgaaacagctaccaaaatcataccaaatccaaccgcaattgaaagccccaatcttgtgccataaagagctgctaatacaatcggtgccaccagtttaccaatcccagagattgctccaattgaaggcatcaactggaccttgagtttggggtcgatgtacatggaaaaaagggctggaatgctcgaagccaaaaagttgtaccctaacaatgtaatcgacatcccagctgaaaaaaatataccagaatttgtgggtggcattgatttatgcttcaaggcttcggatgctccaatcataaaagcttgtcccagcaatgaaacaaacaatgcaaagatggacagaaaaacttgaccgctgtacagcgaatcttttttctttacctcaacggtctcacttccagttgtatctgactcttctaatccgccatctttggctctgccgcaggagcacccgacgtttattaactttggagcgaaatagcttccagtcacaccaagtatagatgcgaccataaacgctatgccttgaaacttggtgtcccagttaacgtggagcgtcaggaatagtggcataaaataaactacttcgctcataataaatgacgataggaacatgctccatagtaaaatcaagcaggagatgagtttttttctttcgactctaaaaaattgtttcagagcactgaaaaggctattttccgaatttgtaactttaacctcaggattttccagaacgacaactaataaaaggcatactgcaagaattatgaaactggaggcaaatgtcggtgcattgtaagaggcaatgcgataccctttaattttaaaatcgcaatatccaaaaaatatgacaattaattgtgccaacgccatgaagataccagccgctgctcgataaattgatagaagcttgaaaacgatacccctatcttgtgcaattgacatgatgtaactgaacactatagcaccagaagcagatgctgcaccacatataatacgcccaccgagaagggtgtttagcgacactgcaccgccgcatgaatacaaaaaattacccacaaaggataaaaagtaaagccccactattacccatttaatggacccaagaaaagcagcaatatccccaataatgaatgaaacaaaaacttgaactgctgcagaaatggcttgaattctgaacaagaatttgtccggattggtttctccgttctctaaattgttagcatactagttcattgaaattatcttagatttacattaacacttacttctttgatgtagtcaaccacacttgagagatatacacaggagtcgaaactgaattggacagctatcaaaattacagccaagtatttcaaaaacatgtgtttcttgacacctaagatttttttcattttaatttattgtaccaccgtcgagtgaaatggatggatttgtaatgcaattgagatacaattaagaagaacgaaagagtacttgacaactagaaagtaatgttaactgatcttttatatgatgattatttattgacggcgattcttttccagattaggaaattttgttccgcttagaatgggataggcttgtttgggcgctatacttctgtatcaaaatagtaaaatcaacttattttagtaatagaagagaacagtaggcgtttggtaattctaattacctagactgtcccccatttccagacagctgtcccatatttttttgagattccgacgtcgaagcgaaagactagaagaataagtaaagtggtcctttgtaagcataaagacaaaggcatgtgagaaaagtaagtgtcttcgcgattcgccgttgtaaatatgtatcagctttttttactgccttttcctggcggatcacagtaatgtatttttttttttatataattcgagctctacactcaagcatacatatatagaatagctcagttttaatgggctttctcgagaactattcacccagaaggatatcctgagccttatatttagatgtaacttagtaaagtgagagtattatgaataacttttgaagctaacaaaatatcagaaattaaacttcattcaagaatgtatttatctagaaactggtctttggcaaatggctccgatggcacacatgcaatgttcttggtaaaaactaatttattattaggccagtacagaataaaagttgtcataagaaaacttcattacattttatctcctctggcaagtatccaaattcgaaaacctcagaaaccagcgttccacctaaagtttgtttgcccgtatgttaaaacagtagctgccaagtcacttgagtttgaagaataatctgatgctttttacatagaggtctattaggctctttactttgtaagcatctcgacttaaaaaaaaaatctattgtttttacgggcatcgctgaaaaactgtgtctgttctctttgatgctgtcatctaagattcaattaaagtcgaccatcaagttcccttaataatatcccttgtgagagcttaatctaaaactacaaaagcgttcgcaacaagcagtatggacagatctaaggacgctagaaagagatctattagtttggcctgtactgtgtgtaggaaacgaaagttgaagtgcgatgggaacaagccatgtggaagatgtataaggctaaatacaccaaaagaatgcatttataatattgataaaaggaaagacaagagaaaaatcaaaaacgggtcgaaggtttttttattcaagaataatactatcgataacgggaataactctatactagagaacaaaggactaaatgaagacctttcttctcatatatatgagaaagaagcgccaaaattcgattcagatattgatatatcaagatttggcacaaatgatgctgtgatttttaataatgacgggtgggacacttctcttccgatcgattttgatttcgatgagtttaacactgagacaacagatttcgatgactttttaaaactattaggcgataattcaccttcaaaggaacaaaaaagtctttcctattcacctactgctacaggcttaagcggtgtggttaaagaaactgagagcgaagataacgctcctacgaggtctcggctaatcgatgtcttgtttgagaacaagcttcactccgtaccaggaatatcaaaatggcatctatatgagctggaatcccaatacccaaatttggaatgtacagaaggaaatagtgatgaaaagtttttactttcaactgtattgtgcctggggtcgttgaccatacgaaaaagggaactattgaatcattcgaacatagacaatcgtccacttttgccggagaatagtatttcaaaactgaccactgatgcttttaagtactataatgctgcgaaaacgcttgttcccgacttgttatctcatcccacaatcgatggattttgcggcctcgttctaatggcaaatttcatgacgatgatgatatccttagagcaccaattatatttgagtataaatgctttacaacttgctgtggctttaaacttgaacaacaatacaaaatgcaaggaattacttgagtcgaacagcgacggaattggtgtgatcttgcttttttggaacatttggtgttcttcttgcatgttggcaacaattcatggaaaaaatccttttatcactttggaacaaattacaacacctctgccgtgtgaaatatccccccgcaataaaactaataaacttttgatagatttcatgcaaatcagaatcaagctagccactctacaaagtaagatttttcaacggctatatacttccagcaccgcaaacgaggtaccattcgtaaacttagaaagagaatttgaggaggtttcactccagattaccaggttaaaaggctttccgatattcgaagaacatcttttttacaggagcagagtcttaatgttagagctatcatgtttaagagctcaagcttcttttctattatatcgtccgtatctgatcactggagaatccttacaagcagtaaccatggcaaaatcaataattcacgaaatatggagtcaatacactaaacagtttcccgataacgaaaaggaaaggcatgaacgtttggattggaatttttgttatcctttaagaacagcgtcactgacattatgtatttcatgtattatactcctaaggtataagcaggtggtgcagttccttaaaggtactgaactatttgaatacattctagcattggaaatattgcaagatttagttcaggtacttcctattgaacaaaaccttattgatataatcaaatatccgatcagtccagtacagctgagtggtgatagctttgtcgaattttggggtcgcatactttactaaaccgtttcctagctgattttttgacactttattcagaaatgaccttttgagatacaagtttactaggggaaagatccatatgacatggtagtaggtttacccttcaaaacaacatagatcgtaaaaaaggtggctgaagaacttactaaaaatgttatatgcttagattaatatattgtcaccgggctaccagtacaaacccttgataatgcgaccagacatctgttttgacttatttatgagcaataatgggtaacaaaagaacgctctgaggcaactctatgtgagtcgaaacatatgtgtttttggcaattaaacaaaatacgagagattcttctcagaaaacattgtcacaagaacttagtatctttaattttctgcaaacatactgatgatttcttcggcaatagcaactacgtgagtttcaagcgcaaaatggccagtatcatagtaaacaacctttaaattatcaacgtctttccgataagcttcagccccggcaacgctaaaaatagtatcattcgcaccccatgcaactagcacaggaatctttgaatctctcaagaacttttgaaaggctgggtacaactttatattattctgataatcgaaaaataatctcaattgaatatcggtctggccggtacgctgaattagcgcaatatcaagcgtataagcggcgggatcaacagattcgatagctggtactccatcatggtactggcatatgacattagctggatcttcaaggtacgggataagggatttaacaaataccggatcactttgatatgacttccaatattccttcaacggaccccaaaagcggtcatcgagaccctcttcgtaagcattaccgttttgagtaacaatgccagtaattctggagggaaacttcaaggctaaccgaaaacctaccggagatccataatcaaatatatacatggcaaatttttcaatactcaaagtatctaacaaatatcctatactttcacaaagggaatcaaagctgaacttgtagttttctggcgtttccgtaaatccgaacccaggaagatccggagcaatgatgtgaaactgtccagctagtaagggaatgaggttcctgaacatgttggaagatgtagggaacccatgtagcaataaaattgtggggttacctgctgcaccggcctcacggtaccaaacctttacaccgtcttgaacttgaatcttgtgaaatcttgcaatgatatttgacatttttgtccttcgtccaattctgacagtgaaagaaaagtggtcaagttcagttaatttgatcgtgcttatatatgttctttttggctcctatcacttttggctcctatcacttttgaaatttctgtcacgattatgtgcggcgcagtccctaggcaagttacagacgaatggcatgcagcgccgtctgtggaaaagatgaatactgaattatcatacctttaaatgactatgttaataacaaaggtgaatggagatttagaaaatgcacaatattgagaaaatgcatatgcgtactttttgttagcaaacatacgattatttagtctattaaaaaaatctatttactcgtcctcgttgcgcacagcagttgaatcaggcttgtgaatagcactacgtgctggcaatgcgtctggaatattgctagtggcaggctggtctatctgtgacgtgtgctcttgttcgggtctgtaagcatcttcttgttcaatttcaaaattactgtcttgacttgtgaaactggataaatcgttagcatcttcatgcaagccatctgattcatctgaaaactgaccctgaagcagcgaagagtaagtaggaccttttctgttgccaaaccttgcccttaattttgaagaaaagcgtgctacacctgccttcgtgcgttgaaatgcagacttggtaattaaagaaatgcataatcctagtcttacaatgatgttgacaactctatcggtcctattgttttctatcagcccatcgtctcctaatcttatttcttcaaatcttgaaaatcccccatttctcctgatacctctatcgtatacaaaccatgcggcaaagaaaataacgagaagaattgtaacaaaaaccagcgcataagcgccggtgtttatagaatatttttccctgaatgccttttcttttcccggacaaggatgtggtgctaaatgtgcatccaatttcagcccacctttacaggttgataagggaatttttcgatagccagaggaatcatagtattcaattaagtcgggttcctttttgcagatatcggcaccattcgccgaacttaagcctttgactaatttacaagtaccatcactggctttataaaaattatagtcacattcgaaatcttgcctcgtacatgaacagtttttgacgttcctcgaaaattcagaaagtggaatattcccaataaaacatttttcatcggttttacgtaaaaactcggtttgatgaccaaatagacaaccagttctggaacccagaggagagtacttaaaatctgccctttttttacccgtaatatcaaactcacattgcctctcgaagatgtttctaaaatcaattgtatacgttctgaatgaaccactacccatgttttttgcttctccaaatagcaaaaacctcaaagcagaatctctgggaacggtgattatatcctttacgaggactttgtcgccacagaatttataatctttccatgttttaccaaaatcggtggagtaagaaatagaatcagtttctgcgttttcggggaccaaaaccaagactccaccatgatcaccgtactcccattgatgggggccttttttaacctcagtccacgtctctcctccatcagtggttaaaaaagtggaacactcctcatatggtagaagcttatcgccaacatttccgacaccaaacatcattcctaacgcggaaccggaggaatatgtatccctgatatccttacgttcagtgtaaccatgcaaatgtagagaacatttatctaatgatacagaatcacagggaaactttttcccttccgaatccttctttggaggcttcaaaaagttccaatctgaaccgtcattaaaggtgattttcgtcttcaattgttcgtcttccttgttctctccaaccttttccctattcgaaacgatgttggtaataataataccttcaagaccttgaactttttcaaagtcgacataaccgaatgtgtttctattaacggcatgctctaaagtgacaaaagaagtaccattcgagttggatttcaaaaggtttccaaaatcgtgtcctgattctaagtttgttgctaaatgtaaaaatatcgatcctttctcagatcctaaaatagtgaatgcctcttgcttactaacatcttgaccatacgggaattttgcctcggcaaactcagtaccatcaatagttacatatgccctcaactcattgtcttcatgaggtacggcaacaataatatagccaccagtggacaagtagccgataatgttttcaaagataattttattatcaccttggaaaaaatctatcgaagaaaccaagcttcttgtttctgaagacttcttttttacttggcacataaccatctcctcatttgacggatattcaaagagtgtgcctgcaaactcacaatgaattgcattatcaagcatttctgtaaaagtttcacctccatctttggtgaggtatgctactgcatgacattctggacttaagattgattcacaattcttgccaccatagtaaataaaagtatcctgtgctttagcactaaaatctagtggcatacctaattgcctggcttcaggtaatttagctatcataaaagagtgtcctctatcgtgtgttgagaatatgttacctttagagccaaacaaatatgctgaagaattgaaatatgggttaaacacaacttcaacaattttttcgccgttagtgtcaaacctttttattgtttgtccaccatcgtgggatatataggcgtctcctatcgaattcagcatgaccaaagattcgtcggcaactgtatcgaagtattggtaaaatttaatttcgaagtcaaatttgttttcagtggtcactatttccctgtcactcgaaccctcctctggaatttcgtcacacggaatatcaacgggttcaattttcatgggtgttttacattcatcacctttgattaattgtaatggctctactaacacagatttatccttcgatttgtcacatatgttggaaaaggcaatcagattataatctggtatacacaggccgtttgcgtccctaacaaattcaaacgaacattcgtagtcggattcaccacaactattacaaggcgtttcatctaaactcaaatctttgaatgctttttttaccaaacactgggcgtcttgtttcctccttctatacttgtatttggcgccattaacacatttcccatccgccaaatcccaatcttcaaaatcttcctcctcacacgttctagagtcgaatgctgctgaaaaatcaattatatactcgacaccttttaaagaagttatactgttggtttcggaatcggtagtggcaaacgttcctttaaaaataaattttgagccagatccatctggtgttggatttatcaatttgtagggatggacagaacttatggcattggtcagctcatattcattccatgttctaccttggtccaaagaataataaaattcagattgaaaatcgccatcttcctctggatcatatgggatatacacaataatatttcccaggtcaccagtagcatataacccagaagaattatgaacaaatctccacgttaaaccgccatctctagagatgaaagttttttggtcttcccaatcgaattcactaccgtcgccaacggaacctgtcattaacataattccggcagtaggatttgagatttagatactataaaaagggttctggagcgaacatctttcaggcctagtgatatcacaagggaatgaatctgcattttcctcgtcaaccactttcaaatttgaccatgtgaggccgttatcaacagatattttagtttcatatctggctatctttttattatattttcctttgttatgagagtagtcaaaggaaggatgaaacgagccaattattgttccttctaagaaatgaggagaagcaatatcaatataaccaaagtgaggatttattgtccattcaacaggtaaaaatttcaacccttgagaatctgatattaaaatttctgagggagctggttggtcgtttttttcatctgtgaatatcgtagatataggaatgattattcttccaatagaatcttcataaattccatacatatggacgtgccgtacttgagcaggtagacgtgccttttgaaaagtagacgcatcattggatatccagatgtccatgggtgacatttcattgtatctatcatcttgtgtcgaaacgattatatgtgattttaatatcttgtattgataaataattttatcattaaactcatcaaattttttgaaagttttacctccatcagtacttaaggctaattgtgtatatgcggcacttaagtgacgatcgctatcgtaaccatggttcgagaacaaacatagtatcgaagcgtcgttaccctcaatatcagaatccttgctagatttgacaaagttgcagcttgaacttgttatatggtcatcttctttctttttcaaggaaggttcgatattgtaaaaggattccccatcgttggtaaagtaagtttcattttgtatttggatataaccattgtcgtttataaagcaagggcaatctgcaataaggtactttttatctgtcggatgggtagctatagagcaagaagtacccaaacgacagttttcagagacgggtatagtcagagccctccatgattttccacgatcatcggtgacgtaaaatttgggtgataaatgtatcgaaacaaaagccctgtcctgtccatgcaaaggatcaacaattaattcgagaatatgcccttcaatttctttgaccgcttcccaattttctccagaatcggaacttatccacacgacttgattatctaatctgattaaactgttggaatcgtcaaagctctctagactaaatgaatattctgaaagagtctccgttactttggggacgaattcctctgcattgagtaacggaataaagagacatgtccaaatcgtgcatatgacttggagtaatatcataattgaggatctcttaccttttcttagttcaaagctttttttcaaagctcggaactttatgctacgattcaatgactaaaaaaaaggtagcggataatcttttggttgcaaattggcggcatttaaatatattttgggttgcaaatattctaaaaatattctcataatattctaaaaatatctagcctaggtaattgcaattattttgagtctggttattttgagttgaccatgttcacttccttttcagtcatcaagacaacgtgtttaccatctaatggggaatcaaacagataaaactagaaactgagcaaaaatactttgatttgctaatgtcgccagtagtacgataatactataaagatatgctgttgaagctgatatttaaagaatgagaatctctaagggatcatagtctagaatggtattctgcaaaacaaattttaaatggtgaaaacttttcctcactatgtccaattgatgcttcttaggatgacgttagaattttattttagtgcaggcattaccttgctaagttcattcattaaagtactaatatacctcttactggcatgcatttacctaagtggtctccgttagccgtggtcttttcgaacgcaacaactttcaagttaagtaaaaatgatttattctataaaatatgtatgtagtgggaaagactcgacagacctgcttgccaagttctctttctaagcaattgagttggccagtccccctgaaaatgctaatgcccatgtgcgactcattccgttatccaaatatgtggatgaatcaaaagttgaatcactgaaaaatgcatacgaatctactgggtcgaagagtgcttgattcagcttcaatatgcctgtccagccgctttctatcgattcaataattggctcgattttagtctgccattcttcttcgacgaaagtctcagaacgaatattagaagaaactggtgtgataggtagcatatgaataccgtggatatattctgtgtttgttccaaaataagtagtataatcgataatattatcgaataaaataccactcactttatttcctatgatttcttcaggctcaactgtgttgtcattttgataatagaaatagtcgttcattgcatccttcattatactaatcatcaagtcacccctcaattccattgactggtcaccgatagtggccccccataacttcatagcataggcaaaattgtaatcttcactactactttcttcgttcttaccgttaccgttttcataaagtccagctgcccatgaatgaccgttgaaccaatcaaacattctcgattgtgcaaagtattcatctttttcagatggatttgcgacatctcttaccaatgaattgacccaatctttattgtcggcagcccaagtaccattcagtttagagtcaacatagccgatgacagcagctgcatgaataatgtaaccataatggaaatgatggtcattgtaataagtgttaccaaaatcgtattgcgtgctggtggaaccccaatctcctgaactgaccaaaccgttgaactttgtgtcgtaaattagtggatacgtctgttcattttgtagcagaatatcaaaggccgatttgatgttttccaaagtactcttagtactggcttcatcttggatgatttcggagaccgttaatagaatgtaagaatacttatcgataactttacccaaataatatgtgtttaacccgcttatactttcggaaatactaacctgtaattcggaattggcaacttcagctaataattgcaattgttctttagaatactctaaaaggtttgagccaagttgagaagaccatggtaaccaagatatttgtctgtttagagatgtggaaaattgtaggctcgttgttagataaccgttcattacacccttagttgtagaagcgagttgaatgccggtatagtagtcttgcattatatcactaaatgaagattcatgatggggcaaggcaaaaatcattgtgctacctgatgccgactcaccttgggtggtataagaaaattcataggtagctgtagaaccgtcagagacaccctgcagcttgaaattagtaacgtacatacctgcggcttgatcataaaagacctcgtaatcagtttcagaaggtgcgacggccaattgaatgataagaccatcaacactagcgcttgctttaatttcatattctgagctcacctccaatgaaaagtccgttgaggttaaatcgtctggtcctatcacgtaacataaccaagtgactccattcaaaagggtgatacgatatttgagaataccctgagctaaattgcttgatgattcagaaacaatggtattgaatccgacgctggaaccaatcttggcatttaaagatccatgatatataccagttgcaaatcccataccttgaaccaaaggtatttccaggtagttcgaagaatcattggattctgatagcactacccttgttgaagacaaggtcatttcatcaacttgcatagtcatacttgaatcaaaattcgaagctgagaaaacaacatgagcaattcccaaaggattgaccaaatattctgcattaccggaactgtcataaccaccgtagctatattgatctactgttgtatgttgaacagcaaaaccatatgaactcgaggtgtacttccacaatgaataaggatacacaaaggcaggtgattcctgactaccaacaatcaaatttgtataaaacttgtttgtttgaatgggaccatcgtttgacaccccatcagccaatgacataggatttggtgatctgtcaaaaacagttggtggttcatctgtcgaaacagcattgaaaagattgacaatggtcgttgttgaagagttctccgttgtggtagcggtgctactggtcgaggttgacagagaagaggaggaagtttttgtttgtctcgaagatgaggacgaagagatggtagcttgcattgaagaagatacataaatggtatctaatgtcgaagaaaccggagaggaagaagaatctactgttgaaaatagtgatgacaaaagaatgtttcctgttgaactcgatggataaactggactaacagtcgatgatagtgatggtgatggtgaagaaccgttttctgtaatgtttgaagggtaaattggactagttgtcgaatatagtgatacagatggagaaagagtgatttgtgtcctattagatgggtaagcagggcttgctgttgtagatgcgagcgtctggactaaatcctgggttgagttggatggatagaacaaagtcgaggaagcaggagttgaagcaatgaaggaatcttcgccggtagctgtagctgcatttgtccttactgaaatagtatatatcgttttattcgaggtcaatgaagaaggaataatttttgtttcttgggaagaataggaaggcatttgagttaccagtggatcgattgtaccttttgaaacagaagtcaataaagttccatttaattgtgtccccgaaatagataaagatgaagaaaataaagtcgaagtcgaagtcgaagcagtttgagataataatgtggtgactttacgcattgttgatgcacttggcatgactgaggcgacgccggaaaccgaactcaaattgtgtactgaacttttgcttttcgaattatcatttgcgtaaatatttgaaacagtgacaggatcattattggtttgtgcgcttattttttgagatacttggcttgcgtagtttgataacgacaatgacagttgaactgctgttcttgtattagaatcactgtcttgtgaattaattggagatgcgctcactctattttttggcgaaactgagagagggctatgagaagctgcagatactcttgttacaaccaccgattgtgcaacataaggctcacctactgtcaaagtagcgtaagataaagtttcaattaaatcagtttccaatatttcgtctgcattattcgatatgaaacttatatatgaacattcgacgaaacttaatagaaaaagaagtgtcagatataattgcatactagctgtttttttgttttcttttctgtatgcagaccgttactatggttatctacttgttgaaacaagcacaagaaacatacttgatattcatttttgaaacaaattgcaccaagtatttatatgtagtcctttaccctcgcttgtagtcttcgtatggtgtatatgctttgctactcttttcatacccagctcttatttttaactttttgggttcagctttatgattaactagtttttccttggtaaccaaattgggagatttcgtgccttttctgctggctttcataacaaaatatagccgaaaagagcttagcgcagctgaactcggtaacaaggttcaggtaaaaaggggagaaaaaaagaaaagaaagccagatctttcaaaaatatgccagcaaataccaaattggtcataaaatagctagcactccgctatcgagcaagttctcttggcaagcaggcttattctattcttttgctgaaggaaaggccagttctatgcttataaccttaagtaggaaacatatgcgcagcttacagcgcataaaattgatggcaacccatttagtggtactattcctgcgttattactagtatggtcgctttaaagagtggtaagatttcacattttcaaatctaaaaagcaaagtttatcacttgaaatgtacctctctgtgggctttcactaccttgtacattttcttagcagttccgtacatttttttaaacaatgaaaattcaaagttctatgtatagagattatttaggtttttagtacttaaagtattttgagaataccttggcaaacgcagaacaatcgtaaaagagattgctactgcgcactgtttccttgctttatcactttcagttctgcaagaactaaggtgtttatcagtaatgatactgtaatatcaatagcgataaaaacttcgtcagtgaaaccattctttttaacagccatctatcaaataaaagagtttttaacttgaactgggatatcaatttcagcagatccaacacctttatcaaaatgaagttttacgcggaggaaatatgacctcgagcataaacaactttcaaaacttggcactatggtagctttaaaatcatcattatattttatattcaataacagtgttctcttatactcagttgaactgacctgattccattcatttgatttccgatgtgaaagtaccgaatggtgatagtttgatggggaggtttttttattcctagaagttcgaggaattatgctggatataggagaagaagcaacaggcacacttttctctccaaccaacttcgttttcaacgcatttttcatgacaacaacattggcttccatattggctaaaacctgtacgtccttaattatactcgaaggcattaaatcagaaaaatcgagcgatctattacgcaggctagctcttgcgtcatcggcaagaagtaagtttatttttgtttgatttttagtgaactcatcgcgatatgcttcaatgttttccaaaatttccttaaatattttcttaatttcattgtatttgtgcttctttaaaagtaaatcactgtggaacctcactggtttgcaatcttttgtgttcgttgttaagcaaatcaattccgtctccagactactgatttccggtgggtcatgtggaatactattagcagcttgcatacatactagttcaagccgtaaattttctagtttttctctctcttcaacggacaatagacctcttaaattagtccagttcttttgattctgcctgtttctcattgaaaatacattttgtttttgaattagatttggacaccaatatggcaaagcattactagggggctttatttttattgttataagcccaattttctctgagttagtctttgaagtgggatcatctggttgagatgaaggaatattacgcacacttttgagaaacacatttttcagacctgtgttgaagagagatgctatagagtaagtaatttcagtttgaattttatcttcttcagactagtgtttctttttaagtgttccgttttcagtatttccagctaccgcgttccattcatacttacctcttaggggtgatagttgatcagagcgattcgcctcctgtatgtcctccttatgaatgggaatcgctcgctctattttagaaaagactttttcgatcattccaagcctgtttgcaatttcaatatcgaaatcctctaagtctttgaggcacttctccctactaattggattgttttgaaagccaaatggaactatccttatgctatactttttttcactcattaaacaaacacgcccagaagctacgtctttgcctactatcatagcatttattgagtaatttattaagctgccactagaactgtcgtttaaccatagtgaggaacctctttctgacaaacgaccataacctaaactctccgaaaattttagagtagaaagctctggatgagaactcgatggtctatcaaaccctaatgtagggggcaaaagagagtgagagaagtgaccgtgcttacaggttacgtctaataactggttcggaattttaaaagtgaaaaatttcttacgtttatcacctggatttagtatcctgctattcggtaatccaaagcttgttttatcaatggagtcaaaaaatccacaaaggtcttcccccgtgttcacgtcttcatgattatatgaccaactcgctgccatatctaccattctcaaaattctttctgtcgttttttggattccaaagggtgactgtgtttttgaacttgtcgtaccttccaaagttaaataaaacatatcgaattttataggtttggttgatttgttttctacagtgaaataaccgtgaattatatccccagaggtgtattcccttagcatgctctcgtgtttaggaagctgtccaaattttggagccgtctttgtgacgtacaattcagtcgctatgggggttttaatcctaggcaatgcgtatatattctcaactgggatacctttagtatcatcataattacgaatttgagactcagcagggccggaagcaaaccggcggccatcaacagtcacttcatgattatctgggccaacgatatcaccggtaagaatccgcatatcattcccagactcaccttccgaaggaatactctgatttcgggaagcaacctcataaaaaggtggattctccggaaagtatgtatcgaaactagattgaggtatattgctgagcaaattttcatacatttcgaatgacggcaatagttctggaaggacaaagtcatcttcctgaacattcgttatgctcgagcagtgatctccattattgcatgcgaaagcgtcttcttcctttccttgggatgttccacatctcggttcctcgaaggaggttcctccaaagagtgtggatgaagatgaagatattctttgacaaccttcaaatttattttgtggttcttttgattcttgcataaagaaaaaacttgattattctttagtcttccagaccagcgaggctatttagttctattagattgatataccaaagcgactatggagcaagttttacaatatctgtatgattggctgtaaatgcaaaactaattgtagtaaaccaacaagtgctatgctctttaatcaagggaagcatttaagaagtgatgtgatcatattttgtacaattggaattgcttcccttctataagtgtgaattattgttcatatcttccaaggaaatcatttaaatggcattgcttatctactgaacatttagtaagcaaaagtgaaatttctaggggactgttcgctaaagctgtgcgcggtctaaagaaagcggtaaagatagatagcatctagtccaatgagacgagaaaatatatagatgactcatagaagataaagtagtcctaaagaatagtggtgcatcttctttaagcctcactcattctcgcttattctttcgtatatttgcacaataggtacgcttgtcattatgtagattctcaatacttgatttaagcagacaataacaatttccaaacggagacttttttttccatgacattctagaatttgcacattttggcacctctgaaaagattgcggatgatagcgtcgttcgcgaatcccattgattctatgaagccgcatccagggtctaaattattgcgcacgtttttcggtgtggtacacactttagtcaattgtgttgtaaaaatcgattgttgaagatgccacctaatgtggtcgctttctcatgaaaattgatggcgaaggtttaacctcccaattctgttgtttgcagacattcattagaccaaggtattactgacgggctatatgcggttagccggtcattgtagtttcacttctaaagtgtacagtaacgttttgaaagtttcctttctcaaattgtctatcgtactaacattgcatcaacaaatcgtgttcgaaccgcccaaactctcacttctgcggtatggtttttttagcttggtgtcataaacttgtccattagacaagcaaggtcattgcggattcagctaaatatgggaaataaaacaaatttttagggctagggcaattgttccttgggagcaaaaaattagggcccggatatagtcttgcacaagctgtacagttgcttatatgacggcagacggtatttatgtaagcaccttagtaaaataactttgtatgagacattcctgggccgtaatatgatagcttttagcttgtgaatgatggcacccacatcctgtctaaataattttaatctcgcacgccgttctagcttgtggtcgtggtttgtcttgttcaaaacgtaaagcaattccctcgcgtaaaagtcttgataaacgccctttcgctgcaaaagacccacgcttttgctatttgatttttcttgatagtttgacaattcaataagtttatagtttgatttatcctttcaattttacacttgttaatgacatactgagagctcattggatggaagaaagcataaacgtaaatcagggtcctgagtgtctgggtgctgtctacgttagtactattcggctgcattatattcccaattcacaaataaattaggctcataaccgtaattttattcgagacatttttggttacttcaaaatattgttattatataaagatcatataaagttcttggacaagattggatacatttagttttatttttgaaaatcacaaagatgaaacaaaataaaaaatgtcagcgtgccgcattgaaaggtaaaaactaaaattaatgaacttttctaataaagatgaaagggagaaaacagtatacattgtagcagagcgtttagaaggagtactcagaaagttctaaaaaggccttatttcaaactcatgaagaaaaaaaatttccatgaatgaatgattgtatgattgtattggcatgtaatatctgcaggatccactcaatcttgaaaagatactgtagaggaatacccgaacaacaaataaatcatgttacaactctttgacggcgaagggtgtggctaccgtgctgcaacattttagttactgctggtacattaaaattgggaagatgtccaagagaagaacatgttctgctatcgaatctctcacgatatatatatatatatatttatatgactcacctggtaaaacatctatgtttcgtttcatatgagggcttaggtaccattcttttagagttaagatctcttattgtggaaaaaagaagttgaacgtgatttcatttgtttattgtgctagtggctggaaatatgaaaacttttgctcttgcaacgtacctttttacttaatgtcttatatttgaacactgctatcccagctacacaacgcattttctgaaggaagagagtttagaagaaacctttctctgtccatcgctataatcagccgtttctttttcgcttccttacgaagtaaagggtgtccctttataacgtaagcgtccaaaatgcagttattaatatactccattgcacgcaaagaaatttcaaggaaagtatccgggaattctgatattttacacttgcactaatatactcttattagaagtagtgatggtagacctcaaatcaatctaaacataatggatttccatactgttaaagacggcgatacggaattgaggtgtcctattcccgacacttttgatgcgtcagctataatcaaatcttatgttaaataagcttctgaacaagggattcatcttcgtaaggcaggtgtagccatggaatgcgtttcagtagaaggtttggattcttcttttttggagggccaaacctttggcgatattttgtgtttaccatggacaattatcaagggtatccgtgagcggaagaatcgcaataagatgaagatcattttgaagaatgtcagtttgctggctaaatcaggagagatggtccttgtcctaggaagaccaggcgctggctgtacatcatttttaaagagcgctgctggtgagaccagtcagtttgcaggtggtgtaacaacaggacatatatcgtacgatggtatccctcagaaagaaatgatgcaacattacaagccagatgtaatctataatggtgagcaagatgttcatttcccacatttgacagtaaaacaaactctagattttgctatttcctgtaagatgcccgcaaaaagagtcaataatgtaacgaaagaagagtatattactgccaatagagaattctatgctaaaatttttggtttgacgcatactttcgataccaaagttggtaacgatttcatcagcggtgtatctggaggtgagcgtaaacgcgtttccattgctgaagcattagcagcgaaaggttcaatttactgctgggataatgctacaagaggtcttgactcttctaccgcgctagaatttgcacgagctattcgtactatgacaaatctgttaggtacaacggcccttgttacggtttaccaagccagtgaaaacatttatgaaacttttgataaagtcactgttctatacgctggaagacaaatattttgcggcaaaactactgaagcaaaagattattttgaaaacatgggttacttgtgtccaccgagacaatcgactgctgaatatttgaccgcaattactgatcctaatggtctgcacgaaataaagcctggctttgagtatcaagtacctcataccgctgatgaattcgaaaaatactggcttgattccccagaatatgcccgcctaaaaggtgaaattcagaagtacaaacatgaagtgaatactgaatggaccaaaaaaacatacaatgagtctatggcacaagaaaagtcgaaaggtacaagaaaaaaatcttattatacggtctcttattgggagcaaattagactttgcactattagaggtttcctaaggatttacggtgataagtcatacaccgttatcaacacatgcgctgctatagcacaggcttttatcactgggtcattgttctaccaagcaccttcttcaactctaggggccttttctagaagtggcgttctgtttttttccctcttatattattctttgatgggtttagctaatattagtttcgagcacaggccaatattgcaaaaacacaaggtctattcactatatcatccctcagctgaagcgttagcaagtacgatttcttcttttccattcagaatgattggtctaacatttttcataatcatcctgtacttcttagccggtttgcatagaagcgccggtgctttttttactatgtatttgttattgacaatgtgttcagaagctattacaagtttgtttcagatggtttcatctttatgcgatacattgtcccaggccaactccattgccggtgttgtgatgttatctattgccatgtattcgacgtacatgatacaattaccttcaatgcatccatggtttaagtggatttcgtacattctacccattagatatgcatttgaatcgatgttaaatgcagaatttcatggaagacatatggattgtggtggcactttggttccttctggacctgggtttgaaaacatcttgccagaaaatcaagtgtgtgcttttgttggttcaaggcctggccaatcttgggtcctaggtgatgattatttgagggcccaatatcaatatgagtacaaaaatacttggagaaacttcggcatcatgtggtgtttcttaattggctacatcgtcttgagggcggttttcactgagtacaaaagtcctgtcaaaagtggtggtgatgctctggtcgtcaagaagggcacaaagaatgctatacaaagatcatggagcagcaaaaatgacgaagagaaccttaatgcctctatagcaacacaggatatgaaagagatagcttcaagtaacgacgatagcacaagtgcagactttgaaggtttggaatctaccggggtgtttatttggaaaaatgtttctttcacaattcctcattctagcggacaacgtaaacttctggacagcgtaagcggttactgtgttcctggtactttgacagcattaataggtgagtccggcgctggtaagaccacattattaaacactttggctcaaaggaacgtgggaacgattactggtgatatgttagttgatggtctcccaatggacgctagtttcaaaaggcgtaccggttatgttcaacagcaagatcttcatgttgctgaacttactgtcaaagaatcgctacaatttagtgctcgtatgcgtcggccacagtctattcctgacgctgaaaagatggaatatgttgaaaaaattatatctattcttgaaatgcaggagttctcagaagctcttgtcggcgaaattggttacggcttgaatgttgaacagagaaagaaactatcaattggcgttgagctagttggcaagccggatctgttattgtttttggacgaaccgacctctggcttggattcccaatccgcgtgggccgtcgtcaaaatgttaaaaagattagctctagcaggtcaatcaattttatgtactattcatcaaccatcagctactctttttgaacagtttgacagattattgcttttgggaaaaggcggtcaaacaatttattttggtgaaataggtaaaaattcaagttctgtcattaagtatttcgaaaagaacggagccaggaaatgtcaacaaaatgaaaatccggcagagtatattttagaagccataggagctggggccaccgcttctgttcaacagaactggcctgatatatggcaaaaatctcacgagtatgcaaacattaacgaaaaaataaatgacatgattaaggacttatcttctacaactttgcataaaacagctacaagggcctctaagtatgcaacatcgtattcctaccaattccatcatgtgctgaaaagatccagtttaacattttggagaaacttgaactacatcatggccaaaatgatgttattgatgatcagtggcttgttcattggttttacctttttccatgtgggtgtaaatgctattggattacaaaatagcttatttgcctgtttcatggctatcgttatatcagctcctgcaacaaaccaaatacaggagcgtgctaccgttgctaaggagctatatgaagttcgtgagtccaaatctaatatgtttcattggtctttacttttgattacccattatttaaatgaattgccttaccatttattgttttcaacaatttttttcgtttcatcatatttccctctgggtgtctttaccgaagcctctaggtcaagtgttttttatctgaactatgccatactttttcaactttactatattggtcttgctttaatgattctgtacatgtctccaaatctacaatctgccaatgttattgtaggttttatactttcgtttttgctctctttctgcggtgctgtccaacctgcctctttaatgcctggtttctggacattcatgtggaaactatccccttacacgtattttttgcaaaatttagttggattattgatgcatgacaaacccgtaagatgttcaaagaaagagttgtctcttttcaaccccccggtaggccaaacatgtggtgaatttaccaaaccgttttttgaatttgggactgggtatattgcaaatccagatgcaacagcagattgcgcctattgtcagtacaaagtaggtgatgaatacttggcgcgcataaatgctagctttagttacttatggagaaacttcggtttcatttaggcttatatccttttcaacattgccggtatgattgtggtttattacgttgttcaagttaagcatttttcccctatgaaaattggcttcgtaaaaagaataacaagtaaatttaagagaaaatgaagaaaaaaattgcaggtatactatgggtgcaggtgaggcggttttttaaccgatttagcacacgatactgtgaattttgggttatatgatgatgtgaatattgcagaaatgtaatgttatattattcaaagaaatagggtaacttctatttatgcaaacattggtaatcaaggctataaacacataatcccaaataagtattttggtacacagttgatgtttctttatgaatacgactcattagttcactgtcaaattgccaacgttcagagggacctacttacagagcgtatgttttatatttacgacgaacgcgatctaattattatccgctggttaaacagcgtaataatgttcataggggccttgcatgacatttgaatttgaacattactagagttcgtgaaattttgtcaatgaaaaaataatgtgacaaacgtctgcaaataacctgaagaattttatccgggataacgacaaagcgttaaatatagaaacatagtgaatgtactgctaggaaaaaaataggcataatttaatctttattcatataaatgtttttaccagaactctcttggtagatagttttgatatacggtttcctgctcaattttagtgaggctgggacgtaaagtatttttttcaaataaaccatttcttgtttctacctttttagtacggattttttttagtaagttctgtattcttttttaagagtaaaaaatattcagaccccaaactcacaaaaagcctacagagtccgcctgttacgctcaatttagtactaccacttgtgataatatttattttgggacaggtccaaaaacttttaggtttaaacgtacaaacgttgagtttaatctagatcatatatcattataaaggttttatctacaagcaagtgaagaaacgtaacaaacgtaaaaagcttcagcctcacctaaatatcgaatttgtactgagtctttgaagtgtatacctcgccgcgcttcagaagaacacaacctctccactcatcacggttgatagcatcaacgtatctaccttgctgaacggcaaatccagaccttggcacaaatttgccacataaattatcaccggtgtacaaatgaacggttggttctgtcgtcgaaacctcaaatttgatgtgagattcgggatgataggccttaaaaacaggaaccaatttgttgacactcacagaatctgtagtcttcaaatccttgttagcgtcaataatgaaagtgcaatcaaagaccggagtatcttcatgcaaaacggtgggcttagttgaatcaaaagtagcaatgttcctttcaatgatcttaccagttggaagcaatgccccctctgtaacttcaagcgatttgttcgagcagaccttaacttctgtaccacgaatggacttctcactcttgactttgttcaagttaaaatacgagtggttggtcatattaattggagtagcatcaccacgaactaactgtgcttggtattccatgtctaaagtcatttctgcaacattcaaagtgtacttcactgtgacttccaagtcacctggaaactcgttagggttgggctgtgtgtgatcatccaacaatttaaattcaacaacgtaaacgcccttggaaggattctcaacaggggacgccttgtactgcttaagatttaaggaactgatactgctgtgatttgtgttaccacaattgttaacagttaacttgtgaggaccatcatccaggctgaaaacacccttggcgatacggttggcataacgaccaactgtagcgcccatcatgttaccatctgttaaatagtcttgtacgtttgaataaccttgaacgactgattggccgtttaccttcaggtctaccaaagttgcaccaagtggcgcaatggtagcttggaactttttctcatcaccaattgtaatgacaccatacttattatcaccgttactatttgacatttcgctgtttgttatctgttttgattttttttttcactgcttatcatacaaactgatcaattgagctatcaaacttcaacttatctctgtatttatatgctgaaagtatagagtgtacataaaaatgtatcacatgtctattacatattacgacacccccacaatattttaactgatcttaataacacggggtaggaagtttatttcatcataccactcaatgagctaagctgccaaaggctcctgttcacttccttgtggttcgtaggctattcagtggcaacgtaataaacaagaaaagaaaaaatttcaacacctttattctaaatgttgtcagaagtaattatagtgggggtattgcagatgtaaatgaaatacgacgtactgtggggggcttttctttttcaagaatcctaaactattccaatgggattgcgtgattatgtttcgttagagtttttttctatatctccgttcttatttcttaagtccgccccttgctgtaaccagcccggctattatttgacgaatttttcacatcttcattccttgccgagaaagaagcttttgcctccctggggttattataaaatatatctgacgtcactggtttgcagccaaaaagtttaattattttaacttcaagggttcgtttcggagtaaatagtcaatgcacaaaataggaaggtggaggtggggtatgcatttttgtgcatagagtggcggggtattaagaataatgcacatataggcacataggcacaaatgcgtgggatgacttgactgtgcaaagaccgttagcaacctagaatgtggaatagtatcccaaatgatgacgtaaacgttcgaggataatattagataatataatattagtatcctcgtctaaaaacaggcaaaatagcacggaatctattcaaaagaaggcggcaagcagtatcaattgagataagtgtatacgaacggtgaaacctccttggcacagaattttatcgttcaagtggtaggatagcattgctgccataacaccctccttaatcacaggataatatggtgaacgagatatataaagcgataagtttaggtgtgatatttttctttcgttgtgcaagtgttgtgtaaattctttctcatttgataaatcaaaaaaaaaaaaaaaaaaaagaaaagaaaagaaaaattaataaaatgcaatcatccactgaaagtgatagagatattcaggatggtcctgatgctgatattcacgtcgcaccacccgtggaaaaagagtggtcagatggatttgatgacaacgaagtcataaacggggataacgttgagccaccaaaaagagggctcataggttatcttgtcatttacttattgtgttatccaatatccttcgggggtttcctgcctggttgggatagtggtatcacagcaggtttcattaacatggacaactttaaaatgaacttcggttcttacaagcatagcactggtgaatattatttgagcaacgtgcgtatgggtcttcttgtggctatgttcagtattggatgtgccataggtggtcttatttttgcccgtcttgctgatactttaggtagaaggctggcaattgtaatcgtggtgttggtatatatggttggtgcaattattcagatcagttcgaatcacaaatggtaccaatacttcgttggtaagattatctatggtcttggtgctggtggctgttcggtgttgtgtccaatgcttttgtctgaaatagctcctacagatttgagaggtggacttgtctcattgtaccaacttaacatgaccttcggtattttcttgggttattgtagcgtttatggtacgagaaaatacgataacactgcacaatggagagtcccacttgggctttgctttttatggactttgattatcatcattggtatgttattggttccagagtccccaagatatcttattgaatgtgagagacacgaagaggcccgtgcttccattgccaaaatcaacaaggtttcaccagaggatccatgggtactcaaacaggctgatgaaatcaacgccggtgtccttgcccaaagagaactaggagaagcttcatggaaagaacttttctccgtcaaaactaaagtccttcaacgtttgatcacaggtattcttgtgcaaacctttttgcaacttactggtgaaaactactttttcttctacggaactaccattttcaaatcagtcggtcttactgatgggtttgagacgtcgatcgttctaggtacagtgaacttcttttccactattattgctgttatggtcgtagacaaaattggccgtcgtaaatgtcttttatttggtgcagctgggatgatggcttgtatggtcatatttgcaagtatcggggtgaaatgtctttaccctcatggccaggatggtccatcctcaaaaggtgcaggtaatgccatgattgtgttcacttgcttctatatattttgctttgcaacgacatgggctcctgttgcttatattgtggttgccgagtcgttcccttcgaaggtcaaatctagggccatgtcgatttcgactgcatgcaactggttgtggcaatttttgatcgggtttttcacaccattcattactgggtctatccacttctattatggttatgtgttcgtaggttgtttggttgcaatgtttctgtacgttttcttctttttaccagaaacgattggtctatctttggaggaaatccaattactatatgaagaaggtataaaaccatggaaatctgcatcttgggtcccaccttctaggagaggtattccttccgaagaaagtaagaccgagaagaaggattggaagaaatttttgaagttctcaaagggttctgattgatcatagagtgcatatgcttgtcttgataggcaacattgtatattatattttacataataatgtgtaattctaatttgtcacgaatttatgaagattcttggagctatgaagatcaacatatgtagaaactggtatgtgtcataggtaaaaagtattcattaagacaaaattgtgtctaattcttagtcatttattcaattttttttttttttttttacgtaaagcggggtggagtgacatgatatggtgatggtgatgagaaactctaaatggatccatttgactatcgattgaaaatcatgaaagatgcgcttgaaggaacataacacgttactatttgtctaaataaaacaatatacaaaaatacgacattatatatactctacccaagatatttagtcattactatcgagggcgcgtagatcagatcacctttaaaatcacacttggtctaaaatttccttaatagcggcaattggccctttatcataaactgtttctagggagtgggtcaactgtgcaacgaattctttgttgtcacgaatctcaggactgaaaagcacctcaatgttgagcagttcgtgaggatctttaccacccttaactgcggctgccttcaaggttggtgccataggatcctcgatttcgaatggcttcccattcatgtctacaccagtcaggtaacggaaccagccagcaacacatactgccaataacttgtacttaccatctggtttacgcaattgctcgtaaattgatggcaaaacatacttaggcatcttaccagagcccatcaaacaaatacgtgcgacagtgtcctgaatagctggattggagaatctttccaacactgatgcagtgtactcttcgaaatcaacacctggcactttaggcaataatgggataacttcctcacgcatcaaaacacggatatacttgttgatagttgggtcgttgacaacctcatgtatataggtgtagcctgccaagtatcccaaatatcccatagcagaatgtccaccgttaagtagacgcaacttcatcaattcgtaggaatcgacatccttgacgacctgaacaccaacaagttcccatggaggacggccatcggagaagttgtcttcaagaacccattggatgaaaggttctgcgacaacgggacattgatccttgattccccaggtgtcagcaacgtatttacgctctttatcggtacaacgtggggtcacacggtccaccatgctgttaggagaagtaaccttgtcttcaatccaggcggcgaatttctcatccttctttaacttggcaaatgcaacaagcatggtctttactgtgacaccattttggggcatgttgtcacatgacataatagtgaatggggtaagacctctcttgtaacgcaacaacagggcctcatatagatacccatacagagtatctggcttttctgggtggttcaaatcattgataatctcgggagcatctgtcattaaggagtttgttgcttcactgtggtagtaaccgttttctgtgaccgtcaaagaaacaatgtgtgtgtctggattggccatcttttcaataacagctcttggatcatcgggagcgtacatgtaagcagtaatagaaccgacgatataagcgttagtgtccttgataccacgctccacaagggtgtataggcaatcttgggccttcatggcatcgcgcataagtgcatctgctttcattaaaccaacaccacatatggaccaatcctttaagtggtgctcctgcatcagacggtgcatgaaaacagctaaatgggaacggtggaatgcaccgactcccagatgaacaataccttgtttaacaccttctcttggataagttggtattggaagagtggattcaaaactctttagagttttggcattcaagctggtagctgttgtttcgtctgattttgtcatatttttttttttgtttaaattgttactttttctttttagttttctctgattatttttgtttatttttattggagttatacggaaagatctagacgaagtggaaatcttaacaattggataataaatgttcgctatttatatgcaaaaaatgaatgaattttgaactatgagtctgcaaccactgtaacctccttcctcctagaatatgattgtttcgaacttatttggaaacgctaaaagtgattcttgattatttctagactttgcgatgccctctccgaccaccacagcagaatatacgaggtatccgtccatatatccaccactgatgcgcaagcttaattggttcacgtccgcacgaaaagtttataaaatgacgtatcatgggggggagtgttgaatcaaaaaagtggcgagctaaaaataaaagaaaagtgtacgtggaatgaactgtttgctgagctcatcctacggtcattttagcccgtgccaagggaaagtgactatacggtggggtatcgcggggtaaggagactcaggtacaaaggcaaaaatcaagataggcacataagaaggcacgaaactaccccacgtttcaagttttgctatatcccttatttattgcgcgccctgcaggaaaataagttttaggcacttaaaaaataaagttcccggggtcaatttctggtagtggcaagcaaagtatactgaagttggcaagcaacacgtagcctctgcatatatcggcctttctcggaatgaaataatcaaaaaaatattatgcgggaagccgctgttttattgagcattctaatgctttctttttcccagcacctaaaccacacaatactttactccagttccgtatttgcccctcccatggcatcacgcctataccttaactgttaattctcaccgtccccattatactaggtttaaaaaagaaggtggtcaatcctgttgatatctgtatctctatataacaaaacttcggtataaaacattcacacttcgagtaaaatcagtacctatcttcatggaccctccaaaatgtcaaattgttatcaagcgattgataactctaatgcacaggtgtaataccgttttactactgtcaaagaaactacatatagtgtgagaatccaaagctaacattttcgagtaacttcgggttttaatagattattatctgaatgcgaagttcaacatttgttgtttccagcggccttctttgtttcacaatacagaaactaatatatatatatatatatatatatatacgctgcagttcatattttagtctattttttgaataaaggttccattttgtcggagaaaagattcttcgactttgctctagaaattaaaaacgatggaatattaatcgtcccaagtaacggtagtggaaattggccaaaccctgcatttggcccaagggagacaccacttggggcatgtcctgtctcaagacaatctgcatcaacgagactagcctctgttccttcttgtaaagaacttataacatttcgggtcaaaacatcaacccaattatctcttttaaccaatccgtgatatctaaaattcgttacatcaccaatggcaaaaacgtttcctgcctcaacagcttttaccctgaagtttttttcaacttgaatgaaccctttcttgtcacaaaggtctgaaatactgttgaccggcacatttggagaaataccaacgcctctgtaaatcaaatcagcatctatatatttagatgagccctcacctagaaaaatacgtttcggcgaggtgtctaaagaagcccctactgtgttcaagtacaacgtaataccattttttgagagatagtctgtcacattttttcttagggtatcgttgtataacccagagtccggcagtagcttatcggaattatgaataatggaaatacgctttttgccagacctgatctcctccaaatacttgaataacaattcaccagctagttcacaattaacaaagccaccgccaagaaaaagtatgtgatctgcatctgagattcgagaagcctctctttcaaaatactctttatagttatccccgaaggtataagttgaaccaattggatcagcccactttgagccagttgcaagaaccaagatatcaaactttatggccctgtctgaccccaaaactacctccttatcatcaaagctggcagccgtatctttgataacttcaataccactatcaagaacattttttaacggcaggatcgacttggtataatcctttgaaaccgtcaaacggacagctgagggtagaaaatacacataattagatgctgtgacgagctttattgcgtatgtcccacccagttccctgtacaagtgatttgccacagacacaccaaacacaccagcaccaacaacaactatgttctttgtgttaattgtcatatattttgcaatttctttcttcctttctctgctctttcctgtaaataatgaagaacaacgatgaggaaatgtgtgtctatcaatgatttatcactgctttcgtttctagtctgcagcagctaatatattaatacttataataggcttcatttgtccagccagataaaaaggactaatcatgcagggtggacattcaattaatttttatcgctttttaacgattactaatccagtattaccaactacaatcactcagtcatgtatcactaataacgaaaagtaagctgtacaatgctcatcttcctagcactactagtactgctactatgagacaccattgaagtcttcttcaagacccccattatgagaacacttggctcactatacaatcggcgggagatgggttgttattatagagagtttcaggaaaagcactcctagattctagtcaagtactgcctattgtataagagacgagggcacgagatagcgcagtattttatgatgaaaatatgaaaataaatacttaactcattgagtaagcttagctgggcaacttaactaacagtcaaaaaaaaaaaaaaaaaaaaaaaacaagagccagcaaactgacattaacattgatcaataaaataagaaaaaatgtaccagagaattcgattatgaactgatgacaatatcattaaagactttgcacagtattcaaaaactaatcgagagctttgaccaaaaagtgtcccgactttataatgagaccgccgcttaattcataggagttatatggtatgctttggaaagctattacattgtttgataattcaaaaataagccacaatacttcacctattgtgtaccatgtattataaaacatcgcagctcgtatctgtaaacatacattgacttacattttagtgataacttgggtacttgagtgaagtccatttctcccgtgcttccggaacataaaccaacatagattctctttcactcgaaactgctcgaagctgttgctctttttttgatcgtggctttaactataaaactcaacagctgcgtgatgaacgcgctgtcaacaaatttcatcttgcgaattatataaaaaacactgcgagtgattaaacctcagtaaacttgttacgtacctcataacattaatgtgaaatacactatattgaatatgggggaagagattagacttttgtcctctaaaggtcttgagacccatagtagcttttgtttgcccgaggatattttcagaaaccgtttaacatggttgtgcagtgagattcgcaactcaggattttggatctggtcgctatcatggttaccgcttgccgtttggtgggggatggccagtacttggttttatccccttctgacttcagtagttctaatcctggcgctaattgctattttgccagtagttcaaatacagtacagtaaatatactttatcaaatcaactcacccagctttctaaagaaatcatcaaaagtgcaccaggtgcatactctgctgattgggacgctgttgcaatacatttcaattcctacttgtatgaaaacaaagcatggaaaactgcacattttttttttaatggtactgactgccaagaagcattcaggaaaaccattctagagccagctgttttgaggagacaaaacgaagatcctaggttcagttcaattgagattttggtcccttacaccgaagacgcggtgcaggtttattttacaaaagtaaacgcacagtggaggttgatccatggtaagaaggaatgcaaacttactatgttggaaaatgtcaagcttcctaaggaaacctatcgctgcaagctagcatggagttgccagagaatcaggatttctttctctccactagacttccttcctgatatgtctgacttctttatttgtgcaaatttatcaccagcatgcttggtatcttattggctaatagacattttctttagaatgatagatgattttcaaaacataaggcctaaatcgatgaaagttgatgataaaatgcagtacctatcagatattataaacgagcagggtgctagccctgaaaaatgggatacaattgcaaggaaaacgaatacacgattatttgaaaagagggtctggaaaaacgaagagtttttctttgatgggactgattgtcaggcattctttgaacggaactttagtagccttttgttctcaaaaaaatctgcgtcgcctagatcattaaacgttgaactttggaaatacattcaagaagcgcaattgagctgtaactatgagccgttaccataaagatagaaacatttattttgacttagaagctacaaggaggatcaactattaatatttttcctagagaacatttttaaaattggattcaataaattagcgccatctattgcccttacacttttctccttcatatctggctagaaaagggggggttacatctcggaatcaaatattttcctctgcgtcgagttttaatcctgcttctggttacattcttttttatcatacacgattctttgaacatcaacttctctcaaaaccatccgccttcagcggctacaattacgtaattgcaccaaggcattcgcggagaattcacgaatttgcagacgccaacagtatacgactcccaacacacgtctaatatcttgtacggatttcaagagatagaaatattacttccatggaagccgtttagagcagactgaatatgggcttagacaataagcttctgaacgagggtcttaaatctaaattcggattttctttttgaccgaaagcggaaacttcgcaggcgcgcaaaaggggttttcaaggcacctcggcacccctataattggcattctcacattctgcgcatacgaatacacatgagtgccataaaacagtactccacatacgaagtctatcaaagatgtatgattcgttcaaaaacaagaacatcttcatagtgataatgagattgtgtgaaagatgagatatggagaatatgtgaggtgctaaatgagcatctgttaacgaatcgtttaagtagtgataacagatggaggaacgggtataaatagagctgcttcaactatatgcctttgaggtatgcgctttcatttcactatttcttgttaagattacatcagcactaacaaacaaaacaaatacaatggtcaaattaacttcaatcgctgctggtgttgccgccatcgctgctactgcttccgcaaccaccactctagctcaatctgacgaaagagtcaacttggttgaattgggtgtctacgtctctgatatcagagctcacttggcccaatactacatgttccaagccgcccacccaactgaaacctacccagtcgaagttgctgaagccgttttcaactacggtgacttcaccaccatgttgactggtattgccccagaccaagtgaccagaatgataaccggtgtcccatggtactccaccagattaaagccagctatctccaaggctctatccaaggacggtatctacactatcgcaaactagggagtgatgcctttacgaatgaaaatccatagacagtgaaaagtaatgaaaaaataaaataaaaaactactttttttgatgatataaataccgttgattatataaatgtatattaatattatagacctatttgatcaatgacggtgttcgtgaagtatttcatgaatacgataaacataagaaagaaacttttacactattgtagaaaaagcgtggacggaaataaagctaacagagtatgcccaataaacaacaatgaaattggaagcgtatgacttcgcagcactttgtccttccataaaaatgagtcgctgcttcttttttcattttttggcgcgtcgcgtcgggccgtatagaatatgcgtcacttctaagaacaagattgcagatcagggcagtgcgagttacaagtcatggtaccagactctcatttagagaccctcatttttgacacttaaaatatcaaaatttctgggttgcgatagtttttgtgtaactgtaactagaaataaagctgaggggttagtgttttatcaacaataagatagagggtggtaagatgaagtgagacaatatcgtaacgtccgttttagtatacggcgctgataagttatattaccgtagaattatttggcgtttcgttgactcctacaaaaacaacaaacctatcaccgtatcgtcttctttagatatagtctcttcgtatgagtagtgtcacatacaagattaaagatgcatcagttatccttttaggatattgcggttagcatatgggaatggaaataggatacaattttatcatagcaccggcatgagtttgagccactaccgtattgtttctcggtgaatatagagtgttacgacagtgaggtggcatattattctaatgtatggtctgtgaaagttagaaatattctgaaatggcatccgttcaagcaaatggtaatattaaggaacttttacgttaatgacgttatggtagtgctcatacttcaagtcaatatgtttatttcgtaaagttgaaagataaataatttttatgtttaggtgattttggtggtgattttgtgggtatattgaaataagtgtgtataaattgagtggttagtatatggtgcaaaagtggtataacgtatgtattaagagcagttatacaatatttggggccgccgaatgagatatagatattaaaatgtggataatcgtgggagttatgggtaaatggctcagggtatagaccgctgaggcaagtgccgtgcataatgatgtgggtgcatttagtactgatttagtgagagatgggtcatggagtggagtgcaatatgagagtagggtaagttgagatggtatatactgtagcattcgtgtgcgtatgccccatcaatataagtgaaggtgagtatggcatgtggtggtgggattagagtggtagggtaagtatatgtgtattatttacgatcatttgttaacgtttcaatatggtgggtgaacaacagtatagtgagtagcagatgggggatggtagggtaatggcagggtaagtggtagtggggttggatatgggtaattggagggtaacggttatggtgggcggtggttagtggtaagtagagagatggatggtggttggagttgtagaatggaatggaacagggtaacgagtggggaggtagggtaatggagggtacgttaagagacaggtttatcagggttggattagaatagggttagggtagtgttagggtagtgttagggtagtgtgtgggtgtggtgtgtgtgggtgtgtgggtgtgggtgtgtgggtgtgggtgtggtgtgtgggtgtggtgtgtgggtgtggtgtgggtgtggtgtgtgggtgtgtgtgggtgtggtgtgggtgtggtgtggtgtgtgggtgtgggtgtgggtgtggtgtgtgtgggtgtggtgtgggtgtgtgggtgtgggtgtggtgtgtggtgtgtgtgtgggtgtgggtgtgggtgtggtgtgtgggtgtgggtgtggtgtgtgggtgtggtgtgtgggtgtgtgtgggtgtggtgtgggt

SEQ ID NO: 12218 - DNA, 1091282 bp, Saccharomyces cerevisiae
acaccacacccacaccacacccacacccacacaccacacccacacacacacacacaccacacccacacacacccacacaccacaccacacccacacaccacccacacacacacaacactaccctaatctaaccctgtccaacctgtctccaaacttaccctccattaccttacctccccactcgttaccctgccccatttaaccataccacagcgaaccacgatccacatctctacttcctaccaccaacccaccgtccaccataaccgttaccctccaactacccatatcctactccactgccacttaccctgccattcctctaccatccatcatctggtactcactatactgttgttctacccaccatattgaaacgctaacaaatgatcgtaaataatacacatatacttaccctaccactccaatcccaccaccacatgccatactcaccttcacttgtatattgatatgccatacgcccacggatgctatagtatataccatctcaaacttaccctactttcacattccactccatggcccatctctcactaaatcagtaaatatgcacccacatcattatgcacggcgcttgcctcagcggtctataccctttgccatttacccataaattccatgattatctacattttaatatctatatctcatttggcggcccaaaatattgtataactgcccttaatacatacgttatactattttacaccgtatactaaccactcaatttatatacacttatgtcaatgttacagaaaaatcaccactaaaatcacctaaacataaaaatattctattcttcaacaataatacataaacacactcaattacgtatcaataccaccatgacgtcattaacgtataagttccttaatattaccatttgcttgaacggatgccatttcagaatattacgtacttatgcagaccatacattagaataatatgccaccttactgtcgtaacattctttattcactaagttataatatagtagtggctcacattcatgcgggtgtaatgtttatctgtaatatcgccgggattttccaccgttatatgacatatatatatatatatatatatataggaatatgatataatgttattcattttcttgttctctatcaccttcgtcaaagggatgaaagcatctctaaatattatcatgtttatgctaaatcctgcaattgggccactatgcagtaatattccaattattgaaactatatcaagtcttaaccagggcgtgcgggctacgttaatatgccttccgctaggaagaatatgcgcggatgtactatacagaacatgcatttatgaactgcacatacgccgttaagtagcagcaaagaagattgtattttggtacagttgcaaggttaatacaaacctcatgtgcatatatacatatttatgcgcatatacaccttgtctgaataataatatgtcaagggcggatggaactgctatctaatttgtaaataccatgctgtaaaaccataggaacgttttgtaagctacatgtcgttaagagcatagcatcattacctcaatacatgacattaataccagcagtaacgtatttactgctttacttgcgtagttgattactgaaaaattatctaaacattattcgtaccatatttttgagtcaaggaatttaacacgataaaagtgttaggaaatccgatgtcaaaaggaactacattttccaagtattttatattgtccggcgttagatcgatactgagagccttaatgttctctttgagatcctcaatttttcctccttcaaccgacggaaaaacatttttcgccttagagcgaacataggcaatagcaatagcagtaacagactcagtgccatgttcctcagcaaccttggctaatgcttcactaatcttgatttctgcatctgtttgttcggaggcgccaacgaaagaacgaatacactctccattcttcctccgttcctccattgcttttttactctgaaatcttccacctcccatgacatcccatggggcgagggccataccgaaatgcctagccattggaataatatcacgctcaaaatctctgttcaacacgttccaggctgaactcgaaattgcttactatgttctatccgtctaaaaatggccttttctatgaatgacaatggtcctagtatacttcttgatgtgtcttcacaaggaataccattagcataattgctaaagtcaacaagcgccatgccgtacaacgaagcacaaagtgccctgatatagtggtcatgttgcgccagactatgcgcagcaaaaggataatccagaaatgtgactaatcctactataactagcatatcttcggcgttccatatcgacagcgtagtattaacgacaccttcaggcacttgtaaggaatatctaagcccagtcctttcaagtacaggttgctgttcgaaattgagcttatgagaggaattgaatccatcagagtcgtttgctgcaacattggcagataaatctgttctctcttcatattcacaccgtaatgaattttgttggcatcgcgagcaagcaggccgcagtttatcacgtttccacttaaccttttttcactgtggttgaatccatggcagcatttcagcagccaatttcttgtacatgtgtttttctaccgcttacagtaagtattagtgaataggattattagtaatggtgtcaaaatctcattctcaatgatttgtaataatgagtgtaatagagatctgcacggatcttgaatagaaaatcttctgaattcaaaaagttgaagaatatacgctttattatgtaaattttattcttcagtttatttcaaaccattaaatcttcttctttgatggtgagaattgggtgaattttgagagaattgttgggattccattgttgataaaggctataatattaggtacacagaatatactagaagttctcctcgaggatacaggaatcctcaaaatggaatccatatttctgcatactaatattacgattattcctcattccgttttatatgtttcattatcctattacattatcactccttgtatttcattttccattagattggacgactgtttctcaatctttatgtcatcctcttacaccgcacgtgataatatactactaagtatatgacactaaatagttgatattggaatttcgttccaacatcaatacctctagaatttccattttgcgttggctaacggtagtaactatcctgatgttgatcctagttttgaaatctccaaaagcaattgtcttcgactgaggcagcaattagtacttctctaaaagggtcaggcgactccaaatagcactttttgtgttcaatcacctcccaatatgcattgtagaatttactgcgcatatctgaagaaagagaactatcgaagaacaaaacaaaacgataagccaatcatccgtccgacatgctcgcttaactagtcaactttgaaacagaagagaacgaatgtcaattttaatgttaattacatgtctacaaaggaaacgaacagtgcaaaaagtcatacaacggcccaattggcctctattttgatcacgcatgcaattgcacataacattgccgttagaatatagtgtcctattattcttcataagtaataagtgattatatggagtaatcaggcgtgttgtgtcattgatgtttcaggatagagaatgatatgtgactatgcgctaatgtggacacagtaaagacaaaagttcattacctggaagattaactggacgtttacgtatataaagatatctgtcccttcattaagactatagtaaatggtgttatcattattaaactgtcatgtttaatatgaccaattggcttgtgttttatgtactcctcttttagagtataagaaaatctgcttttatacttaaataatactacaacttaactaccaattatcaacaataagagaatgtgctaccctgagtgagtgtatgagaatgctgataattgccacagtttctttttatgttccttcctttttttctaaggatgtttattgtagcaaatataaatatatagctcaataaagaaatacaaagctcctatgtttgctaagctttatcgcggtcttacttacgttaccaacaaaattctatctacattgctatcacatcattccatacattattgcataaattcctttaagccgactacattggcaattataattcttctacacccctgttgccgttgtaatgtttacattattagatgcatccaccattaagacaaattgggctgcaaactcttggaaatattcggcgaagttacggcagaacgggtgattaattgttttattgttccaggagacttttctcattccctaaaaacatgattattacacagctttgatctagagccggtattcgaactagtcagaccatttttcacgaaatataacaatatagccgctgctgctggcaataactattgtgtcttgacgttttaacagctgataaccgccatttttggtgctaccgctaaaatcctttcgcgtatacaaaaagaaccttcttgacttacgtcagatttctcatcaagcaaaaattagccggtaacaatatcacccaaaaggttcttttatataagaattaggggtggttttttgggacaacggctagtatagcaaacgtagtagctaatatcggacgtagcggtagcttccttttagatccctctttgtagtgtcgcatgcttgagtggtgccacatctaatagcaaacacatgccgacccactatagtactatagaagaaatacctgccgttcacaacttatttgttgttgtagattgcgtttattcattcgattctgatagcgccggaatacttacgtaaacatcaatccataaactcccttgagagtaacttatactcccttttagcaaggaactgctgtcgccaagtagtgctcttttaggcgatgtaatctcaccaatggcaagtagttaggtaaggatacggggatatgggacgtatacgactggtagcaggatgtgtgaatgctcctctgacgttttattaatggagtccactacgtggaattaactaatcgttatgactagaacgttgacagaaatcttgcgttcagtgttggaacagctatgaaaacaccttcagtcaaattcgatcctggtcactacgtgtttttctttcttgggctgagcatacacactttactcggcgtatctcggtaatcctccttgctaaagtaacagtcagtatactgtactattaaccctactgcacggcaggtagtatgcaaaatactaaatacacgaggtaatgtcgcttccaattgaaaaggttctgttttcaagatcagtgcttcccccaacggggaatgtctcgcggctcttgctagcatgaaccctgagttgcgaaacgaaactttcttattaagagattacaaaccattaaaataattaataaaaaatttatgtataaccttcacttgtgagtactacacttcattattagtcaccaatatatatgtccattctgacagcatttagagtctcgagacctcggctagaacctatattagttatacaaggccaccaactcattctaatcatgcgtcccgtaaatctatcagtattcttgtgaacgttttttacttgggaagaagtaggttcaatttgttcttagcattccctaatcttacttcatgccgattactatcttaactttttttccgatgacttacgaggtgagcgtaccaactaagcatatgaacacggaagtgtggcttcttcaacgcgacgttacaaaaagatatgatatcattccctgtcctttcttatgtatattacagcaattttggacattctctccactaacgaagtgacatcatggtaaattcattacgaggataaaaccatcgtgcttacggtggctttcgttttaaaactgtatatttgtgtatgtttgccacagtaatgtaaagtgattataaaaagcagcttatattcactcctattacgttgcttgcacaaattaatgacaatttttaaggcccagcaattcataagtgaattctccaccaggatcaaatcgaaaaacatcactgtctcactaaacaaccggatatgattggtgcctttaagaggaaccgtggaagttctcagtcttttgcgaaggaatgtcaaccttctacgttaaaagccaaccttgaagtggcaaaagaacttccattctcagatcgtcgcgatttcgaggatgccactcaaggttacatcggctccttatctgatgagcaaataatcggccctgacggcggtgtagtatggtgtatgaaatcttatggctttttggagcctgagacgcccgcaaatactgttaaccctagcttgtggagacaagcgcagctgaatgccattcatggcctatttaaaatcactgacaacgtttaccaggttagaggactagatatctctaatatgactataatcgaaggtaatacttctttgataatcattgatacgctttttaccacagagactgcccaagagtcgcttaaactttactatagacatcgtcctcagaaacctgtgcgtaccgtaatatatacgcatagccattcggaccactatggaggagttaaaggaattgtcaaggaagcagatgtgaaatccggagaggtgcaaataatagccccagttggcttcatggaaagtgttgtagcagaaaacattctggcagggaatgcgatgcatcgacgttcccaatatcagtttggtatgttactttctcccagtgttaagggtcatgttgattgtgggatagggaaagctgcctctcacggaacagttacactgattgcaccaactattattatagaagagcccgtcgaagaacggacaattgatggtgtagattttgtttttcagcttgcacctggatcggaagcgccttcggaaatgctcatttatatgccacaacagcgtgtgctcaacatggcagaagatgtgacacatcatatgcataacttgtatgctcttcgaggtgttgaagtacgcgacggcaaccaatgggctaaatacatcgatgcagctcgagttgctttcggtagcaaaacggacgttttaattgcccagcatcactggcccactacagggcaaatgcggatcaatgaattgctgaagaagcagcgggatatgtataaattcattcatgaccaaacacttcgattgcttaatcagggatataccagtagagatatcgccgaaactcttcgtatgccatccagtcttgagcaagaatggtcaacacgaggttactacggcactttgagtcacaatgtaaaggctgtgtatcaaaaatacctggggtggtatgatgcaaatccggctaacctaaaccctttgccacccgtagcctatgcaaagaaagcagtcgagtatatgggcggcgctgatgctgtattggcacgggcttataaagatttccagaaaggagagtttcgttgggttgcaagcgttgttaatcaattggttttcgctgacccaaataaccatcaagctcgtgagctctgtgctgacgcattggaacagctggggtatcaagcagaagccagcacgtggcgcaacgcttaccttgtaggcgccatggagttgcgccaaggtgtaccaaaaagacgaagtactggtaagcgcaacaatattgccgttttgaataacgaaatgttttttgactttcttgctgtgagattgaacgctacgaaagcagaaggtaaaattatcgttagtaattggtgtttcattaattcaaatgaacggttcgtgatcactctcgaaaactgtgccctgacctacattcagggctggcagacagatgcagatgcaacaattactctcaaaagaactacatttgaagctttattggccaatgaaattactatggttgattttttaagatcaaaagaagtcgaaatagagggtaatcgactcagaattgaagagctgttgaagttgtttgacgacttcgaccagtcctttcccgtcgttgagcctatggggggaagcacttgaatatattatcagaaatcggcgagaaacttgatttttagatgccaacttttttatccactatattatataatttttcaatagtatttcttcaatacgaggccttttgtgaagaagagaaatcattcctggcccactgattatcatatacgatatcgagaatgatataagttataaagcttgtaaagtgtggttcgaggtgttatcgtatttactacaattggaaaagtacggattaatatacagtgaaactaatgaatcagagtgtttaaaaaaggaagacacagtaatctataatactttggtggagctacaggtttctatttacagtcacctatacttccgaagagagcttttcgtatatctgttttcctaataacatttactattgtgaattgaaatttaaagttatctcaaattcaaatgaatctgccgtttcgatttacttcgataaagtttgcgttcttcaaaatggtagtttcagaccatctactttccatcacctggttttcatcgacattccagctaatagtggaaagatagattcacactaacggtggaatacaaactcatagtgattacaactgtttcgggcttgtggcgtatattgtggcgcgatgtaagagaatactcagaggaccctgcgccacaagctaagacaaaacaaagagaacttatctggcagctcgccgagtttcggtgttctttagggtgacgctcaccgcttgtcattgtgaatagaccacaattttcctccgatttcttcacaatggctctgatggaaaagccatctgctgaagataatatactcacctagactattcaacagcaatcggggtgtcatagagttttttatccattacacagatatgtaaatctttattgacactgctgataaccgaaggcagcctgagccaatatacttagtatataaacgtactatttcagacacaaattaatatagcactctctaaacactttgtttcgtatttatgtttgagtacaagcctgaaaaagcctctgtagaaactacagttactcagttagaggagtccctttctgataaacctctctattcattggtgaacattcccaataccgacaactctctggaaagcctgaaaacccctttttaaatcctgctgtggaaaagtattatagacagttgtacgagtccactaagtatgaatgtcttgaaagatttgatacaacatttgaatggactaagaaagaagaataaaaagtagtgagaaagttagactggcatgttactcccctttcatgtttcctatttgtggccttgcagattgatcgaggtaatttgtcacaagcggtcgccgataacttattgcatgatttgggtttaaatgctaacaattataacgttggaaacaccatattctacttgactttcttgtgtgcagaattaccctcacaactcatttcgaagaaactaggagctgatagttggattcctctgcaaatgatagcgtggtccctagtggctacgttgcaatgcaaaatgacagggaagagttctttctatacatgtagagcacttatgggcctatttgaaggtggttttgtggctgatttggttctctggatgtcgtacttctacagctcttcagaattgtcaataagactgtcgttcttctgggtgacactatctctaacacaaatcatcacttcaattgtggccttcggggtttttcacatgagagggataggtggcatggcagggtggcaatggctttttttgatagaaagaattttcactttagtcatcggtatcagtgcatacttcttgatggtaccctccgtagttcaaacgaagaaaccttggagcaagaaaggatggttcactgagagggaagaaaaaatcatcgtaaacaagattctgagagatgatccgacaaaaggggatatgaacaataggcaaggtatgtcacttaaaatgttatggcaggggataacagattactatatatagcctatctacttgatgggccttttggcttatatccctacgaacgttttggccacatacctgactttggtattgagaagtatcggtttcacaacctttcaagccaacctgctagctattcctaactttgttcttcatattctcctgctgtttggtttaacatggtcgacagaaaaatgtaataacaggctaggtttgagtctgttacaaccgttgtacactgttcctcttcttgcagttcttcgcttttggaaaggtacaatgtttaataaatggggaacttatgcaattattaccttaatattagataatccgtatatccatgcaatttgtgtatccttgtgttctagaaactcccaatcagttaaaacaagaacagtatctacttgcttgtacaatatgttcgtgcaagcaggtctcatcatatcctcaaacatttatgcgaaaagcgatgccccactctatcgtaagggaaatggagttctttttggtttggcactttttatgtttccaatattaattggtagcaaattgatttatgtctatatcaacaagcagagggataagaggtggaatgcaatgtcagaagaggaaaaagaccactatctaagtactactagtgatgctggttcacgtagactcgattttagattctatcactgaactatgtagaaatatggatacaatctccatgttatgtattttttaagtttgtgaatcatttttttcatttaatgttctatactattttcaataagatggattaaggacttatatttaccctattgccgttggtgtttatgaactaatcactctttttccttaattatatgtttaggtgattgcttaggtttgtttagggtatgatgagcttattcactatattgttgagttaaatattcgagatttgaaatttataatttgctataaatcttggttttcttggtcggttccacaaaaaactgtgccaacccaaaaattttgatattttacgtgtcgaaaaatgagggtctctaaatgagagtctgataccatgacttgtagctcgcactgccctgatctgcaatcatgttcttagaagtgacgcatattctatacggcccgacgcgacgcgccaaaaaatgaaaaaagaagcagcgactcatttttatggaaggacaaagtgctgcgaagtcatacgcttccaatttcattgttgtttattggacatactctgttagctttattaccgtccacgctttttctacaatagtgtaaaatttctttctatgtttatcatattcataaaatgcttcacgaacaccgtcattgatcaaatatgtttataatattaatatacatttatataatcaacggtatttatatcatcaaaaaaagtagttttttattttatttttcattacttttcactgtctatggattttcattcgtaaaggcatcagtctctagtttgcgatagtgtagataccatctttggatagagccttggagatagctggctttaatctggtggagtaccatgggacaccggtgatcattctggtgacttggtctggggaaataccagtcaacatggtggtgaagtcaccgtagttgaaaacggcttcagcaacttcgactgggtaggtttcagttgggtgggcggcttggaacatgtagtattgggccaagtgagctctgatatcagagacgtagacacccaattccaccaagttgactctttcgtcagattgagctagagtggtggttgcggaagcaccagcagcgatggcggcgacaccagcagcgattgaagttaatttgaccattatatttgttttgttttttagtgctgatatgagcttaacaggaaagaaaggaataaaaaaatattctcaaagacatacagttgaagcagctctatttatacccatgccttcatcagtcatcactacttaaacgatttgttaacagatgctcatttatcacttcacacctttcatgtttcatctttcgcaccatcttcatcattaaaaataagatgcacttgttcctgaacgaggcatgcatatatcatgaatttcttatgcgaaggtattgttctatggtgcctatgtgtattcgtatgtgggggaagtgagaatgccaattgtaggggtgtcgagatgtgccttgaaaaaacccttttcgcgtgcctgtgatgcttccattttggtcaaaaaaagaacgtctgaattgaacgctcattcagaagcttattgtctaagcctttattcggtgttttctaaacgatctccatggaagaaatatttctatctcttgaaatccgtacaagatatcagacgtgtgtcgggagtcgtatactgttggggtctgcaaatctgtgaactctcggcgattatcttggtgcaattacgtaattgtagccgctgaaggcggatggtattgacagaagttgatattcaaagaatcgtgtatgataaaaataaaactgtaaccatttcttagtggcagaattaactctacacagagggaaatatttgattccgagatgcaatcccccttttctagccagatatgaaggagaaaagtgaaacggcaatagatagcgctactttattttattctattttaaaaaagttctccaggagaaatacattaattattgatactccttgtagcttctacgtcaaaagaaatgtctctatctttatggtaacggctcaccgtcagagctcaattgtgcttcttgaatgtatttccaaagttcaacgtttaatgatctaggcgacagggatttctttgagaacaaaaggccacgaaagctccgttcaaagaatgcctgacaaccagccccactatagagaaactcttttttttttctaaacccatgaaatacagttccttttccataccaaaaaatgaggaaagaagcatgtgttgggagtcgcaggcagtcgtagaggtttacaattctaaccattttgtgattcgttgtaagtcaccgttccatggtaaacgtattcttaattctgctttaaaaaacaggcacatatgttatcgctctgattttcgtcatccaaaaacatatgatagcaataatttactactcgttgttgtgttgatatggttaaaccactccttggaaacacaggcatagaaaaagtaggacagattcttcttcattatgatttaacttaacataaacagggttttttaaaaagaatttattaatgttgaagatttatattgtataacattggacggtagtcagtatcgttcaacttatataaaaataattagaaataagtgagacaaacataggtttattggtatctgtcagactaacgataaacttaaggttttatgaggtttgaagctttcaatgcgtaaaacgatcccaaaaaatacagaaatttgtattgcattcaaacatcatatctaaaaataaccaaaacaattttaattgtgaaacagtcactattagcaaattgatcaagagtttcgactgtagagcttatcaccaagtcagtttaattctaccgggtctgtatatgtacaatctgaagggaattattactgacaaaatcgtcctctttttatcacacttggtctttcgtagtccacaagaaatatatgattttactatgtggtactttttaagtgcaaaaggtacacgggagctggacactcgcatatttttataaaactctctgtagttctaagcttctgataagagcatcagtacatctgtttttatcgtattatagacacgatttgaaatctttaaactttattcgattagttgatcctgatgatcatggacctttaccatatgatccaaaataaaaatgaaaattgagtatagaggaataaacaaacaagttatacgtcataataactcaagtagagatcaaaaaaaaaaaaagaaaaagaaaaaaaaaaactttacctcattgagaactcagaatagcttgtatttgatagtctttttataagaaggatttaagaattaagacgaagataatcttccaatcagcaattttatcagtgtgtgggtgggcattctgctaaatactcttcaagaataaacatgcatgcaccaagagctttaatctgtttcttaatagaagaagtactggtattttaaaaattagcaattctaaaaacattactattagacataagggggtgatttctttcttgcacgattctatatgacagttttgtatggaaaatatagcattcatttgtcttcagagctgcacaagaggtatatacggctgccaattttatagcgctacattggaaaattatcataacatatcatttccaatatttctattgcagaccaccttatttaatcactgtatctctttaaactggtctaaagctgtgtttaatcgtattaagaggcgaaagtacatgatggaactgaaaaagcactgttacaattaccaggtgagtaggataggaaatcggaaaaaaaatgggtgcttctttctaaaaatggccaacaacagagttttctcagtcaaaaatagcccaagattattgctcttctttatataagattgaataagccatcacatagatgcgtgctttggtgacttttttttccagcttttattttaatacgttcttgcttgtatactatcccactttatatatattacctaaactttattatttaaagctcatcatggtggtcatggccaccgtaacattgattattaaagcagcatccactctcaaatccctctttttggacagcgcgtttggatccacaccactcttcacagcaaacatgaccattcttctctgtgcacgttttaatgcatgaatagccctttccaccgcaattgtgtgcagatgaatagccgagcgatttaccgcaatcagtacaacctccagtcgagatacgataccttgcgttaagacacccttttcctctttttagcatttcttggttgacttgttggcgaagaaaagaaaagtcggcgtcaagaatattaattttggtaacgtttgtatcaaagccaatggtagtaccattgaattcagttatgattagattgatagtaccattggtttgctgtaagtttactgagtcgacaacagagctagcatacgcatgaatctcggtctgattactgtcgagggttccagcatgaacgcaagattataccgtcgccaacaagctcattaatatcgtgaccatgttttttgaattcatcttcataatacaaaagtaatctcttattttctagtgtccttttggtgatatgtaaagtataacaatatatcttctcttcaaactgtgaaggatttagaaactttataaagacaaagtcggagaaattctcttcacaatatactgtatccagccactgccctgataaatcgagttcacagtattgcatatgtgcagtgattccacaaatggtattggtttggtcccaaactcgacaaaacaaagaaactagcagcgtatatatagtacttattctatggggctattcatttaatatttaatctgtctgacctggcattctgcaaactgtcggtaggaaattacgcgatcaataaaattcctgttgatgggagggagaagacaagcgaactctacgctttaagcagagctggtggaaaaacaccataataatccgaggcagcagttacgctaaatggaaagaaatcgttaaaaataaggggcaggcaggtgtgctgctgaaaaggtaaatgaaaaccagtgagtacacttctgcatggatttttttggcaacaaatcaacgaaaaaaatactcacagcttccgaataagacggctttccatcagtattattagagaattatgtggctgtaaccttgctgtttttacactcgttccaagtaaaaaatgctcatcttaccattttagatagaaaaaaaaaatcctacctgccatttctagtcagcagaatctttacaacatattgcgaattttcttcaatattggtttattttaagtgtttgatagagtttggagttcaataatttacgcttgatgcttaagttatttttagtaatggcacgataattaatgctgttgttactcccttatatgatactacgcggtaaatcatcattatacggaaacctttagatatagtgctgtcaactggaattattatatgggaaataacaatttgtgcattttgcattgaacagctcaggagaagaattaagtgtaaatttgggagtttgctttcaaatcaccgccctgaaagtgaagcaacaatcttgaagcctgctgtattggaagcattggaatatacgtcactccctgaacatcttgaatcttttttttattgctagctacagcttcagttaattttgtcaccttagactaccaattgttttattttgtatctttggtatgataatcttattccgtctcgtattatacttgtcctgttatgatctctcgaagcaagttctaagaacttgtgagttttataatactcctaggtttagccactttccaaagatagagcaatctttttggaattgaaatgtcagagggatgattctgacgatagacatttttctgatgaactgttgcgtacgcacgcataaaaacagtataactttaggtggtagcggtagtgtcgacttttattggaatgagaattaactatcatatatcgactagtatccatagtacgtgtatattatcgtatacaacgtaagaaagacataaatattgagaaacagtcaacgattttagtagaggttgaaacgcgaggcttgataatttcatgggataatgaatgacggtatataaaatgaaagaagatgtaataatattcattatcattcaaactttatctcagcccatcctcatctttttcagtactgtatgtgaactcgtccacaaacaccgtatagctacgtcctctttcattttcaggtatgtatcagcttcttgcatcacgccaccactagcacaacgaaagtatacaatacaatgtcattaaccctagatgctgttgttcctcgatgttgtgtatacatacattaactcgaaagtgcgatgttaatgatgtcccagtgctatataataaatctacaaactaaaaaatcttgatcacatcaaccaaaaatgtatcttactgctaaatgtgtcataaaagggttccagtatccttactacaccattatatagaagactctttataatttcttccgtcagaataattacttatcaatagattgtttaacgtaggaggagttggatgagcgcaagcatttgttgagttattcgcaactggatgaacataatgtccttcttcatcatatacacgcattaccaaatccattatatctgtacaataatcagtctcagaattatatggctcaggtccgttataagtcgatagatctaggttactgtactcataagaatctgtaatagcctccaactcaactaaggtatccctataaatcaaagattgctgatcgccgggttcaaaccgtcccgttctaagtgttctaccacttttatcagaataaatatcatagtaagatgcttggaatagccagcatatttgattgtttgtcatattagttggcaagttgaaaaatacttggtaaccgctggtgatatcaacatatgcggagcataatgagtacaattgagaaaaaatgcaaaataaaccaaataagggaaccattttttactaagcctctctacccttttaaaaatggttttgacttcaaacgcttaggaagcaaacatgctactgctattttttgtccaaaatttttatcctttatagttaatgtttttagatattgcgcggatccatttaaaagcaattttagtttggttacataatgttcagacatgtattttaaaaggttaagcggcgtgccttaaagcattttactcccgagtttgattgactcgcttatgttcataggtatattaaacaagaattatggagaaaacagtctttaacgtgtatttttaaatctatatacataaaccgtaggacgcggcattcgactgctttgataagaattcaaaagttagtgtccggaaatctatttttagtaaaagtaataatgttatttgtacagagtattgcagaagttctcttttagagtgttatgaattcatgaaatcgaatctatagcttgcaatataatcaatgccataatactactgttgaaatagagaatttggtgaataattggataattgttaggattttcattattattgaaggctataatattaggtatgcaggatatgctagaagttctcctcagatatatagcaattcatgaaggatcgtcgattattctatagaatagtattattacttcactttccattttatatgttgtgattcattatcttattacattcctaattcttgagtgtcagctttcactaaatttcatggctgtttctctatctttatgtcgccttcacttatttctacactcctcaagattaagtatctaatttttgtaggaaaacgacactgcaaagagtggatcaatatataataacatgttttaaataaacgtctacttatgatggaaaacattaacttgtgagttaggattttttgtatatgagatattttaaagaaaatttagttccaaaggagaaaatgacttgcacaaaaatgacatgggcaaaatacctaatattaaatgagctctatctacaatccgtgcagctatacatactttcacgcttgttatacattaatcagcgaaccattataagtatggggccactaatatttcatatattctctgatctgagactgttggagtcgatttctcgcacaatcagcactggttaaaatttcgtggggttactgcttcttttaagtcggtcaatgttttcttcattctttcgaactttgaatattttttatgacgtcaattataagaagtatgaaagtcaggttagcaacagctaaaactaaataataaagggctcaagcaggcttacggcaggtggtgattatatttacactactaattttttttaattcgtttacgctctagtaaaagttcttcgcaacatttttttttatatttctttataaaaactacgggaaatgacaggtgcgaataatctcattgatttttgtattgtcaagcccatttaagactataatattgctgaaataaacgtaacaaacgtatggatattcacttagttagaaaagaaaaataaaataaaactaattcgaactttttgttgttttttatttcagacaacaatattatactgttacacgccattattgattactacttacattaacagtgattatttcaaagagaattctagttcaggaaagagcttaacactatatttgtatcgctagtactctccagctcaatatccaattacacgacggagccatgattgttgtttgattttgagcttctctttctctcgttcttctgcggaaagactttgcttcttgtttacagtaaagccacgcaagaaaaaacagagaacagcattgaaagccgcaaacgaaatggacacaattatcaataagcgttgaatcttcgaataggattctatcatctgaacacgaacctctgatccaatagggtatttttttagataattgagtggtgatttgtagattgccatccctaaactagagccgagtcgctgtatcaactcctttgccagacgctgagtccatatagcaccagcgatggaagcacctactgcgtctccgatttgataaacggacattagtaacccagtgacagttgccatctcattgtgggtggttgaagcgtgcactagcgtccacataggaaaacgtatcataccaccagctataccgaccacaatctcagcgccaataagacccgaaatcccgtcatataccaccctgtatttgtacaaaagacccattccgatgacaccaagaagcgacccagcgactacaaagactttcggatgaggatagaaatgcagcataatgccgacaacaatattagtgcatgactgtagaaaattgtaaagctgagctatccgctgcgcacttaatgttgattctccgaatgctaccattaacacggtgaccaaatactctaactcaatctgcaaacctagacgccatacaaattccattagcaatgcaacgtagatggttggatcacctagatatactcgtgggataaatggattcttagcaaattttaattcccaaattagaaagataaaacctaagcagccaccaaccacaatcattgcaataatgtgaccctctctccatttggaggtggctccaccagctattgtgagaggtaataatactaaaactaagaaagcagtgaaaagaatgactccaattaagtttatgtcatccgcaaatttccagagcgtttgacgcagggtctgtcctttttctttcaattttaatggtggtaacttaccgctgcgccaggaaatgtactgagcatacacatagggaaggaccaatattagggtggagatgggcacaatgatgcaaaaaattccatagccccaacgccatttatatggtgcaacattaccagcaactgagctaacaatatttccacttacccatgtgtttataatcacgggaatcagaaatatgttcatcgcaaatgtacgatctctcaatccagacagatcaccagtcagtgctgtagcaagaagacgaaatccagaataaccgaactgttgtataacaatacctgcaaaaagtccggaaaacgttggagtagcagcagaaataatttctccaatagtatagagcacaagcgcaaaaatccagcattctatacgtccaaaccgatcagatatacgtgcgtatggcactgcgacaacagaggctactattgatttgacggtattgatcgatcctacttgagaatgctttccaaaactgttagcggcataggtttgtattgattgcgaaatctgccctccgagtccagtacagtaaccctgcaaaaacagagccaccagtagggcggtcttgagtgaactaaacgtaactccaaaagctgtgaaagagctgtagtcagacaagaccttgttgacagcgtctatacggcgcaagccagacgtggtagacttctcaacattgctatctgtcttttcgctgtagcagacagtgcttttatcgtctaaattgtcattcctagagtgatcagtttccagcattttcagagagacattcacgagcacttttttgctatattagagttctgctaggacccaaaccatcatttcaattaaataagtcatctctattatccaaacatagacccttcgccactcaaaagccacagaggggtgcaattgtaagccgtggcagcctctataatagtatacatttgtatcacatttgggtgcaataatttaaacagatttttgcagttgactcaggactaagggcaattcttgcccaaactacggaaccctgtttctgatccgaagggcttataatccatagaaacccttacatttgctcactgaaaaccctgtgtccttatttggtatatatgatgcgaggattaaacgaaaacggaaaattttaggtttgagggtcccattagttcaactaaaaaagaaaaacgaaaaaaaaaaaaaacaaagtcaaaccataaaaagttttgaactacagaaaatgtaggcttgtctattctcctgaatttgactttttttttttctaactttttcacaccccttcattaactaattaaaactgtcgtagaatttcccttcatttttattcagccatcctcagttaggaacgattgatacagccttcattcgtcatttcgtgacttgcatgttggattggaaaatttgctggcggagcaaagtcaagacgttcagagggaatagtaaatgagattgtacgaaccggtgaatatattttgctggctagattttaaatggccattgtgttattgctctatcaacataaaagaaagtatatgtgttttcagaatcgtaaaatttgtgacaaactaaaaatcagtatcttcataaaagtagtagagacatttcataggtacgttccgcccttagataaatgtggctgcagttcataatgcagtgtgtagtagagatgattctgttgatcataaacaataatatataatttcactagtacttgttcttatatgcacataactcgccgtattatctggccaaatgagctatagagtaacccttctctcagcattattataatacaataccaatgcaaggacatatggaaaatgctacacaaaactatactttagtgtattacataactcataccgcactaccagatatatgtcgttactatttaaagtgcggtatgtaacatagataaaaataagtatatgtatatgtataaaaatcttgtcgtcacaatcatcaatcattcagatatgtaaattctgccctcccatggcttcaatgttctggaagacgcatcaacttcgcttcttgggtagtttccgaattccaacttaaacgacgagctattgtttggaatcgtgaagtcaatcgaatcagagctgaagttcaaagcagcaaacaatgttttgttgtcgtatttctttgtgaagctgaacagtttcttattgtccaaatcaataaactcaaaatcatatccatatacagtaatatccttgtgtgcctttctaaatctcaaggcctccttccagaagttcaaaaccgagttgggatccttggattcgtcttcagcgttaattccttccctgaaagactcgttcaagtaaaaccatggtttagcattaggaccagaaaaaccagcatttggctcctcacgagaccattgcataggtgttctagcatggtctctggaaataagggcaattgcttccaaaaacctcttcatctccttcgagttttctccatgctcttccttgatcgcatcatagttatttctaacttcgacatcctcgtatttttcgataggccagttcttgaaattgatttcacccagttcctgtccttggtacacatatagagtaccgctcagtgacaccaacaacacagacaacaacttaccagaaataacacggttcttaggagaatcgtcaccaaatctggtaattgaacgaggttggtcgtgattttccagataaattgttgaccaacaatcagttccgttaacgtatctgaaaagttcagcaagggcaaccttccaatcctttagttcatatgggatcaaattttgacggaacttgggcgaagtcccgacatcagtgtgggaaaagttgaataactcactaagttcgtgtcttgatgcacttgtatacaacctcttggtttcatcagtagcatgttgcatttcaccaactgtcataatttctctgccatccttcactctgtttctgatgaacttgttcatttcttgatgaaactcatggatacgtggtccgttcattgtgaaaggatcactgggttgccactttgagttttcgtcaatcacaggagcgtctggtagaccagcaaccttggagtacaagcttcccacatcaattctaaagccgtctacaccatggtctaaccagtatccaacggcactttcgtagattgcctttctacagtcctcattctcccaattcaaatcaggttgggtggagcaaaacaaacgcaagtaaaactcttgtgtcttttcatcgaacgtccatgcagaaccaccgaagtaagacctccaattgtttggaggaattggcttgccttcggcgtcataacccttaggaggtctccagaagaaccagtcacgttttggattggtttttgaggatctgctctctttgaaccattcatgttcgctcgagcaatggttgatgactaagtcggtgataaatttcataccaagcttatgtgtcttttcgatcaaggcaaagcagtcctcgttcgtaccgtaggttggccagaccttttcgtagttggcaatatcgtaacccatatcatcttgtggcgagtcgtagaatggtgagatccaaatggcatcggcaccaagctctttgatatactccaacttggaggcaatacccttcatatcaccccacccatcgttgttggagtctttgaaacttgcgggataaatttgatagattgtggcctctttccaccacttgggttctgtttctggatgtgcagaagaaatagtcattgtacgttgctttcttttctttatgaaaaaactttcacttttgtttgtgtgtttggactggtgaatggaacatatattctagtacagctaattcctcgagtgaagaagtctttcttacttatatatgtcttttacgtgcctatggacgtcttacgaatgatcgaaaataagaaaagaacaaagtaaatttaggatctggaaggagtgctgtatgtaaacgaagctttcagttttaggtaatgtttgcacaacctacatgatataacatggtatgttctgcaagagcgtgcctggcccttggcccgttatagcagatcataccatctgcaagcagaccccattattgcactgcctccgcaatcttgcgtatacgtagtcccacgacaaagtacgaagcgtaaactgaccttgttcagttccccacaaaaattacataaccatttctccgcggaattacataatcatttctccgcgaaaattacataatcatttctccgtgcgagttataagtgcttttctcgtgcatcccttggcacttcacaaaaccttctttttcttttttttctttatttcaggggaaatcagtgcaaaactaaaaaagaaagaaattttgtgaaatgtaaactccaggtgtcaaaaaataaattatatccgtggaaaatcaggcgtcggaaattgtagatgaaaccgcctcctccacaataaatgctgaccacacgaacaatgcatacactcggacaccttcgttcaaagtatcagtagcagttcgacacaccgtatactacttagctcttaaggtctaggctcatctttctcagttcctctttttcgctaattaaaggtatataatgtcacagttgtgtaactagagaagagcacacttgttcctatctttttcttcttctttttttggtatgagttgaaaaaaataatcattgcacaatttagttctaaacgcttttgttattactcaatatcatgtcaggtgttaataatacatccgcaaatgagttatctactaccatgtctaactctaactcagcagtaggcgctccctctgttaagactgaacacggtgactctaaaaattcccttaacctagatgccaatgagccacctattgacttacctcaaaaacccctctctgcgtataccaccgtcgcaatcctgtgtttgatgattgcatttggcggcttcatctttggttgggataccggtaccatttctggttttgttaacctttctgatttcatcagaaggttcggtcaaaaaaatgacaagggaacctactacttatcgaaagtaagaatgggtttgatcgtctcaatattcaacattggctgcgccataggcggaattgtcttgtcaaaagtcggtgatatatatggtcgtcgtattggattgattacagttactgccatttacgttgtaggcatcctaatccaaataacttccataaacaagtggtaccaatacttcattggaagaattatttctggcctaggagtgggaggcattgctgtcctttccccaatgttgatatctgaagttgctcccaaacatatcagaggaactctggtccaattgtaccagctgatgggtacgatgggtatttttctaggatactgtaccaattacggtaccaagaactatcacaacgccactcaatggagagtcggccttggtctttgctttgcctgggctacattcatggttagtggaatgatgtttgtaccagaatcaccacgttacctgattgaggttggtaaagatgaggaagcgaaacgttcactatcgaaatccaacaaagtctcagttgacgatccagccttgctagttgaatatgacactataaaggcaggaattgaacttgaaaagctggcaggtaacgcatcatggtctgaactactctccactaaaacaaaggtctttcagcgtgttctcatgggagtgatgatccaatcgctgcagcaattaaccggtgacaactacttcttttactacggtaccaccatcttcaaatctgtcggtctaaaggactcctttcagacttcgatcattatcggtgtggttaattttttctcttcattcatagcggtatacaccattgagaggtttggacgccgtacgtgtctattgtggggtgctgcttctatgctatgctgctttgctgtgtttgcctccgtcggtgtgacaaagttgtggcctcaaggaagcagtcaccaagacattacttctcagggcgccggtaactgtatgattgtgtttactatgttcttcattttttcgttcgccaccacttgggcaggcggctgttacgttattgtctcagagacgtttcctcttagggtcaaatcaagaggaatggcaatcgcaacagctgcaaactggatgtggggtttcctgattagtttctttaccccattcattaccggggcaatcaacttttactacggttacgtattcttaggctgtctggtttttgcatacttttatgtctttttctttgtcccagaaacaaaaggcctgacactggaggaggtgaatactatgtggctggaaggtgtgccagcatggaaatcggcctcatgggtgccaccggagagaagaaccgcagattacgatgctgatgcaatagatcatgacaatagaccaatttacaagaggttcttttccagctgatcttctagttttcggtaaattggtaaaaaagcaaaaaaaaaaattgacgaaactaattctctattatacataatgtttttacttttgtaccctttaatttctaatgaatgttttatggaagcttcaataaatgcgtgactggctatagttgtcggatggcaatccattattatgtataccgtattattaagagtgcaactaggcccgactataaatctaacactcagatccttgtactgtaatgcatatttattttttcacaagttgcatgctaataataccatgatattttttgaagccttgaaaaatagttcaagcagctacgatatcatgaatcaatatactcattgcagcctatgtaatatatataggttccgtgttaccactcgtttctgatattttcgatatggctacactgggtttttcatgatggaaatgtgatactaccagttccaatatatttatcttccttatctatatgacacgctgttattttagttcaagtcagtgtccaattggggtgagtgtcacgtgcacaacgacggtagtcgttggatgtgctaaatgatgttctactgccaatgactgcaaatacgttcgaagagtataaaatcgaaggaaacgaattaagttgccaatccttactgtaactatagcatgttacatatatgtaccataagtatcacattaaggtttcgccatagccatgtgcctatattaaatagaaatatcacatggcgatccacggaatgtttatagattttcttcttttgtctatggcccgggcgagacattaatttatcttgctgaaaaattcgaaagttaaaactcaattatgcgtgggatttctcaattaggttaccagaatttcaatctgctgaagaattatgtcttaaaaaaaaaagtcccgcctcaaaaaagccaaaaagggtgtgactgtagattgtgggttacttgctgtcaaatgacatgaaaatctctgcctgcatgatccctgtcaaaattcgaaaacacgcggtcataaaattgtgcctcaaaaagatatcttttcctgcgggttctcttagtaaatgaggttaggttgtttcctattcttacgagatttcccttgttctcgccgctcacatcattgtcggtaagatcttccgtagtggcaggtcaagcagtgaggaagaaagatcggcagtaaactgataagagccaaaccgaaaagtttcttatacgcaaaaacgctttgaaaattctccaagaatcctatttgaaactcttattaataaataaagtataaatataataaagtttattgtgagacatgtcgcgataagcaccccttgtctttcttggaagggagaaatttgtaatataaagccaagtgttcagaactcgatttttttctgaccaaagagcggaagctccactataaaagttgggaggtacttttaggttctcttaagttcgcatttaattatggcctgaacgattttactgtggacaataagtgaaataagtgtccttaaaatgtgtacgatgtgtacacatcaacctagtctccccttcattggcagaagagggaaccatttcatccaaaaagaataaaaaaaataaaaaaaatccaaatattaagctaaaaaaatacttaactgtttacacaaagcgtatataaaacgcatattaagaacctatctcgtttcagaggaataaacttttaattcctcagttaaaaaaattagttaaagaaagcaagaacgaaaataccgaccaatgcattcaaagtattggcattcaaacctgcggcaataccctcggactggacaatgataccagtagaggtctttattggagctgcagatttggagtatgtggaaattgcactagaagccttggaaatggcagtagtcaatgaggttgctttagaaccctcagaagtgacagtagtgtatgactttggagaagcactagttgcggtgacggttgaagtagcttcaggtatttgagaggtgattatcttgacgttacaaccattgtcatcacattgagtaacagtggcagtagtgtatgtcttaggggcagcactggtttctgaagtttctgaagtttctttaggagcttcagaagtgacagtcttggtgctacatccattgtcatcgcactgagtaacagtagcggtagtgtatgtctttggagaaacagtagtggttgtggcttcaggggcctcagaggtgacagtcttagtgttacagccgttgtcgtcacagtgagtaacggtaacagtagtgtatgattttggagaagtagtagttgctgaagtttcttcaggacattcagaagtgacagtcttggtgttacagccattgttgtcacagtgggtgacggtaacagtggtgtatgatttggaagaaacggtttcagtggcgacggtaccggtagacgtagttacatgacatccggtctcatcgcaagaagtgatagtggcggtggtagatgaacatggtacggttgtggtaatggtatagacgttaccgttcgaatcagttgtttctgaacaggagacaactactgtgcttgtggttgttgcatatgttaatgttgtggtataaacagatggggagccggaaatcaaggtggaagccgttgaaccagtcacggaagcaccgaatgaagtggaagcggttgaaccagttacggaagcaccgaatgaagtggaaccggaagtagagttggtagcccctgatgtggtagatgtggatgagggtgtagcgctggaagcaacaacacctccgtaatttagataataagcataggcaccagcaaatgttccttcggagacgttgaagccagaactggagaacccagtaccaatagagaaggagaattgtgagttgccttgtgttgcagttaaaacaccagtagcactgtcgtaagaaagagcagtgacatctgctgtaatggcgatttggttttcaccagtgtatccaaccacagggataggagtagtgttggtttcggttgggtcaacggcaagaacaccttcacccttgaatacaacagtttggccagtaaaggtgtctggatagtgcaagtaaaggttgccagagatgatgttgattgtaccacttccagaaactggttcgacaacgacgtaggtactgccattctcaagatttatctcaccgttgttgacagaacctgattcagctctacgctgcaaaccagagacggaaccaccattgagaatagcatttgagaaagagaaagcaccagagttagagtagggagagaatgtgacttcgccctttgtggactctgatagactcaaagaaatatcaccactgttatcgaaagagcctggagtgaaggagtaggcagatgcggaagaagcagcaggctcttcagcgttaaaggtaccagatacatcaaagttttcaccagaaatgtcgaattcggtacctgggtaagttggcttagacttttctacgaaaacgccaccatggattatgaaatcagcagagaaaacgtatttgtcaccatcaagtagggtcaacttaccacctgcagcgacttcgacagcttcagttgcaatgactgaaccggtgagtgtgatgtcaccactgatggttgtagaaggcaaataaatagtaccatcgctggaagaaagagagttggaagcagttgcagttgcactagaagccgaagaggtaatagaacttaaggtaccggaggtgatagaaccagaggcagtggaagccgatgaggttgattgaggaattgaactcgagatacctggagcagaagaagctgatgaaccggaaacggaggaaccagattgtgtaacagaaccggacgtgctggaggctgatgaaccggaagcggtaccagattgtgtgatagatgattcagatgctgatgaggatgagcctgattctgtgacagaaccggatgagctaggaaccgaagaagcggagcctgattctgtggcagaagatgaaccggagactgatgagcctgattctgtggcagaagatgaaccggagactgatgagcctgattctgtggcagaagatgaaccggaggcggatgagcctgattcagtggcagaagatgaaccggaggcggatgagcctgattcagtggcagaagttgaaccggagactgatgagcccgattcagtggcggaggatgagcctgatgtaatggaagtagatgaaccggagactgatgagcccgattcagtggcggaggatgaaccggaggcggatgagcctgattcagtggcagaagatgaactggagactgatgagcctgatgaagtaatagaagatgagccggagactgaagagcctgatgaagtaatagagctcgagacttcagaggacgaggttgatggagcaatggagctcgagacttcggtggaggatgacgttaactcagtgagagagctcgagacatcagaagtagatgaggtcaactcaatagaactactgatggaaacggaacctgatgaagttgacgaaacggcggtggagctgttactagcgattgaggaactgttggtataatattggcccaatgcactttgggagtaaaggaccaaagccaaagcggcttgaagtttattaaagcgattgaacatctctttgacaggcgagatcttaccaaaaagaatcaacgatgggtatttgttgttactgacttgagaaccagaaaaggcataaacctaagataatgggatggcagaaccgatactaatgagatgaatatgaagctttttatatgctttttgcaagtgtgagcggactccgaatacgcaactgcgtagattaaccgctgggctagcttaaatctcctacgggcacttctgcggaagcatccgcaagttctgtgcgcgcgcgttccttgcaacgaacgggggggcattttaatgagtaaacaaagatattccgctgctaataacaacaagagaccccctaagcagtctgcaaaaccgtgcaggacgtggtctaagctactttgataagatagtcacaggaacctttttggaaaattaaactattaccgaaaaaagccacaacacagggcctagcaccaagcattttcacccaattcgtcatgaaaagtcattattaccttatttccaattggagagttagccaggaatctccgctcagaatgaactagcagtataaagaaaaatatacgacttggataaagaggaatgctttagtaagctacacctcacttttcgatgaaaaggagttagtggttgccttccgtgagcgcgagatatttatttttatgttcctaaggcgcgtgtctacctcgtatttctgcaacgcgagcacggttttctgttgaggagtggctggtaaaggccctttaaaaataccacgccattttagtaggccctactaactaattcatagcaaaattcagaacttatccattagaaataaattgcggtgcctacgaaaagaacgttcccttggcaaaattaaagaaaaattaaacgtgatcggtctatcgagcaggccattgaagcatatgtacaagcacggtttgagtgcttagaattgaacagttattacagttcttaacactgtttctctaaaagtgcaaaaaaggcacggtcacatagactaatcttgcagcggttccaaggcttatttgttgagttgggttagtggaacgaagtagcagtcaattccaacgtagatcggtatatacgttcaagcccccctgaaagttgccgaggccaaatggagaaaataagttgttcccctctttttattaagaattaaagtgttctattttagattgatttcctaccattggtttcaacttctctctctgattcagttaagcgacggtgtttttaattcagatttgattgtccgtctccattttttggtaagataagtgtgagcaagtttgaggggttactactgactcagaaaccgtactgctatgtagtacttgccttcgtcctacctagtaactattatttctacctaggaaacattttagggtatgatctaccccattgcggggtgcctttttcttacgttagcgagtactcgaatgagggtgaaatggcatcgtcattgattgccgaggacagactccccaacattgaggtgtttatggttggccttactgataaaccataaaaatacggtccgatatgtgtagtggttccgttatatttttggcatggtaagcatgtataggtatatgctacattcaattatctggaaaggcggttttttaagctcattttcttttttgagcttattcttgaagataatgctatcacacgtgcataataaaatagtagctttttcttgtaactgcgctcttttttagccgcattccaatttagccttaaatcgtgaacgtggagatgattatttcatctcaactaacttgtataaccttatttgcgtagtcttcgcggggtaatttttgatggtgtaaacttttaccatagaaatacgatactctacatgtagttttgtctatttagtgaaatccgacaaactgcgacggctagcaagttcttgcttgtttctcactaacagcttattctttcaaggaaaggtgtataattagttcgacaaaattcagtccgattccaaaaatatggttgctgaatcgagaatcaactattgttaattgactagcagtcttcttgctagtatatatgacatactggtgcaaatatggcataacatcaagaggcagtcatcatatctaaaggatacagaaatggaaggattgataatgtaacaaggtaatgaacgacaatatgtaaaatgaatgaaagcctcaataatatcatacagacaaaaatcgattcccttttgtgaatttttttttttgtatcctccaggagaaattcatacctaatgagaacagtggaatcccaacacaattatctaattttttcatctatttctcatagataaaatgaaatttcaataattgaccaatattcacctggcccataatcaatcgctgtaataaaatctccaaaaagggtaaaactaaacaacttttaaaatgtgaaaaattaagtaaagaaaaagataagaataaagtccaacaagagtcaactgcttgaaattttcagctgaagtggaaaagaggtgctgatcattgagtgccaaacggaagtttgttgctgccgcaatgtcaatgaagcattaagctctgacgttttgccgtttctttttgggcagtatgcgatcaatttatgctagccaaaagaaaaaaatcgtatgcgcgctgaatcagccgtagctagctgtcgacaatgacatggcggaagcgctgtttttaaaggcttcttataattgaccttcagggttaggaccctgaaggttttttgtagccatactgcttacaagaatgtaacctctttggaggaaaaagaaattatactttcttttccagatcacgaatctgttgaagtactgttcttttccgtggcttgaaccctctacaagagatctatagacgccgcacatgctttcaaatagagctacattctggtccttcaatatatcaattagaaacgtataaaaacaagacaaaattactgtcattgggggagaacaacccatctaggaattgggattgagcaattaagatagaaaaccaaatccacacacaactactaaacattatgaagttctcttccggcaaatctatcatctttgcaactattgcttctctagctttgagtgctcctgtcacttacgacaccaactctactgctgagttacaatctccttcatctcaagaaattctgggttggagtcacgcaacttttcctaccatttaccaaacctgtaatgagacgaacgcaagaatgttgaatgcagcttttaaggataccgctgaaatcaccgcttatggtaaagatagacttttgaactatggtgtcgatgacgtttactacaaaagatggtttggtaatggtagtattttcaccgtcatgggtgtctttgagcaattgatggaggcttccaagggtgccatgctcatgagatgtgatgatattgatggcttgtgtgcagctaatccaaactattacgctggtcatcaccgtcaatctgctccagctgaaactgttatttgtgattacttctacacttccaaaaagccactatcaacaatttgtttcgaaggtactattgtcgatgtcggtccaaaacattatgcaggtattgatatgttacatcgttacttgcacgtccctaccatgagtatggatggatatgttggcgagtacgcggaaactcttgaagaagttgtggactacacccagaacaatgctacttacgcagttagaaacaccgacaactatctttactatctcgctgacgtttacagtgcttctgttatacctggtggctgtctaggtaacttgtaataaccacatcattacttccacagaatatgttttctataccgtaaatattagttcgtttatgtttttaaaataaattggagctattctttttcattgaattagatggtattttttatatgattgcaaactttgacgagaatgtactgctcattatttttcgtaaactgcaaaaaattgagcacaatataagtatctcagtgcattgtatacgtgtcgagtaatgaatcaaacaatagcattcttcttctcaattttacaatagtctgaaacaatttaatgacaagtttatcataattgtgttattattatatttatatttagaggcctatattgcgcatcgaacttttcaaaatccgcggaaaattatagaattcatcatatataatgaaggaactgtgttcctgaaaagaacaaaaaaaggattaactacaaaatgaaacataaatatgtcttttatcaattaaattaatgataatttattcttaccgaacgttttcttctaccaagtttttcgcctacgcacctacatttcctcttttgaatttcatggcaataaatagtaaagaaatcaatgatcgtcttggttttattaaaaaacttgagaattacataaccctttaataggccaatgcaactgatagaacaccaggaaaagttgtaatgccagtgcggctgaacagaatctgtggtaatagatttcgggtataatgcggaaattaggaatactcatatgttcagataggataaataataaagagaccttcaacataaaaaactaataggaccttcatgggcaaaaagacaggattacgctaaaatatacttcagtgattttctgttaatatgcgaaagaaagacacataaaatattggtgaacagggcaaaaaattttagatttgtcagtcagtgaacaatatttcaattggtcacttatagaaaagattattataattacccatgttagtgtcgccaaacactattatgaaataaagataatattctattagcaatggtctcaaattaatatgaacgggcatcattggcacagagtaaccattttaaaataaaaagagggcaggaactctcacacatttcggtacgaacaaactgatatactatatctattaaaccgtaattccagacgcgtaatactacagcataatcttcaatatagatatgacaagaaaagaacaagtttttccataataagtatcccattttacctacatttcccttcttcggtatgttaaattattaatattctttgcaattgttggccgttgagtaaagttctaatttcaaaaatactagactttgactgaaacgttataggagttttaatatcaatagaccgtttggccaagacgcgttcaacatatacactggtctaccattatataaaaaaattcgcccattaatcatggccatactcgttgacattcacaatatattcatagacaaatgctactgctgaaacgtgtgaagatgctgaaatatgttcattaacagaatgtattgtccttagttggtcaaatggaaagatacctgcaacaaatctatagatgtttttgcttaatccccagtaatacttggtatcggtattaccagaaaacaagccacccgtaacgtagacatctgcatctttctgctcagccaaaatttcgttttgaaacaagttttgaacagtacctgcaaaaatctcccagacatgtcctgaagttggcgatactggtgctggttctaacattttttcacttgctaaagaaatgtggccaagttttgtttccgggatgataatctcgtcatggaatgtcaaaccatacccgtgcttttcagcaataactctggcccaatacaaatcattttacacagtttcgttcacagatgaatgaatatccactctatggttaacaataaagctggtcaatcctggcaatgcattagccttgacaccgccattaatgacatcgactgctctagttgttcttattaggtcacgaatgtcagggtgcgatgcagcaaattccgtcaaaaccttccttttcccttcatccacaggtgcttttaagattgcctccctgacatgtggtggcagaaaacctgaatgctcggcagcacattgtaatacatcataaatggggttatcaagtgagaaattataatcgaatgggtgattttccatcatatatatcaattctgatgcaacaccaatggtagtatggtcaggttgtacggatgaatgaccaccatgaccatggatactaatccttacgtcaacgtaacccttctcagcatttacagcagctgcaatgtaaaggtttttatccagtcttaggagtccagcaccttcatcaataatggaaaacatgctatccgggccatacctttccaacagaaatggtgccaagactttagcgcccataaaaccgcttgactcctcatcaaagcccagagataatataacggtcctttcagtctgataaccatcggcaagcagttgttctataccctctaactcagcgagcattaagttcttacaatcattggagccgcgaccccaaacatagtccgtttcttgatcatagtgacccgacaatggtggatactgccaagaatcccatatttccctgttaactggcaccacatcttgatgtgccataaataatattggtttcaaactcggatctgtaccttcccatgtatataatagacccaattggttgactttttccacctttagatgagagtgaacaagaggaaaagtctcttagaaatatttgtgaagtttgaagaattctgaatagtactctgggtcatcgtttggaagcgggtttgtgtcactaatttctgtaggaatttgaatggcaccagacaactttcttattgagtctattttgaattgcttatcgttcagaatcaaattcacagacttgttaaacgatggacgatatacttgaggctttttacattgtggagaggcaggaacgtcaaaagtggaatttgggacgggtttggtaaagctgctgatataagctaagagcaacgtcaataaaccaattaatggcagaccaaattttttacacttagaataggtagaggaggttggctgcttagaagaaggatacacatccggaagcggagcgtgatgagtctctgtcatataagcgttttagtatatgggaggaatgacagagtataagccgttatggtatactactacgaatacataattaagaatagggttttaatgtagttgcttgtatatcttctatgttcccctttttaagcaccccttagaaaatatatattgtcgaggatttttctccagagaccatgaaatgaaaaagaatccgaaatatgcactccttcgaccaaggctttagagcaccctcatttaaagcccgacctgtagtgcatatgcaagattaagaaaaagaacagagagaaaagtccgctttaccataatgttaatttattctaaatgctctcattgacttttatttcaccgaccctgagtcaaattttcgaccatgttatatacatgctatttagtaatcaagtgattaattttaccgaactcaaagttgcagccgcagaaaatagtcatctgataatcttatatatagatccgacttattaaaggacataattttcaaagaatcgggtacgtgcctaatgcaatcatgtcgtgtcaatcaacttcccccatactatatcattgttttacgccacgttaataggaaccaacgaatttcttaaagccaatccttactgctatttgcagatggactgacggttatgcattcactaacaccccaggtcttaccgtaccacatatttaggtgcaatactaatcaattgtctcttgaacagtaacgacgaaagtatgaacttcttatctatgctatcttcaacgtgatagtttatgctactttgcagatgtttgagttaacctgctaaaatatattaaagcagctatagttattttgagttggtctatacaacttcaggaaaatgtcgtttgaatattcctgcacaacgctgggatatttacaaccaaagatgccactacaaataataatgacatgtatatgagaacattgcaaacgattaacgctgctcacttaatgctatgtagacttcaatatatgtctttgaaaaacgcttttccacaatcacaggatagcagagggatgcctagaggaatactccccggctaaaaatgcctgagactgcccatatattcccacggtaattatccatataataacgaaattgagttttctataagtaacatcagcccatcacccatttatttgttctatagaatactatactcttttgctccagtgtcttacctcaagtggacgcgctctcagtgccaaatacagagacaacaaggacctggagagttgttcataacaaaagtttcatcatgccaccagcgtaatgacagccgcagcagtgtttgaccaattgaactatgataaaactacattatggtttctgactatgtctgtacatccatgcatcatcttttgaagtttttattttgatagcatcctattttgtgactcttactttacaagaacgccaacatagggagtgattgatattctctgaatttatctggatacagccaatgacatcctgaaatacctatagtgacagtagcgcatttcctggtcatttattaatggttttagacacaaaatgaagataacagataatacgaaagtatcttaaactgcaaaggggatctatacgccacgacttactgaacatctctgaccaatagaagatccctcaagtttattaggcaactacagtatgttattacaagagcatacgcctgtatttggatggccaatgaacaaggaggatattttttccacatataagtgaccgccattaaacaagacatgtttgaaataacctccttctgtcatactatgtgctcactattttcagaaaatgcggttgaaaatcctcgtctgcgcaaattgaaaaagtcgatatacgtttcaagtaacgcagccgaaatgcccgtttgccaagcttattatatttggaaaagtgtcaaattatagtgctcgcatctggatgtaccgcgcatatttcttagttaagcaggatgtataactgcgcattaatacgtgagcatttgcgcaaattcacttcttaaaatctctgaagtacttcttcattatgcactcgtttgttctcaagatcatataaaccatgcctttattaccaatactaaaagttttttattgcaagtaaagggatatttcaaatttttatttcaaagtttatttatatacatcgataaataataaaatgattgaagaaagagatttggttttaagcaatggtatccattgtattgctgacatccactccgaactatacgccaggttaaaaaaagaatcgcaggcagcgacaccatgggtgtaccaaaaacaatacggaaaattcgtcacttactttgtcgctgtgataatttttttgtctttgataaaaaagctggcatttatgtattatgattccagtgaggaatttcttccagaaaagaagaactcgccgactaccccttctgtattccttgctcgaataatgacgaaacttgtcgcattcaacagatacatttgctacaggaaatttcccacgttgatattttcttatttaggtattccgacatctgtgggtacttttttagtagtaatggctaccactttatacacacttctatactgctttgttcctcatccattctacagaccttgtgcaggatttggttcgccgcctttgtctgttcgtgcaggcataatggcaatatctttggttccgtttgtattctcactttccgggaagatcaacgttataggttggttggttgggctttcgtatgaaaaaatcaacatataccaccaatgggcatccattctttgtttattctttagctgggttcatgtcattcccttcctacgtcaagcacgacatgagggaggatatgaaagaatgcatcaacggtggaaggcatccgacatgtggaggagtggtgtcccacccatcttatttttgaatctgctatggttatcttcgctgcctattgctagaagacatttttatgagatttttttgcaacttcattggattttagctgttggattttacattagtttgttctatcatgtatatcccgaattgaattcccatatgtatctggttgctacaattgtggtttggtttgcacaactgttttacagactagctgtgaagggttatttaagacctggtagaagtttcatggcctcgaccattgcaaatgtcagcatagtcggcgaaggatgcgtagaattgatcgtcaaagatgtggaaatggcctattccccaggtcaacacatattcgtgagaactattgataagggcatcatttccaaccatccattttctatctttccgagtgcaaagtatcccggaggaataaaaatgctgattagagcccagaaagggttttctaaaaggctatacgaaagtaatgacgacatgaagaaaattcttattgatgggccttatggtggaatcgagagagatattagaagttttaccaatgtctacttgatttgctctggttcaggtatatctacatgcttacctttcctgcaaaaatatggccccatactccataagacaaacttagaagttattacattggactgggtggtaagacatagggaggatatatcatggattagagatgaaatgtgtaccctctcaaataatttgcgccagttatttttagatgggaaaattgtggttagaatttacgtctgctcggacagtaccgtccctggtattattaaaactttccctcaaacaatagacaccgccagtgaccaatctgatttagctaaaagagaaaaagataccgaattcggccaggatgatactgagtcaaattcaactttcgacaaatccaataacgaatataaaggtctcatcaccattattccttccaaacctgatttgaatcaggtcattaatgattaccaaattgggttcaggaactgcttcatttgttcaggttctgacagcctaaggtataccgtcggaaattccgtggcagtttacaggccaaggttttttctaacaaaaatgtcgaagagtgctatttacacagcgagagttttggctactagtaggaaacagatggcatccaccatgtgaaatatcattcaagcatttcggcaaaaccatgtaaatatttgattattagcgggtaaatatgtaatagttatgcactttaattcttttgttcatctagaagacaatacaacgcatttcttggctaaccatcttacagccttgagggtaaagggcgggcaaacgaacaaaagtacaaaatttccatccttgtttgataatcatttcctcggaccagataagaatgagcagccgaaataaacggtaacgtgattaaaaccgctagaagagtgtttttgtaaggatgaaaacctcagtgagaaagttgacaatataaacattatcagcttttctcgccctcttttgcacttcctgcaacattacttgttctgcagcttgtttcttccaaatatatccatgctctcggtgtgccacttctggggtttctcaccaataacagaacatatccagtataatacatacaccatattcacaccctatttcatatcattaacctcttcatttttaaatgccagcgattactttgacttctaatcaagaacgcgaaaaaaaattaccgcgtgaactatgtcatatttgcgattttaggtacaataaatattatcattattatattatgtttgcatgtaggttctacaaatacattgttgtacgctatagtttcctttcaaaactagaaagaattcgtaacaaaataatctccaatattttatagcaccttattaatatcaatgctgcaataccttctcatttcaacaattggccctcacctcttttgtacaaaaaacgtcgccattgataaaataagtaagaagcatataattggaatgtccattacgtaaaagaaaaaaaatcatgtgtacatattacgtaatagaatacggaattttctcgcggaagtagatcttccgtggaaaaaaaggaaaaagtccgatcaatattgaaaaagggatccttagtttcccaactatataaggaggaaaagtctatctctgtagcgttgatataacgtgtacgattttcaaacaaacagatagcagtatcacacgcccgtaaatatgtcagttttcgtttcaggtgctaacgggttcattgcccaacacattgtcgatctcctgttgaaggaagactataaggtcatcggttctgccagaagtcaagaaaaggccgagaatttaacggaggcctttggtaacaacccaaaattctccatggaagttgtcccagacatatctaagctggacgcatttgaccatgttttccaaaagcacggcaaggatatcaagatagttctacatacggcctctccattctgctttgatatcactgacagtgaacgcgatttattaattcctgctgtgaacggtgttaagggaattctccactcaattaaaaaatacgccgctgattctgtagaacgtgtagttctcacctcttcttatgcagctgtgttcgatatggcaaaagaaaacgataagtctttaacatttaacgaagaatcctggaacccagctacctgggagagttgccaaagtgacccagttaacgcctactgtggttctaagaagtttgctgaaaaagcagcttgggaatttctagaggagaatagagactctgtaaaattcgaattaactgccgttaacccagtttacgtttttggtccgcaaatgtttgacaaagatgtgaaaaaacacttgaacacatcttgcgaactcgtcaacagcttgatgcatttatcaccagaggacaagataccggaactatttggtggatacattgatgttcgtgatgttgcaaaggctcatttagttgccttccaaaagagggaaacaattggtcaaagactaatcgtatcggaggccagatttactatgcaggatgttctcgatatccttaacgaagacttccctgttctaaaaggcaatattccagtggggaaaccaggttctggtgctacccataacacccttggtgctactcttgataataaaaagagtaagaaattgttaggtttcaagttcaggaacttgaaagagaccattgacgacactgcctcccaaattttaaaatttgagggcagaatataaactttaaatgaaaatagataatatttatatatattaacgttattacaattattttttatcatctagtacatctctgcgcatttttctcttctatatacagcttaatatgtcgaaaacgcgaagcaagaaagaaaagaaaattgacgaaaaaacaatagagaaacgttcagataagcatttatctttgcaacacatcacaagaaaagctgtgcacaatgaccggagcagcaactgcagcagaaaactctgccacacagttagaattctatagaaaagctttgaatttcaacgttattgggagatacgatccaaaaataaagcaactactttttcacacaccacatgcgtcactgtataaatgggacttcaagaaggacgaatggaataaactagaatatcaaggtgttttggccatatatttgagagacgtctcgcaaaatacaaatcttctacccgtctccccacaagaagtagatatttttgattcacaaaatggtagtaataacattcaagtaaacaatggttctgacaatagcaacaggaatagcagtggaaatgggaactcttataaaagtaatgattcgctaacatataattgcggcaaaactttaagtggaaaggacatatacaattatggattgatcatattaaaccgaattaatcctgacaatttttctatgggcattgttcccaatagtgtcgtaaataaaagaaaagtatttaatgcagaagaggatacacttaacccactagagtgcatgggggtagaggtgaaagatgaattggtcattattaagaacttgaagcatgaggtctatggtatatggattcatacagttagtgatagacaaaatatctacgaactaataaaatatcttctggaaaatgagccaaaagattcttttgcttgagcacagaggtgagatgcccaagtgagaattttttttaaataatgatgtactttaatacaatatatatatatatatatatatatatatatatatatatataaggaatgataactctatttaagtagattatgacattgtagtagaagagggcgtgctacttgcgctctgtttcttcttagtcattcttttctttttaggagctggtgtaccgctctcgcttttttttgcattttttctaggtcgcttaacctttggtttatctaaattattattattattattattgttactggtggcattgttaccactccgtttatttgcgtttttcatggctccaccattctgttgttgctccaaggcctgctgttgtctttgaagtagctgttgctgtggagtcaatggtgctgtcatcgatattctagcgttgaagggggttggattgatgtttgcacttaaagcctgctgttttcttttttctttatttattctccattgttcaataaatttcagcctgctaaattgattattatcgttacccatggtagatcccactgcagccgcagccgctgccgctgccaaagctacttgattgccattagccaaactgttattccttgtatttgatgcggaattcgaagttgaggacgaagctccacgtaccccgttggaactggagctagcaatctccatcgcattcttggttaacgaaacagcaaacgtggagttggttatcgttgttgtgcgttcattcatgatcaacatcaactgttcataatttgaactatgttgcggaaattcatcgcgttcttcgatatgccctacaacgcccttcgtgccttctctcgtagactcagcacgatgttcgtgaatgaaggattttttttcactatcccaatgaggttctgaaaaagctgtttcctccaacatgtctcggtgctcatatggatttaatggcacacttagtgacaagttcctcttggtaagtgttaaaatttcagattcaaactgttgataaatgctatcagaaaacctggcattatctgcataagacatcatgtcataatacgtcgtcaaatcattaggcttcaacaatgttcgatatactctaggtcgtttgaaggatgccttcttatttgctgtgtttgcgcctgtatttgccacaccactattaggttcggatggttgttgaatcttggaattgtcctgtgtgctattattatttgaaggggaagaagagctgttcaaattaggcttgttctctttgggggtgacatcaactgtattagtatggtcataaacctgtaaaataagatttccttcgtaaaattggatattacagtcccttaagacttccataatagcatcaggaatccttcctcttgcgacgtactctaaaaattctttcaaagtttcgttatttttggttaatattaaaccgtcactagtcagctcgggttgcttttgctgctgttgtaacctgctatttgcaggagcgcaaatcttataattattctcataaatatgaaattcaaaactgtgtaaatattgctcatattttttcaaaattgagtctgcatcttccacaaaattgtaaagtcttttaggtcttttgtttaaggtcataagcatttgataaaactgagcctcatagttttggagtgcttgctgttttctctgttgttcgagtagtctttgctgtagtaataatcgttgtctttgctgcaattgctgtatttgctccctggttaaagtcctagtaccttcattggcattactattactgtttgtcctcataacaggatgatttacatttgctaccgctgggttcataggaggtggtacattaactggactgcctggcgaacccatattggatggtgttgcgttcacaggaataccaaatacatggggatcgtttcctgtcgggctattggcactcatccctgaaatatataggcgcaaattaaccgtaactattccttcctaatcctcttgaaggctacttttctcattcttttatctctgctggtcgatcatcttaacacttcttcatgattaatggtcgtcaggtatcacgagcgggtaacagaactaagcagttatagcgatcccagttttactttaaagatagttagttagttattaatggtgcggataacaagaactattgtcactcagaatcttatacaggtatggacatggaacattgggtcatatacataagaaataaattataaagaagggtcgaatcaaacataagcggagaatagccaaataaaaaaaaaagatgaaaagaaagctatgtagctttccacatgtcttgcataccaaggatagatgtgacaacaccggatagcgcaacatactcttcgttgctagacaagtaccctaggttgttgaggacgatgaacgaatctgcagcatcccagaatagtcttcttaacgcggtgtacctgtcttggtatgccttccctagtaccttcttgtgatcctcatgctcatcgccttggctttgtgattttgccttgacaaacgcagcaatctgggcatgagatgtttggatcttacgaagatccatagccagaccacttaggaggccgaacagccaacaccaattggaccagcgaggtattttcttaccggtaagaacggttacaggaatcactttcaaaattctcaaaagattgacttgatctaacgacaaatatgcagcaaagaagatgtttttcaaaacattgcagactctaacgacgttgtcgctggccaacttgttatcgtagaatttagcagctgcctgcaagtggtttaaaggcttcagaaacctcagaaattttctgactgtggtaaattgagcttgtaattgcctggccaagagagatgagttctgtactgctaaaaatcttgctaaatactgcagtaatctgagaaccttttctctgccagctgagccatctagaaatttgacgaatctcgtcacggagggatgatataccagtgtatcacagaccatattgattatactattacttgatgaagtctttgaagtagtagatggagacaacggtttttcagttgttggagtcacttcccttttatatctataaatgatatacccatcgcttcgggttctccgagataaatgccgacgcgtagtgaaaatcgcaatggaattgatgccaactttgttcttggtattatatttttacaatagaagggcaagcatagaaaggatgggttactatgacattgatgatgtcctagcagatgggacagagtttccttgtaaatttcaatatgatattcctggtcttggttatttggaaaacaacccaggacgacccataacgaaaaacactaaactaagcctgccactatggttagcaagaatccttgcaattgtgggtggtgacgaagccttggtagatgaagaacctgtaccttttgtggaactcctgccaccagatatgttttctacgaaagttatgaacgctataaagaccgatccggtggctctggacttgcattccataaattcgcatttcttcagtctagccataaaatggataatgttgtttagcgaaaaagaactggccaatgtcgttagtgagctacttttgcaacgtgcccaagaacttaatcatcatgctagtagtttatcgattgatctcaatgcagactcgaccggaaaaaattcagcgaacactaatatagcaactagcacatttttactgaaactagaagaaatggagaaggagatatataaaaagtctcatgaatcttataaggacacgaaaaggtggatgtttaaaaaataacacatctttttctttagaaatacactatataaaataactataaaaaaaaggcaacagtataatattaagtttctttaaaagtcttgattctaaccctcgcctcttcttagaacaatccgtcgttatcatcattatcattgttttcgtcgttgtcatcgtttttattttgttccgaaccgctcatttgagcttcttcctcatcactatcttcaataaattcattcgatagttgagattttttgcccttattgtgagaaggctttttcaccacatcatcgtcatcctcgtcgctgtcggaaagagtttttttagcagctttccttctcttagattcaccgctatttttagtttttgttgacctctttcttttttgtcttggctgttcttcgtcatattcattgtctttatcagacagatctgaatcatctttaacattatgttcacttatggccatggcttctcgcacctggaatatcttttgtgcctcatcttggagtttcctatactcctctgcctgtttttctaacttcaaacgcctggcttcctcctcctgcttcatccatccttgctcttttaattcattttcttccagaattttacgtgcttcatcaattttggcgcgttgttccttcttaaattcttcttgctcattcaaggaacgttctaatgcacttttcatagtagtttcacccaattgtatacgttgttctagttcttccttaggaatcatattgaattcttttaggtcgttcaattctctaaatagttctaaaccttcttttaagccttccagggaatccttgatttgttgaaccgtcctaaatttgggatttgatcttcttaatgtctctgctatttgaaaatgcaacaaagctatattaaacttaacactatgaatgaacttgctcttagaagactccttcacgaaaagatccaaagcagttttggcattttccaaggctttttgataaaaattcacagaggtttccttaatggcacgtgcgtaccaagctctacctaataggttcaaaatatgtggtcttgtcttttcattgtcaaatttttttagaactaattcataattttcgatcgccttaccatattcacgcatttccagataacaatgggcaaggttcagttgaacatcttcattgtctaaagaatctcttaccttccttaaaatttctagagctggtcccaatcttttgctttctgcaaaaattatggcaagaccttgagcagcgaaaatattaaatggatcaacttgtagaactttttgatacaactggatggctttcaaataagaatgctttgattttccctgttcctttggattcctggactttttaccgtctctggcaattgtcacatatagattagctagagaaattaaggcatatgcatcgtgagaattatactttaccaaagtttccttgttatgggtcgtactcttttcattgttttttctttccttgctgtttttcaagtaccaaccataaaatgaacgaatctccagatcagacttgttcaaatctaatagcttattcatttctgtactcatatctgaatcttctatcttagattgtgcaaacttgagatatagatttcttattcttgccgcaatgtaagctggatgtaaagacgtcacctgggaatatatagattctgatttttcacagtcgtttttctcattagttcttgctatgttatattcaagtgtaatattgacactttcatctttatcactcacttttgcctttgcttgcttaaagagatcatcagcctttataaagtcaccgttaatgaagtggtaacatgccaaattattgagcacttccaacggaatttcctttttaatgaattccatttcctccaaagctttggaaagataatccaatgaagttttatattggttttgtaattcatacagctgagagataactaggtaagctctagatataactaattggttctttgtggcaagcgttaattttaggtatctctccaaatactttagagctttttcatttaagttgctttgttcttttgctgaagtgtttttggctgtcttggcatcaaaggccttgcctgcataaagcatacccaagatatagtttaattcttgtaaactttcatttgtcttgtaaagattctcgaaagtgatgatactttcctccaacaagttatttttaatttgggtttgacccagccctaatttcgcgagcaggttatcttcatttttctttaaactttcttgaaacatgatgaatgatttacgataatcacctaatgcataatgcgctctaccacaccaaaatgaagattcagatagaacaattttggctatcatcggactcatttttaaaatcctatggtgataaatatccaaaacagtttgataatcacctttgaagtagtagtacgtttgtaataacgtcaataaaacaggattatgctggttttcggagaaaatgttgttcaagtcactcaatgcctttgtaaaagcctccttgaatgttttatcgtttgtagaattggtgaaagattcgcgaaattcacccaataatactaaaatggaggcactcgtattttttggatttagttgtaaggctctctgccacgatttgatagccatcttagaatcctttaattgccaaaaacacagaccaattccaatacgaggatctggttgcaaaacagggttgatgaccagcaattcttgaaaaattttcagactggccatataattttccttctgataaagcaatttcgctcttaaaagtaaaaacaagcaattgggtttggattgcctaccagacctgtggtcttcagcatgaatactctttacaaaaaggtcggatgtttccaaagccttgtcataatgaccgcgctggtagtataactcgaccgtggctagcatatttccaatccatgtggggtcgaacccaatagcatcctttaggtttaattcagcctgtgtcagttcatgctctttcgtttccacactcagcgattgtccctttgctagatttaaatgtgcccaggtcagaaaagtgtgtagtgaagccctttcagagttttggaaaacatccaaggccatttcaattagcttaataccttcgtttgtttttccgtggttgcaataagcaagtgcaatggtcaaccaatgttctttttcagaattttcctcaactaaaagagtctttaaatctgttggatcatccggcaagtcggtttctaaatcgataccgaccaattcttctgaagcctttaatggaatatctaaggacgttggccattccatagaagggtagccttccaccttcattgcgtttgtcatgtttttttttcttgctctcaacacaaatggaccagacaattagaactttgcacagaagtgattgttagataagacactatggtactaataacaactgtctatctaccgtaatattatcttttcctataaaatgaataatttttcattcaaaaaaagttcgattacgggtaacgagcaaatagttactgtgaaaatttttaagaattgagcgatgagctaaaatgtcaatgtcagtcaattaacaaagtatacaataggcccatatcattttagattgtacctgaagtgagaactaggtaatatacgacgatggatagtgtaattcaaaaaagaatttttgtcggaaatattttccataatgcagatgattgttattcagaactactagatcgatttggaaaatttggtgattgccaagattttcagtttgaaaaacacaaccactttgcatttatcgatataaggtttaatgatgaggcagattttaacaagctaagaaagagctttaataatgttaagtttaaagggaacattttgaaggttgatgaagcaaagccgaattgggaaagcacctgggcggtacaacatgcaaaggaccttaaagaagatattatactaaatgctaaaatgaaaaaaaagaattggcaacattataagaaaatggaaaatgtagcgaaaagttggaaagatcataaggaagttattgctggcagaatgagggaggcgccgagaaaaaggagtcaattgaggaacattacattcaggatcaatgtcaatggttcattgaaagtttacaaatgctataagactaaattatggggttatgaaaggaacaaagaattgaatgaccttgtgtacaagtttacaaataatttctggaaaaacggatacaaccacattgtcgatagattggattacagtcgtgctgttaaaactgttcgattcaaaaatgggctgaaacagttaacagtgtcaaaagatgaaaacgtttgcagtggagagatggacagcgatgagaatatgtcagaagaggagaaggagaaaaataatgttattcttaatgacctattaaaggactttgacttcgataagccaatgacgttgaatgattcggacgaggaacttctgacagagcaacgtaaaggagaggaagaagaagaagaagaagaagaaaaagaagtaaacgctcccgaatacgagaatgttaataagacgaaggaccagagcaccctaccacaagaaaaaccagaggaaaggaaagaacaggacgagggcgacgggcaggaggataatgaatttattccgactttcaccaaggaaattggtcaaggtacaataagcaacactgagacgttaagaaacctattcaaccccaacgaggcagaacctgtatcacaattcaaattgattgaagattctgataatgatattgatcatgcgaaagatgttgatgtgaaccaactggaggaagaagtaagtaaatcatctgacaccctaggtttgacatcggctcccgtaccacatgtatctagagataaagataacaaaaatttcttgtttttccctcatttgcaatcgccatttttagtaggacaaacacagttgagtaaagtaagggctcctggaagagaaacaatgctatcgaactgggatgaggagttctgggctaacagaggtaattggacccgtgatatgaggcgcaaaatgaaagatgcattgaagcaccgtaagaggaaacaatcaaagagcgggcttcttctatagtgagtatatatacatatatagtatagatttctctgcgcttattcaaaaagcatttttaccgaacttaacagccatttccactgctgcagcaccccaatcttcaccatggttgtgcatggagtgcgcttcatcgatgccagctctggccagggcttgttcttcagtcatgcaagttaagaggccaaaaatgacgggcatgtcgactttttcttgtaagttcatcaatgcgtgagtggtggaatctgaaatgtattcaaagtgcattgtactacctttgataagtacaccaataggaattacaacatctagcggctttcccaacttcgcttgtctgtcaacaaacctttttgtcccccaaggtaattcataggatccaggaacagtttcaattattatgttattttcctcgacaccaagggaagccattctttcaatagcacctttcacaagagcgtcaataatgacacggttccaacgggcatgaatgataccgaccctgattttggaaccgtcataaacttgatctggtttgcctaatcctttaactgccatactgcgttatactgcgttatactgcgttatactgcgttatactgttccttttcatgcttttgaacccactctctggggcaatatttcattgttctcttttatatggctacttttctcttattaacggggacctccgaaaatatctccgctcccagaatatgtcatagagccttaagaattgacctacgggaacctccgaaaacctcccagagttttaattatacgtcatagaaccccagacctcttcgatgaagtttcgtggaaactagttccatccacctcacttaaagttaccttaatgaaagccatcattgtttactagtaagggtagtggtgtgacccggacctgatcggctgaaattttttggtttagagaagcatattaaaccaacagcacaaacggatgcttcagcagctcatctccagcatttcgactaaccaagagcatacaagatgtctacgttcatattccctggtgatagctttcctgtagaccctactacacctgttaaactgggccctggcatatattgtgaccccaatactcaagaaatacgacctgttaatacaggtgttttgcatgtttccgctaagggtaagagtggtgttcagaccgcatatatagactattctagtaagagatacattccatctgtaaacgattttgtaatcggtgtcattatagggacattttcagatagctataaggtttcgttgcaaaatttctcctccagtgtttcactatcgtatatggcttttcccaatgcttcaaagaaaaacaggccaactttgcaagtgggagatctagtgtatgcgagagtttgtaccgcagaaaaggaactagaagccgaaatagaatgttttgactcaactacaggacgcgatgctggtttcgggatattggaagatggtatgatcattgacgtgaatttcaatttcgcacgccagttgcttttcaataatgacttcccgttattaaaagtgttggctgcacataccaagtttgaagtcgccattggtctcaatgggaagatctgggttaagtgcgaggaattatctaacactttagcttgttatagaaccataatggagtgttgtcaaaaaaacgacacggcagcgttcaaggatatagcaaaaagacagtttaaagaaatacttacggtcaaggaggagtagactaccatgtataattaaaatatataaacacatagatatcatcaatatttcacgtccttttttaatgtcctttgaaaaagcgaaggaaaaaaagtttcatctcatctcatctcatcacatctaacatatggccataaaatttcgacaactatagtgcacatatctaatacgatgaagaatctgaccactataaagcaaacgaacaagaatgtcaaacaagaaagacgtaaaaagtacgctgatttggcgattcaaggcacaaataactcctcaattgcttctaaaagatcggtagagttattgtatttgccaaaactgagttcggctaataatttccaaatggataagaataataaactgttggaatattttaaattctttgttcctaagaaaattaaaagatctccctgtattaacagaggttattggttgaggttatttgccatcaggtcaagattgaactccatcattgaacaaacgccacaggataaaaagatagttgttgttaaccttggttgtgggtacgatccattaccatttcaactattagacaccaataacatacaaagtcaacaatatcatgaccgagtttcctttattgatattgattactctgatttattgaaaattaaaattgagttgatcaaaactatacccgagctttcgaaaattattggtctttctgaagataaagattatgttgatgatagtaatgttgattttttgactactccaaagtatctcgcccgaccatgcgacttgaacgattctaagatgttcagcacattgctaaatgagtgtcaattatacgatccaaacgttgtcaaagtatttgttgctgaagtatcactggcgtatatgaagccggagcgttctgatagtataatcgaggcaacttctaagatggagaatagtcattttattattcttgagcagttgattccaaagggaccttttgaacccttttctaagcagatgctagctcatttcaagagaaatgattctccgttacagtctgtattaaagtataatactatcgagtcacaggttcaacgattcaataagttaggtttcgcttacgttaacgtgggtgatatgtttcaactgtgggaaagcgcagatgaggcaaccaagaaggaacttttaaaggtagagccttttgatgaactagaggagttccatttattttgtcatcattatgttttatgccacgctacgaactataaagaattcgcatttactcaagggtttttgtttgacagatcaatatctgagataaacctaactgtggatgaagactatcagcttctagaatgcgagtgccccatcaatagaaaatttggcgatgtagatgtcgctggaaatgatgtgttttacatgggaggtagtaacccatacagagtaaacgaaatattacagatgagtatacactacgacaaaatagacatgaagaatattgaagtaagcagcagcgaggttcctgtagcaagaatgtgtcacacttttacaactatttctagaaataaccagctactgcttattggaggtagaaaggcaccacaccaaggtctctctgataattggatatttgatatgaaaacaagagagtggtcgatgatcaagagtttatcacacacgagattcagacatagtgcatgtagcttaccggatggaaacgtcctgatccttggtggggttacagaaggacctgccatgctgctatacaatgtcaccgaagaaatcttcaaagacgtaactccaaaagatgaattcttccaaaattcgctagtatcagcgggtctagaatttgatccggtttccaaacaaggcataatattgggtggtggatttatggatcaaacaactgtctcggacaaggcaattattttcaaatatgatgcggaaaatgctactgaaccaattacggtgattaagaagctccagcaccccttatttcaacgttatggatcccagataaaatacattactccaagaaagctattaatagtcggtggaacaagtccttccgggctatttgaccggaccaactctataatcagccttgatccgctgagtgagacgctaacatcaattcccatatcaagacgcatatgggaagatcactcactaatgcttgctggatttagtttggtgtccacttctatgggcaccatacatatcattggaggcggtgccacttgctacggctttggatcagtgactaatgtaggtcttaagctcatagcaatcgcgaaataatgctcctatcgggattcgatatggttgccagctcgctatgtgactcacttaaagtacatgatccgtcattgtgcacttttttacgaaataatggcctttttccgctctatttaaaagcgtgaaaaaaaaattgcaacatgaagaaaattcgactcttaagtgcaagtgactgcgaacatttttttcgtttgttagaataattcaagaatcgctaccaatcatgtttaaaagatatttatccagtacgtcatcaagaagatttacaagcattttagaggaaaaggcctttcaagtgaccacttactctagacctgaagatctatgtataactagaggtaaaaatgcaaagctgtatgatgacgtgaatggtaaagaatatatcgatttcaccgcaggtattgcggtgaccgcattaggccatgcaaatcctaaagtggcagaaattctgcaccatcaggctaacaaactggttcattcctccaacctttacttcactaaggaatgtttggatttaagtgaaaagattgttgaaaagaccaagcaattcggtggtcaacacgacgcctcaagagtatttttatgtaattctggtacggaagcaaatgaagctgctttgaagtttgcaaagaaacatggtataatgaaaaatcctagcaagcaaggcattgttgcatttgagaactcttttcatggccgtactatgggcgctttatctgtcacttggaatagtaaatatagaactccttttggggatttggttccccatgtctcattcttaaatttgaatgacgaaatgaccaaactacaaagttatatcgagaccaaaaaggacgagattgctggtttaattgtcgagcccatacaaggtgaaggtggggtttttcccgtagaagttgaaaagctaaccggattgaagaaaatatgtcaagataatgatgtgattgtcattcatgatgaaattcaatgcggtttgggccgttcaggtaaactatgggctcatgcttatttaccaagtgaggctcatccggatatttttacatctgccaaagcattgggaaatggcttccccatcgctgccaccatcgtcaatgaaaaagttaataatgctttgagagttggtgaccacggcaccacgtatggtggtaatccgctggcctgttctgtaagcaactatgttttggataccatagcagacgaagcttttttgaaacaagtctctaagaagagtgatatcttacaaaagcgcttgcgcgaaattcaagccaaatatccaaatcaaataaagactatcagaggaaaaggtttgatgcttggtgctgagttcgtcgaaccacccaccgaggtcatcaaaaaggccagagaattgggacttttgatcattaccgctggtaagagtaccgttagatttgttcccgcattaacgattgaagacgaactaatcgaagaagggatggatgcttttgaaaaggctattgaagcggtttacgcttaaatatactttgtaaattgtcatgtatagattgtttttttttttttcatctttatattgtagtataaaaaatgccattcggtcagagacacataggaacatcttacgtgatatgtacatgtggtgcgtctttcataccttgaataatataattaataagagttgtccttttaacgtcatcctctcttttttttttttttttttttttttctccttcattttgacttttccttctgtgttaacatgatgagtttatacgtgcatcctaactagtagaatgtatatatattatattatgattatatatataattttgattaaaataacaattatcttaagaaaaattcagactatcttacaaggtgattgatggttgagggtgtctaccattggcactggaatgtggaaagaattccaaatgcccgtcatcggttaattttaaaacttgcttgaatttaccaccaattctcaatagtggttctttgtcttcagatttagtccataaggcaaacttgttaccaccttttctaatgcttaaaacgacaccgttaatttgggagtcgtcttcatcaattgtttcaccaataactgctagtaaagttcttagccataattcatcaatatcagcaccttttcctctaagttggaaagaccatttaccacctttagcattggcttcatcttcccattcaggtctaacgtcattacggaagacgtggtaatctgatttcaatggtagttcgtgtggctcaggaatattttgaatgatagcccaaaattcttcaacagtttggaatgaagtgacgggacgtaatagatcagaccacgactcagatttatcgacggctggctttgtgtaccataaagtccatttggtgttcaatgggtgcttgacatcgaagtgagcactgtcacttaaaacagtctttggagtagctgtggtatcatcgactgaaacgttttcttcaaacttcttgctaacttcttcaacggacatttttcttcctttcactagttttcagacaaaaatgcttttatttttcgtaaaactcctaggaagtactcaagcactaacacaaacacatatgtacaatataaatccagaattaacactacctcttgcaatgtaaaactctctttatcaggtattgcattaaactctattgacgacgaaaaaaattttcttttcggagagggtaataaaattttacccgacctttttgacgggtaatattactctaaacgatttaactaaacaatggtgatgatatgttaaactatacattatgtggagaacctagatgaatgcaacaccggggcaaccgccgggacattcttgttcattctcatcgagaaaccattcttgtatgcactggaagtgaccttcgtgtccacaggggaggatgaccatggtcagtttctttaatggtctttcacatagaacacaagatgtattcttcttcttacaagagtcacaataccagtatccaaacttgtccatgatcttcttattgcccgtctgctgagcttccgctctgagcttttctttagaactttcgttagtgattaactcaccacagcgttcgcaaaacaaccgaatggaagattggtcaccctcagaacccatgatatcttcgaatgggcagtattttaagacgtctgcagcaatgccgaagagttcgtatcgatgtaataataacaagaagtgagcgattgcgtcctttgcaatgtcgatttctgttatttggtatatcgtttggaaaagaaataaaatattcaccgtcaatacgacgttcccagtctcagtagcttgattgtagagttgtttgatgagttttttcgtgtcccagggtgggtcagcgataattttcttgcatttggcaagctttttcgtcaatgaagaagacagttgttccctaccaatgctatctggccgtgatggcgcatgtctgggcgaaccgattattggtgctgtatgggaagaaagctttttaaaagtttctagttgcgaggttgttgtggcatagctttgtagcgacgaaaccttactgcgtgggcttacgctgttgtaagtaaacctaggagatatattgtcatcttcgttacctatgtccgtatctccattgtaaccgttgggagaatgcaacatgaaagtatctatgaatgacttgcggtgctcacgtttctgcaatattggtatacttttcgcgataggagacgcgtgaaattgtgctgacttagtcggtgagtcatgaggctgttcttcttcttgatgttcatgttcgtcttcctctataatcacatcgtcactcactgtttctcccattttagtccttgactccaagcgttggttctgtagctcttttagcttagttaaaacttcatctgaatcctcatttggctgcgcataggggattatttccgtgtttttgagctgctctttgagcttagaaacaggtttcttttcggcatcacttggttcatcagagttagcacgaaatgcctgcggcctttcttcaactaacgactcagccccacttgtccctgcaccatcctcctctgggaactcttttcctgttttcagattttctccagcttcgaaatcggagctttcattggcatccatattagatgcgttatctgatgaaatttgggaggaggtcatccacttcaagtcccataacaatgaatctcttatcaagatccagattttgaagttggttagatcatctatggatagataaacagatgcgttatgcgttgcaatagatatcaaatctaccagtgtttgtattttttcttgcagttctgcttccacgttcttgtcgatcttcctagctctgtcatgactttgcctacttgcagaaatggaagatatacttgatctgacatccttctcgtcaaactccctcgaactactggaatttcttttggattttttgttatttactttttcattcattaaggtagcccatgtattattttctggaaaattgtattttttcaaaaggtgactttcgattattttgtcatcatcatcatcatcatcatcatcatcaccatcatcattattattggtagtagtagtattatcaccatgtgtttcggttgcgtttttaacgacgtcaatgttctctatatcatttttatatgcagtgtctgcactgtctgaaacattatgctctcgaatatacgaaaacttgagctgtctcgccaaatatttgaacttttctactggagaatttttcatagaagaactttcggaaatgacgttcttttttcttgaatgtgcgattttggttaatcttatgttattgaagatctgcggtatatccaaagtgatgatacaaggcggttcaatggcgatttcttctctattttcagtttgtggcgtcagggatgtcaatgatgcggaagagctgttaaaagaagatgctccagatgctaatgttaagctttttgtgctaaacgttgggcctgcttttaaagtaggcggcctctctggcgtaaaacttgttaatccagtatggctaaatcctttttttatccctccaattattccctggttctctggattgccattcttcgggttttttattgtacctggatgcttcttgcatgtggtacttgaggtaggttgaagctccggttctaccacctcatatgagcctatctcttggccaactgaaagtaaaccgttaccatccaaatctctccaagttgttgtatttttgctcaaattttcgagcactgttggttctttgttaatgtcccagccatttatacgggtccccttatcgatattaaagatcaagttttcgtcccaccatactaatcctaaagaaggcgtttctgataggagaacatgttttggaatgtactttcttgccaaggaatagatgcgaacttcagcttcgtcacccattgacgatattcctagtaatgaattatatatattactactataagcaggcttgaacttcaatttagtgactggatagcccgtattaattgttagtttgggaaatgccagcgagccgctattgttcaaggacgtattgggggcatgtaacgagggagagttcccgtaattgaggactgtattttcggcggcattggcattgtcgccaacaaaccagaggcaggatttaccgtctctaccacctgtagcaatgtattcttgattgggatgccaatttaaacaaagaccgggtcctgtgtgagcatttaattttttttcgtattgggcaggttgtcgaagatcaaactttagcaagtatcccgaatcgtgaatagaagcaaatttgtaaccgctttttaaattaccatacgttgatgaaccttgatcgttcttagatgcaaaattgtaaccgggcatccattttacatctctgattgagtcagatgcggtatttatactaatgtcagatctatttgagcttttagatttattggaacgtaaatcccatatttttacacaactatcttgtccaccacttattattaggtttgattcgaccatgttgaagtcaaaactattgatagatctagtgtgttcgcataaggatgttatcaagggattgtctatcgaggaactcttattgagatcatatatcgatatcgccgtagaattgttgcacactgcaatacagttcttgtaattattaaatccagtcttaacatccgcaatggtactaaatttgttctgtcttgttcttttgctcagcttgggcaaaagggatgtcgttccccttgttgaggtgttgctattaggtgttatgaaatcatgaacgcatttgatagatctatctgagggcgagaatttatagagccccaaatgagttttacctgcacaaacaagaccgttaatgtttggatcattcactttgtctatactagataattctttatccactttggtggtgtaaatgagtccagacgactttcttgtatttgtgttgattgcatttttctttgttttgattttcatgttcgatttattgctcatgcttccggttgtttttgcgtaaggattcttatcatatggcaaataactatcgttgaatgaactagttctgtgactttcaggcatataaaccccattactgtaagaaaaagttggagttagattaggtcgccgtatagaatctaacacggaaggttgtccactatttgagtaatgattcattcgaaaagaagaattgttgcttgacgaagatccaagaaactcgcccttgcctatagaactaacgtttctgttttttggtatcggggtactccccttgggaatggaagcattttctacgtgtggtgataagctcatgattttcaactaaatccactcaatagctcactcgccttcagccagcaatcgcaccatatgtattatcaatcggttttcctttttcagtaatcatcgttatatatcgatgtttttgacaaattaaaaagaacgttccgagacagaaaaatttaaactctccgatcatgcatagctagacattcaacagtattctaaaatgctatagtaagaaaccaagaataagatcctagggattcatagtataatttaatccatatataagttttcagcatggatgcttcctcggttccaccaaaggtagatgattatggaatgtatacaactgaaatttcacatcataacccaatagagttgaaaaatctgctatcatcatcagactccagaagaaattctcaagatgaagatagtctacctaacaatacaaacttaatcaaagaaattgactggcagggcgagaaagttaaaacatatccactaaactatcaaactgtaccactagtaaagctgcaggtgatagcatgcttgattatgttcgtagtctttggtatgaacgatcaaacagtaggtgcactacttcctacgctaattgaatactatcatatatcgcgggtagatgtctcaaacgtatttatagtccaattatgtggttatgtgatggcgtctttatcaaaagagagattgaataagcactttggtatgagaggtggtatgcttctagcagctggtttgtgtatagtatttcttatcattttagcaactgcaccttctagtttctatgtttgtatgttttgtggccttcctcttggtttagggatcggcatcttagattctaccggtaatgttttaatgggcagtcttttagtccataagaatgaactcatgggtatcatgcatggtctttacggggcagcagctatggttactcctcccttagtttcatattttgttgaatggggtcattggtctctttttttccttattcctctgttcttttctataataggcatgattgtaatcttcccagcttttaaatttgaaactgcaagtaaatacgactacctctgctctgtggaaaacaaagaaagcaacaatgatgtggaagaagcgggtgataactcgctgatggaatctaccaaggcgagcccaggattttttgaacttttaagaaatcctgctattttcttgtactcattgtatttgttcctttacttaggtgctgaaattacaactggttcatggttctttagttatttattggaaactaaatcaagtaataaggttgctatgtcatacatagcggcatcgttttggacaggtttgactgtaggcaggttgtgtctaggatttgttactgaaagattcttcgaaaacgagtataaagcaagcaaagcgtacgcttttttaactctatcttcatacaccttatttgtgcttgttgggttgatcaattcaagctcagttttctatttcgtcgtgttattttttgttgttttttgttgtggtacgtttatcggaccattattcccaaacgcaagtatagttgcattacaagtattgcccaaaagactacatgtgagcggggttggggttgccgtcgccgttggtggttgtggtggtgcagccattccatatttggctggagttattgcacacacagtgggaatccagtatatcccactattgtgttggattatggttgcgttatttacattggaatggacattgtatcctaaattcataaaagggcatgaagaatatttttagtttcagaaacgccatcggtgccagtgcattgcaactaattccaaaattagaaaaataaagctgttgaataattgtaacagaaagatagaaaggcggaagataaaaggaacttcagacaacatatggaactttttgatatatagtatacataatgacactcttggtcgtttacaaatagatagaattttaaggaaaaagtaatactatctgaagtctataaagagcttttgaaagctgcttcagtagtgcaaaaaaagtgtatagtagccttttcaagataacataatgtaactagcggtaccaaggaaactgtaaaagaatagaaaaacatgcgaaaaggtcgtaaaaatggtcattaaaaggcgggaggtagatggagttctggagaggatcataaatataataaaggagtaccgatattcaactcccgtatggtaaagtatcagtcaagcaaatccgttgctttcaattaggctctgcaaatcatcaaaaaatttatcattaacaacagagtctagtgtagttaaagtttcctctgagctatttccaaaactttcaaaaaacaatttaacagcttcgatgtattcaaaaccaaacatctgagaatagtgattgatgaaattttcaataaccataatggtgtccctaatttgcttgccgcaggttgaagggtaatgactttgatttaaagaatgtggctcaacgacgcccgcattaataacattgaagaaaaataagctcgtatcgatttcttcatgttggctgatatatcgatggatttgattgaactcatcaagggagaaaggtgtaaactgcgaatagtaatgttttaatctctttgcaaaatctttgatggcaagttcataaggtttgtctaagtagtcttcattaaacgatttattgtggatattgtatttgataaagcttctgttaaaacatgacacctgtaagattatgggcaccaaattgaaactagaaagctcatctgtattgaacgaacaaacctcctcaaatataaatcttcttctttcgatggtcgaatttgtggcgtcgaagattcccacgtcacattcatcgttgttgatttcgtgaaacaacttttgcaaagtgatcctggcatacgtttcctttttatcgttatttttcggattaaataagtcttccgaagatgtattcgacaaaagcaaaggctttgaaatggtagcacaactgatttgccttcttatcttaccagcattaaaaactttacagcgtaatgaattagttagcggattgttcttcaaacattgaattaaatgagaagaaatggtagacttcccagtagctggtagcccaatcaaaacaatcataaacttgttaacttttccatttgtatacgtagggtctgcattgtctcttttgtaattcagtgtaatgggtaagtgtaacgggtcgttagaaataaaccttgggacctctgtagacagcagtgaacttttgtgattatcgaaaaaaacagaatcttgacaatctaaagtggctctgtcgagagatgcgcttgaatagctgttaccggtgttaagtgaaaaaagagaattcgaggaattatattcggaagtcaaatatccatcgtgagagtctgaatcggaagaaccacccattttcaaacttccagcggaaaaaacgcgttcgttatcccttttcttccttttccttatatctaaaatattaaaaatcgcgtaaggtaatttgtttcgagggcagtggaacttgaagccaaataagaagtataagtactgggctctcctagtatttccggtttagtgttactcgtatatgagcgtatcagactttttaacaccctctaaaaaagcaaataagttggtttgctgtggcaccaaaataagcgaaaacacctttgtttagagcacgtcttcttttatataagccaatcttccacacgaaaaaccgagtaatccaatttacttttcctacttttttttcattatcaatcgattcagatgcccagagaagaaaaagaaaaaaaaggaaaacaatttccgttgcagactcatctgtgcgcgatttctgtgaaaaggtggggcacttgtgcctggaatctcggaaatacgtcaattaatttttggtatatattccgataagctatagttcgtatttttccgttccgagggaggtgtacgggtggactaccacgtgcctactatacgctatacggtagttgaaaatgtatatagttacacaaatgatttataatagtgtggtcattgggacgacgatggaggagattgtgatccggttcttaaggtgtcctgtatgctggtgagtttgtcgtgtacctgtttgcatacttgctcgatctcgcgaatttccccgcgcttgtattctaattgttcttccaatagcataataagggactctcgggactgatggggtctgtactcattaagtaggtggtgaatattgacaagaatggtccttatgttctccactttgcgctcatacatatccggatttatgctcaatacgccgatgagttccaagtaatttagcaggagggatttcaatagtttgcgtagctcttggattttgtattgataatttgtgctttcgttttctgtggatttcttataaagttgggtgagtcccatgctctctaaatcgggcagttggtccttcacctgccatatactcccaaacgctcggtactgctgatttttgggcatggggggtgggattaggtaatctagcgcacatgtaatctcctcttcactgccgccgttactgttatttggagccgtctgcttcgcacttgcggccttcttttctttgtattttggtaatttttccagattggactgtgtgaaaaacttcacgtatgggggtggaggtgggtacaaggagctaacctcattaccaggatcattggacatttttagtttgtgaattttttttttactagcttaaatttgggatatgaaacctcttttatgtcatatttgcacgtctaatgacctgcctgctgaaaatgcaagattcgttgtttaagttctaactaacatttcgtatttcgtgataatagtttcttttaaaggtgtgaagagggagatcatgaaacccacaatagacgtatgggcttcaatatgtgcaatgttggttgctactaaatgtctttctccagtggcagagaactttaaagagaaatagttcaacatgagcaacgaagttgacaggatggatgttgatgaagatgaatcgcaaaatattgcgcaaagctcaaaccaaagtgcgccagtggaaaccaaaaagaagagatttgaaattaagaaatggaccgcagtggcgttttggtcatgggatatagctgttgacaactgtgctatttgcaggaaccatataatggaaccatgcattgaatgccagccaaaggccatgacggacactgataatgaatgtgtagcagcctggggtgtctgtaatcacgctttccatttgcactgtattaataaatggatcaagacaagagacgcatgcccattagataaccaaccttggcagttagcaagatgcggtaggtgaaaaaatgaattgcccgtaaacatttaaatcataccgaggtagaaggattatggcatgttcctttttttttagagtatgtcaactggcgcagtagatacatgtttttctcttccacgtcgaattttgttatatacatagcataatcgagttgtatgcaccctttttgtttatctcgttagtaactcggggtaggaataagacatccacaaaggtgacagaacaaaatcatcctagccttgttcataatctacctctatatagccgctaaaaaattagtagtattttgactctttaagagcacatttattatcaggctgcttttacatacttcttttgtttaaaacatttaaagacgatcactgcccttccaaaggacaaatatatatacacaaacactaggccaaaagttcacttataataatttagtggtaattatgttgggtaaagaaattgccaatagtcttttttttccgtattgtaaggtgagactgaggtagcggcacaaaaaaacgacacataataggatactgagtaaagcagtattaaaataaaaaaatatattttacctcgaacgctacaaataaagcagaaaagaacaaaatcgtgagcatgatggttttttcgagcacctttatttttctaattttggagttagttgtactgtgtgaagcttcagtccacaccattcaaattaaggacaagcatttcgttgacacagtgactggaaaaccattcttcatcaaaggtgtggattatcagccaggaggctcttccgacgttagtgaaaagcaggatccgttatccaatccagatgcatgcgctcgtgatattttattatttcaagaattgggaataaacacagtaagaatttattctataaacccggacctgaaccatgatgcgtgcatgactatgctcgcaatggcaggtatctatcttatattggatgtcaattccccattgcaaaaccagcacttaaacagatatgaaccttggactacctataatgaagtttatttagaacacgttttcaaggttgtcgaacaattttctcattacaataatactttaggattttttgctgggaatgaaattgtaaacgacaaaagatcagcacaatattctcctgcctatgtcaaggagttgattggaactatgaagaattacataagcgcacactcgcccagaacaattccggtaggttactctgctgcagatgacctgaactatagggtatcactgtccgaatatttggagtgtaaagatgatgataagccagagaatagcgttgatttttacggagttaactcctaccaatggtgtggccaacaaactatgcaaacttcagggtacgatacattggtggatgcttacaggagctattccaagccagtttttttttcagaatttggatgcaataaagtattgccaaggcaattccaggaaataggttatttgttttctgaggagatgtattcagtattctgtggaggtctggtttacgaattttcacaggaggataataattatgggttagttgaatatcaagaagatgattcagtacagctcttagcagattttgagaagcttaaatcgcactaccaaaacattgagtttccttctatgaagactttaaaggaaactgttcagatggaggagacgccatcatgtgcggaagattatgaaaatttgaagattgaatctaaaattgctaaaaatttaggaagttctttgataaaaaaaggcgtgaaagttgaaaaaggcaaatacatagatattcacgaggatcagctgtccaccaatgtcacgattttagacaagcatggtgacagatggaatgggcccaaaaagattgaaattaggcaaagcctgacattggcagacctggaaggagaagaacaagaagacgcagatgaagacaaagatgatttaaaacgaaaacaccggaattctgcctctatttccggcccattgttacctcttgggttgtgtttgcttttttttacttttagtttatttttttagactttaatgtcgttctccctttttaaagagtaaatacatatttaaaaaagtgactatggctattgctaaacgtgataaaaatcagagcctataacactctctgaaataacgctatgcaggaatttccagttaagttcttcttggggtgacttctttactcggtatgatatgtgttttatatgcacagtacgagtccattagggtaaattagtggccgagaaacttttgccgccgagcttttaagtatccttttgccacttcttatttagataaagacctggcagtagtagtcgtagaagataagatagacagagaatgaatactaataagatagcacaagacgaagtccaagataaggttttgcaaagagcagaactagcacattctgtatggaacttaaggttcaacctcagtaaagttgccaaacggattcgcatggaaacaaaggtatttccagagataaagataaatgacgcgcaatcacagttagagcgatctaggtgtagaatatttagccctgacctggaggaagaacatgtgcccttgattcaaggctttaaatgtttggattcaccccctcccgttccaccaagctcatcgcagggggaggatgaagagaacacggtagattcgcaatactaggaaattagaaccgaatcaaaatagttccgatcctaacttttctactaatctttgagattttatctcattaactctttgaccaagctatgaaatgcgtaagatgaacttttgtttgagagtgttaagtatttaggcgtctacgctatgatagcctcactctaggacgactgcttttttggaacaacttgttgttctccgatggtatattgtgtgtttatgtattgttctacgtactcctccgtctctttttcgagggcaacgctttgaactagtattttccgttatagtatgtcccccctatatgcaaccccttgaatggacgaatctctaaaatatacaaccttttcctctataggaaacaagtagggtcttctacgctaaggattacataacgcatgtatcaaaaactgattttaattgattaatttcaaaatgtcagcgtaggttcacctagacttgttttatagctccattcaactggcggtagacacaactaaagccaaaaattgcctaaaaatttcagtactctggcagcatctactcatttaattgccgtaatacatgggactcaatgatccttaatatgctaaatgctacccctccttttttcttttttattcctcataaaattgcaaatatcgcaagcacgtttttactcagcccgtccgctttgagatacaaaaacgatatctgaaattaaaattttctctggaacatggtccatcgaactaattatgcataataacgtacgttcctatcctatgaacacttttctttttctggataaactgacttaacagtagaaaacgtagtgtgcaaggccatccttcaatatagactcaaaattagaaagagtgccctgattagttgagtttttccttctataagcaagaaaaatatcatcctgacaagagacaggtattatataaaatatttctacatggaagtatactgttagttgaacataaattcaacaaaaggataccattacttcttctcaaagatcatcgaatattgctagaaagcgtaaaagcattttaccatgtcatcatcctcaagttcatcagagtcatcgcctaatttatcgcggtcaaactcactggctaacacgatggtttccatgaaaacagaagaccatacgggattgtacgaccataggcagcaccctgactcactgccggtccgtcaccaacctccaacattgaagaacaaggaaattgctaagtccactaaaccttctattcctaaggagcagaagagtgcaacgagatacaacagccatgtggatgtgggaagcgtacccagtaggggccgcatggattttgaagatgaagggcagggtatggatgaaacggttgctcatcatcaattgagggcatctgccattttaacttctaacgcgaggccttccagactagcccactccatgccacatcaaaggcagctttatgtggaaagtaatatacacacaccaccaaaggatgtaggtgtaaagagagactatactatgtcatcttctactgcatcatcaggtaacaaatccaagctgagcgcatcttcctcggcaagtcctattacgaaggttagaaaatcttcgctggtcagtcctgttcttgagatcccacacgaatcgaaatctgatacacactccaagctggctaaacccaagaagaggacatattctaccacatctgcgcattcatctatcaatcccgcagttttactgacgaaaagcacatcccaaaaatcggatgcagatgatgatacattggaaagaaaaccagtacgtatgaatactagagcttcttttgatagtgacgtatcacaggcgtcgagagattctcaagagacggaagaagatgtttgtttccctatgccaccacaattgcataccagagttaacggtatagatttcgatgaactggaagagtacgctcagtttgcaaacgcggagaagagtcaatttttggcaagtctgcaagtgcccaacgaacagaagtacagtaacgtttctcaggatatcgggtttaccagctctacttccacttcgggatcatcagctgccctaaaatatacaccaagagtttcgcagactggtgaaaagagcgagagtaccaatgaaacagaaatccatgaaaagaaggaagacgagcatgagaaaatcaagcctagtttacaccctggtatatctttcggtaaaaataaagttgaaggggaagagaatgaaaacattccatccaatgacccggcgtattgctcttaccagggtacagactttcaaattcctaatagattttcttttttctgttccgaatctgatgaaaccgttcatgctagtgatatcccttccttagtgtctgagggacaaacattctatgaattattcaggggaggtgagccaacatggtggttagattgtagttgtccaactgatgatgaaatgcgttgcatagcaaaggcgtttggtatccatccattgactgcagaagatatcagaatgcaagaaacacgtgaaaaggtggaacttttcaaatcgtattacttcgtttgtttccatacctttgaaaatgataaagaatcagaggatttcctggaacctattaacgtttacattgttgtctgtaggtcaggtgttttaacattccattttggcccaatatctcattgtgctaatgtcagaaggcgtgtaagacagttacgtgactatgtcaatgtcaattcagattggttatgttatgctttaatcgatgacattactgatagtttcgctcctgtaattcaatctattgaatatgaagcagatgcaatcgaagattctgtgttcatggctcgtgacatggattttgcagcaatgttacaaagaattggtgaaagtaggcgtaagacaatgacgttgatgagacttcttagtggtaaggctgatgttatcaaaatgtttgccaaaagatgccaagatgaagctaatggtattggaccggcactaacatctcaaataaatattgctaacttacaggcaaggcaggataacgccagtcatatcaaaaataatagttcgacaactgtaccaaataattatgcgcccaccacatcacaaccgaggggggatatcgccctatacttgggtgatattcaagatcatttgttgacaatgtttcaaaatttgctggcgtacgaaaaaattttttctagatcccatacaaactacttagctcaactgcaagtggaatcatttaattctaataataaagtgacagaaatgttgggtaaagtcaccatgataggtacaatgctagttccattaaatgttatcactggtcttttcggtatgaatgttaaagttccgggggagaattccagtatcgcgtggtggtttgggatattgggtgtgctgcttttgctggccgtccttggttggttcttggccagctattggattaaaagaatagaccctcctgcaacacttaacgaggccgctgaaagtggagccaaatcggttatttcgagcttcttgccaaaaagaaacaagagattcaatgatcgttccaaaaatataaatgtaagagccggtccttcaaacaaatcagttgcaagtcttcctagtagatatagccgctacgactgattagtgatgtgataaagatagaagatttaagtcacagaggcgtgcatctacgattttggcgtttcacattttttacacttaaattttagtgatctagccgtgaccttggcagcagtttccaaaatcattccatgaccatgtcatgcttaagaacgttagacccagaacaagtggacctgtattctaactcttcactcttgggcaaagataatagtattatcttttaccccattttttgtatgttttttcgtttattgagtttggcgtttcctatttagaaatagtacaatccggtcaatcattcgatagtgaaatatatatatttaactaggaaaattagtaaaacctcatttaaagatcattcaccttgatatatactactattgaccttttgttaatgaccattttcgtaaaaatgaactgcgattctcttctggaatttgttaccctaccttattcactaaatcagaaataataatgtgcagcgcccctttcataaagaaggcaagtatagggcatatagttaaaggtcagaactctttatccccaactacaagatcaattagaaaatcacatcatcatggaggcagatgatcatgttagcttatttcgcttccccttcaagattcccacctttcgtggtataagaaaaggtggggtctatctttcaggtgctctctatgctctaggcttttggatatttctagacgcagtgctctattctagatattccaatgcatcagatgttcatgttacgttcattgactggattccttttctttgcagcacactgggaacattgattgtgaattctattgaaaagaatagattattgcagggagctttatcgtcagatggtggtgccttcggtagtggtgtaggcgatttagattcaagcatggcatggcaagctcgaaccgttttattttttggctttgctttattagctggtgggctatcaggctccattgtcgtgttgatcatcaaatttttagtcaaggattacaatacctatccaactttggggatgggagtaaacaatgtgttggggaatgtatgcatattattgagttgcgttgttttatggatagcccaaaatgttgaagatgaatattcatattctttgacgctctaagttaagttgaccaatattttcgaggccaattaaggcgatctgatttagataaaaaacgtatatatgtatttatcaacactttttcgaaaacaaaaagatttttagataggagtatgtacattccaatatatttgtaatgtttcacataaaaggacagtctgagaaaaaatgcaagtaatgtggtaagaaggaaacataagatgacggcaaatgcaaaaatgaggtaagaatcagcaactaatccagagatggcacaatcaagttgtaatactctccaagagcccttttctccgatgcactaaaattaaagaggtctggtaggtgaaccggcatactcgaacctcttggcaaaaaataggtttcatttcttaacgcgtcaaaaaattcgtgagccatcaattgtctagcatcgcacctttcagtggcatcatacgtcaacacctttagcaagaattccacatcaaaaaattctatagagggaaaccaatgcataaacttcttgaatttttggtcatttaagctatcctgtaactcttgagaattttttatagaacttttaggaaagcggcctaatagtttagctatctcctccagttgtgagttagcgctatcgcctttaaaaagtggctggccttttatcatttcgcctattatacaaccaagcgaccatatatctatttgagttgtataatccttcgaatttaggagaagttcaggtgctctataaaacctcgagcaaaaataggtcttcaattctgtattatcatccagtcgctgtgccgagccaaagtcacacactttagcaataccgctacttggtataatcaatatattgctcggtttcagatcgccatggcatatactcatggaatgtaaggtcagaagtgctcgaagtatttggaatgtgtacagcttgatatgttttgtaggcatcttagaaccattgtcaaaatattcatgaatttcagaacttaaggtttgaggaatgtattccataacaaagtttttctgatataagtgcccaccgtccttggtagtacagtggctctcgaagaagaactctaaagtaaccagatttggatgtctgatattctgtaagatctccaattccaaagattgtactttgggagatttcactactctttttatggcataaggtcctagccattcaatactattgctcgacagaatggactgtgtcacagttccaaacgagccgtggcctatccgtttcccttccctgacgtacattttgctcttttgtctgtttttaatcgatacgatgtcatcgataaagtagtgttcatcctccaattttgtcattctattggggttgctcccgaaaacgttattcactttaagcattaggtatgttagtgctaaaagcaaaatgtatgtagtattttctttttttttgtttgttttttagtgtcctcatcgatgtacgtactgtatcaacacaacgaagaacgacacctctttataaaccctaagcttgctatttgagagcaagagatctttacgtaaacagatagggtcacacagactatacgaaaacctgtcaatataatctattcggataagattatcaacccctccctgcaagattttttattgttattattacagtttttaaactggtagcagagctatccggtaaacatgtactaatcagtctaacaccccggaggaggcttatcattacatattcttgtctcggcgttctttaagtttcttatcttgtatgcccgatatagcaaccttgttggtaccaatctaacggtttccgtactttgcaatgaagagatgaggaggcatgggtcacttatttaatatgtacgggtgtttacatggagttgctttctttttttgtctcagcagtcattgtgcgccaaaaaaagagaaaaccgtgagccgaagtccacgctctggagttaggctctcccattacggagagaagcatttcctcagcctgggagccccgttggaacagtcaggctaaactgggccttcctacccactgcttgctgtttctcactggacgcacaaggggattttctttctaccttcggcttgcctcactgcgttggggcttcccaatgcaacttcgttcgtatgcatacaatcttttagatattatcttttaaaattattttaaaacaattttaaatgtatctcatatgcttttcttctgctgttgaaaaggctaaacaaagaagatcaataagataaaatggctccatctggtatgtgaactgcaatattaatagcacgagaaaattgagaggaagatagatgggaactagtagagttgatattgatgagatacgaaaaccacacgtaaataaactatccgacgacaagaatagtgcattaaggacttgattaagatatggtgagcaacgtaattatcgggctcaacagtttattagcaatcgttttgatagaagcgttgatgctgtggaagttgttctttttactaccaacagccattaacaaatccattagagtgttcgttcgtttttctgctcagattcaagaaaattattccatcctcattatacttttttcttctatttcgtgctccacgtcgaggtatcaaggaacatagtttactaacattaacgaattcatctcctatgaatttactttttgtatagctaaggctactgccgctaagaaagctgtcgttaagggtactaatggtaagaaggctttgaaggtcagaacttctgctaccttcagactaccaaagaccttgaagttggctagagctccaaaatatgcttccaaggctgttccacattacaacagattggactcatacaaggtcattgagcaaccaatcacttctgaaaccgctatgaagaaggttgaagatggtaacattttggttttccaagtttccatgaaagctaacaaataccaaatcaagaaggccgtcaaggaattatacgaagttgacgtattgaaggttaacactttggttagaccaaacggtaccaagaaggcttacgttagattgactgctgactacgatgctttggacattgctaacagaatcggttacatttaatctaattggtttaattaataaatttaatattatttttaaatttttctttaaatatacaataaatctttcataacatgttaaattcatgattaagcgtaaataaagtgtagtggcagagtgcacggggtttcctgtgccttacaaagtaggtaccaatttgcgtattgcagcgagggttccggttactatttataattacgtgttagtgtactgtgattttattgaggctataacaagaaaaggatctgtgaaggttttgagagaatgaggcgaaaacacagggttattttcatcagcaacgccgctgtttcagcggcaccctgcccttttcttttcgcaagatgagagtaaagagttgtacatcaggtaagaatgttattatttaaattcgaagtgataaattcttttcatgatgaatcactcgcttatatggggtagaatatatatatatgtgtgtgtgtgtgtgtgtttgtgtatgtagggatggtgcgcgtttgttgtgtgacatttgctactcattcttttccttttcctacgactggcttaacgggaatattatcaatttgctgcattcttatgcttcggtccgatgctcattaagatgatgcagatctcgatgcaacgaattccaagcccttatcgatatttttctttaactgggagacgcaaattggcaacatttggttgcgttccatgtcgttcatcctattaacgatgtcataatccacataggaaacaccctttgtagtaatagttaatggtatggcaaagtagtctgcaccgtccaccagaggcaataattgatctgccccaggagcaatggggaagttgttcgcatcttttaatggcacatagtaggttccatggatctgctcaatgttacccaataacaaagaaacaaattggacaacacacttataaccggcatgggccatcgataaggtagcactacctttaccgttcttggccttgaccacttcatcaccaccgtattggactctatgtattaaatatttcaattgatcctcatttaatctcgataggaagtttgactgtgaaaacaacggaataatagtctcgccagaatgcccgccaattacagggacgtcaggcatggagttaacacgaggagttagccctgactcaatgtttatctcacgtagaaaagtggacgctctgacaatgtcgagcttggtgacacccatgatccttctttcaatgccggaatttctagactgaggatggttcttaagaatgttagaaaccatcactgggactaaagaattaacagggttggaaatgacaagaacgaagaccttggaaagatcacaacattctgcaatagaatcaccgagctggctaatgataccagcattcacgttaaataagtcatcacgagtcatgccaggttttcttggaacacctgcaggaatgacaacaatagaagcgttatgcaaacagttctcaatgccacctgcaggagagtggctcgacacggaaatgggggtgtctatatgagacaagtcggcggtaacaccgttgatggcttcttggttgacatcgtaaagagccagatgaatgtgggtaacgctccggttgctctcctttaactggtattgcaactgagctttcaaaagcagcgataacgactgcccgataccaccggcagcacctaaaatggcaatttttaacgaatcttgttctatggatggtgtaactgagtgaggcatgttactataacttttatgatattgtattgaacttttgtaatagtctgcagcactatattctggactacttctgactgtacgatttatacagaaggggagaaaatatatacagggaaaaagaatcagaaggagaatcatgcagcaatctttatctcatatcgataaatctttatctttatatatctacgcacgcgcgtgtatattgtttttagaaaccttagataccttccgtagttccttaaagtcaaatcggaccttcccaaccttgggcaacacaaaatgccactaaacaaaggaaaaaaaccggaacttcccggatcattaggggagtattgggggcaaggcacggcggctttagaacggctacggccgaatgggcaaagtaattgcggattaaaggggccgtatcgtagatgatgagtccatttggccggggaaggccgagatgccggcaagtgacatcttttccgtacttcgctatatagatgagaaatttgaaaaaaagtgacaaacggaagatagcgaatgactagctattgtctgtagtaaaaatggacttcaatggtaaaccaagcaaataaagaagaaaaaaaggaagtaagaaagtaggagatacaaacggaaaagtatgaggggattttcttaggtttgggcaagtgttgttgttggtccgccttgggacaggcgccagaagagggctctgggctatataatctcatttttgctttctatgatttctttcacttttttttcttagctcatcgcaggcggttcgagcaatagtgaaaaagaaagaaaaaaagtgaaaacaaaaacctcagtttctccattacgtaaaatgtctatatatacgtgtacgtaggtgctatgaaggcttcgctaagtacagttcaggtttattatttagcgaaggatgttacaagataataatgggcccgctgttaagagggcgaaaccctcagaaaggttgcaatgtgaatatttcatggaaaaaaagaaacgaagatgtgggatgaccaggagttctcagaacttgtattgttcagagcatctgaatttgatgaaaaaggcggctaattctcaagtgcataataagaatggcagtgaagcagagaaagaaagagaaagagtaccttgtccgctggatcctaaccatacggtttgggcagatcaattaaaaaagcatttgaaaaaatgcaataagaccaaactaagccatttaaacgatgataagccatactatgaaccgggctataacggagagaatggactgttatcgtcgtctgttaaaatagatattactgcggaacatttggtacaatctattgaattgctgtataaggtgtttgagggagaatccatggacgagctgcctttgagacaactgaacaataagcttatgtctctaaaacgattccctcaattgccttcgaatactaaacatgctgtacaacagtcttcactgatcgaaaacttagtggacgctggcgcatttgagaggccagaaagtttaaacttcattgagtttggatgtggcagggccgaattctcgcgctatgtcagtctgtaccttttaacacaattgacaagccttccagcggagcactcgggttcaaactcgaacgagttcgtgttgattgacagagcaactaataggatgaagttcgataaaaagataaaagacgatttttcagaaataaagtcaaactcaccttccaaacctattagctgccccagcatcaaaaggataaagatcgacattagggacttgaagatggatccgattttaaaatcgacacctggggacgatatacaatacgtgtgcatctcaaaacacctttgtggtgtagctacagatctaactttgaggtgtataggcaacagctcaattttacatggcgacgataacaacggatgcaaccccaaactaaaggcaatttgtattgccatgtgctgcaggcatgtctgtgactacggcgactatgtcaaccgcagttacgttacatcacttgttgaaaagtatagggcccatggctccatcttgacgtacgaaacctttttccgcgttttaactaaactctgttcatggggtacctgcggaaggaaaccaggtacggctattacagatatagtaaacgttgtcgaatcgtttgaaggggctgagccatatacaataaccattaaagagagagaaaatattggattaatggctaggcgtgtaatcgacgagggcaggttggtatatgtgaaagaaaagtttacagagtttaatgcggagctgataaggtacgtagaatccgatgtttctttagagaacgttgctatgttagtttataagaaatagagagcttttaatttttattttttttcacttgtatttttgacgggctattaattttaaatgaaacttttctacatgatggaacataaacataaatataggtatagataaattgttcttctttttttttttttttctttaagagaaagagtaagtaaatatatcttaaaattacaaagggcttatgcatcatttcagttaaaattattgaagtaccgctccctgaaattatcttttgaacgttttatgccatgattacttgatccattgaaagtgctacccctattaatataaaccagtagtctccttgaccatttattgaattcttgaacgcagttgtattttagctctagattttcgtgcattgggacaatagtttcaatattggcgtcgtttgcagtgggcatccagaaggctaatcttccgccaatcggtaatctttcggaagagtattgtaaaagatcatccagtaatgaatctagagcatacggttttttggttggaatataatcgcgacgcaaatatgccttttcaccgtcaatttccatatcttccttgcctagaaatctttctggatccttagcacctaggacttttatgctttctctgataccatatggaggatcacacaaaatagtatcaatgacaagattgtttcttaatgcgttatttgtaaagtccatggtcaacacgtcgaggaattgagaactctcgccatattttttgaagttggccgaaatgttcacttgagcacccttaccacgaatcattctgccatctatatccgaaccaatcactaaagaaccaaaatgcccaccagctaccaaaaaggatcctgtacctgcaaacgggtcgtacattatagttcccggtttcacttgagctatattggcgctgaccaacgataattctgcttcgaagctagttgtacctttataaggtcttttcttcaaatcatatttctccatggcactcctattgctcatctgaacctgcctaccaaaataaatcctggtgggggtcttaccaccaacgttttccgatattggtgtgtactcttctataacagtgaaaacctcttgaggatgtttcatatcaatctttccttcaaagccaaggtaacggaaagtttcaatctgctctaccctcttagctttactgttgcctttatagcattcgaattcgaacttaaaagtggaatgtttgaatttcaattgcagatcctgttcaaagttagactgacgctgaatatctttatgcagctcatcgagcgttgtaccctgcccccaatactcataaatacctctggttaaaatagacctcttaatccaatcctttgcttgctgatcattttccagctctacaataaagaaagggctattggcatcgtactgcgaaaagtctatggaaagattatataggtctgctaacgattccagttctgctcttctaaagttcaaatgaacttgtaccatatacagcagatatttcttcatgctgccgtttttaccttatatacaatgtgtttagttatgctatttcatctccatattacgggtattaagacctcgatgcccataatcatcgatttttttcacttttcccacaacgtaaacatttcttttttcttcggaaaagaatccaaaatacgggtaataaaagtctcttaaagtactaatagctatagataacattatggaggctattgatatacaaaatactaagaaatataggttgctgcaaggaagaagatcaaaaaccctctaaatttcgctttatctatccatcaaaagtccggagggtcatgctatcgaaaacctattgactataaatatcaatttttttatctcttcgatttgttcttgaagatcttgcgcagaagttgaaaaacaaagagtaaatcctaatgtagatgcgtggaaaaagaaacatgctcttaaggatcccaacttctttctcttctaaacatctataaccttggaagatcttgcgaaatactgggcggctaaatcgaatgcatttttaatcttacccggaaatactttcttttttttatttattttttttcttgcagcccctccctacgagcagcgccgagatttcttgttggacaaagcaaaaaaagtataaaaggcgcatgctttccacacgcccaggcgctcttaaattttcttccgctctctcctttccgccactgtaattaaaaacaaaggattgaacagtttcgactagttatttaattttgcagatagtcaagtattagtacaatatactgttataaattttttacgtgtatcttttactttttagtgtttaataactaaaatctcataccttactagatttctttctaaccttttttgcgaaagaaacaaaaagaaaaaatacggacagaaaaggtatactcaataaacaagaaattgaaaaagcgtgcataatacaaacaattggcccttttttattctgtattaatattactgtttatattacaatcttttcataaaagacgcaaatattttatttataaagaactttagcagtatacacaagtctgagaaaatagagaataagttaaataagcaatgagctctgacgaagaagatttcaacgacatctacggcgatgataagcctaccactactgaagaagtcaaaaaagaagaagaacaaaataaggctggcagtggtacctcgcaattagatcaactagccgcactacaagcattatcttctagcttgaacaaactaaataatccaaatagtaacaacagtagtagtaataatagtaaccaagacacatcttctagtaagcaagatggcactgcgaatgacaaggaaggttccaatgaagacactaagaatgaaaaaaaacaagaaagcgctacatcagcaaatgccaatgccaacgctagttctgcaggaccttctggcttaccttgggaacaacttcaacaaaccatgtcacaattccagcaaccatcttctcaatcaccacctcaacagcaagtaactcaaaccaaagaggaacgttcgaaagcggatttgtctaaagaaagttgcaagatgttcattggtggtctgaattgggacactacggaagataatcttcgcgaatattttggtaagtatggtaccgtcactgatttgaaaatcatgaaagaccctgcaacaggtagatctagagggttcggtttcttatcttttgaaaaaccttctagtgttgatgaagtggtaaagacacaacatatcctcgatggtaaagttatcgacccaaaaagagctatcccaagagacgagcaagataaaaccggtaaaatctttgttggtggtattggtcctgatgtgagaccaaaggaatttgaagaatttttttctcagtggggtacgattatcgatgcgcaactgatgttagataaggataccggtcaatcaagaggttttggttttgtgacgtatgactccgctgacgccgttgacagagtttgtcagaataaattcatcgatttcaaagatcgcaagatcgaaatcaagagagctgagccaagacatatgcaacaaaaatcatcaaacaatggtggtaacaatggtggaaacaacatgaatcgtcgtggcggtaacttcggtaaccaaggcgatttcaaccaaatgtatcaaaaccctatgatgggcggttacaacccaatgatgaatccgcaagcaatgacagattactatcaaaagatgcaagaatattaccaacaaatgcaaaagcaaactggtatggattatactcaaatgtaccaacaacaaatgcagcaaatggcaatgatgatgccagggtttgccatgccacctaatgcaatgactttaaaccaaccacagcaagattcaaatgccactcaaggttccccagcaccttctgattccgataataataaatccaatgacgtccaaactattggtaatacatcaaacactgactctggttcaccgccattgaatttacctaatggtccaaagggcccatcacaatacaatgatgaccacaatagcggttatggctacaaccgtgatcgcggtgatcgtgatcgtaacgatcgtgaccgcgattacaatcaccgtagtggtggaaaccatagaagaaacggccgtggtggtcgcggtggatacaatagacgtaataatggctaccatccatataataggtaaaaaaaaagaaaagtgtagaaaactagagaaaagttttcttgtataattcaacaacccttctattaaataagcataagcaatttataatatatatatacatgtacgtgtattagtttcgaatagttattatttttttttcactatgctagaatgtataatcacaagctctacttgaagtacagctgtcataaagcttacaaataatcttaatgttattgtgcgcaagaatgtaagaggcagacattaactgatatcaccatgagacatgcctaattgaacaatggcataaacgttcagtaaagataagaaaagccacacaattatagcaataacagtgataatccaattgtttgccatataaacgattttgacatcttttccattttctatctccatgccactagaaccatcttgctcgattacgctacctgcagatctatcgttgttattttgatggttatggctatcttcttcagtatggtcgacggtaatttcggttttcatgattgattttttacatgtgaagaaaattaaaggtgctaccaaaaatggcagaactatggataaaacaacttgggaagcatttaaggcctttgataaagcttctctaccgatacagatagagatgaccaaacaagggattatcgaaatacatctagtggccaatcttctttgccatggctgcaacttccaattaatatgaccctcacttacaatttgacccgacatagtacacactacacctgcggattgaccacttaataaaagtgcgagcatgaaaatcgtacctgctgcgggtgccagatttcttgataataattcatgaatagtaaacaaatctgccccatctgcttctggtgagttatatagagtggagcccgcaacaactaggatggcacaattgacgaaaagcgctagggtgaagagagttatgcttaattcgaccatagaatatttcatgcaatatttgatagcagcgttcgtgggtctataattaaaatatttttcttccataatctcttcagtggatttagattttttcactttatcttgttcttcagaaacagtataattaccgtgtttaacgtcataatctaaaagccttggctgcactaaagcggaacccaaaaacaacgaatgtggcataacagtagcacctaagatggaaatagcggtataaataccattgtggtcaaacatttgggcagatggcacaaatcctctgaacacttgtttaacggacgtactcttcgggatataagccaattctattgcgaaacaaatgcacacgccaacaactaatactgcaacaaaacattcaaatattctaatgaacctaattgatgacgcaccaggtttatatgtaaacataatcaaaaacacatccacaacagtaatggccacgcccgctggaaggggcactttgatcaggatattcaaggcaatcgctgtaccaatcacttcagctatatcggtggctataacggcacattctgcaaaaaaatacaatgtccagttgagccaccgtggtaaatactctctgcaagctcgacttagatctagtcccgtaacggaacccaacttgatacacagacattgcaaaaatatggcaataaagtttgataacaaaatgatacaaagtagggaaaattgattagaggcacctgcatcgacggcagtagagtaattaccgggatcgatgtaagccacactaaccatcaatccaggtccaatgaacttcaagtatttagcaaaaatatctctcattacctgccttttagaaacatacgtatcctctctttcatggttactagagctactggtaaaagttcttaccggggcttcaccctcaattaccactgtagaatctttcttatccctcagttcgaatacttcttctgaaatatttcttttgcgggcttcgctagcatccacagcaactgcagcatgagaaggaccaacgttcaccattttgacctaattgagaaagttagtttttctgctgatatatatctttctacctattcatgaaatattaatatgctcgcacaatgatgagcagccaaatattattctatgtatatttatattgcagcatcaaatcaccccggcggagttaacaaatcctaaattagaaaaaactgttgcatttagggacgctagggtccacgtagtacgtcgaaatattttcggcacaggaatgcgaacaggattgattccgatgatttaacatctaagcaagctggtttctggcgcgcattactactacagaagtactctgtactattctaagtttacggctgtcgtttaaacaacgctccttccaagctactggcgttgcggttactatatgcagtaaaaaaaattactggctagccaaataaagaagaaaatcggccaacaaaattgaagaagaaagtagaactgagaagagcgcgttaacaaggctcttcaaaccatgtgacaccaaacttcgcaataggattcccctcctcgttgtagcttttaaactttattattacttgtatgatgataattgtagtagtagtatatatatataaattatagattttatatttattcgtcttcttccaaagtttgagcggcaatacgatccaaatctctttgaccgttttcagagattcttctaccaccctttggagagatttcgacgataccaatcttttccaaagcttgcaaaacctttctgttgatagaaccggaagcgtcaatgtgcttgtatggtctaacacctctgctcttggcaccaccgtataatttgttcaatttaccaacaccaacttgttttctcatgtaaatgtgtctggcaacagaggcagcacgcttgtagaaccaaccttcggcatcttgtggtggcatttcgttaccagaagaggtcttgacaatgtcaacgtaacctggaacttctagcttaccttgtctttgcaagaaagaagcgtaagcattaatgaaatcttgagcagcaacgtctctgtagaaaacaaaatcaaaacaaaaaagttattgttagtaaatgatacagtttaaaaaaaatactttcattaaccattacgtttcatgagaacttatcggaaggaattgaaatcctagtaataacaaagagcaaatagcaccactacccttaatctccctcttcttccatatatttacacattgcactcattcgcgaaatttgatcaatattttgtttcaattattatgggacagttgatatatcattgatttaaccatgggtgctatttaacttgacgaagaagtactttgcttgcgtgtctatgctgctggaatgactgcgttttatttccatctaaccactcgaaacatatagtaataatcattatgatatgtcatttttacgtacctaacggaaacacctggcatttttactctatttgtcgatcgtatcacttcgctttcaagctaaaatattaataaacgcaccggggtattagatatacaacccatagttttcttcatttcacctatatctttccggtatctcaatagggcttttgcaaacaaggccgaacctcacattgaaaaatttcacggcgttctgcaatcccgatcataagaaatgtaaaaaaataaaaggccgccagaacggttttatataaatgtacgggttgaacgaacgtcacatgtgtacggatgtagttgtgtcacggtatcatggttagagacacagtatatgaagattgaaaacggaagaatttattatgaaagttttcaactatggtctagcctattgatggtgtagcaaatattctagtgttaactttgactcactttatgaactaaatgcgttattgatcgccagtaaaaattatgtagtttgaaagaaacgattgaaagtgtatgtagtttatgaattacaaatgagtaacaataaaaaagtaaatatgaaattttcatttcagttaacttacaccttgaaacccttagatcttcttctacctctagctctttcgaactttctaccggtggacaagattcttggagccttacccttgtgtggacccataccgaagtgtctgacagcttctctggagtttcttggacctctcaagatcaaagtgttttgaccctttggagctctgacagctaattgatccaaagtgatacattcaccaccagccttaacaatcttggctctggcaccagcagtgaatctcaaagcagcaacagtggtctttgggaattcaaagattctggcatcgtcagtaacagtaccaacaacgacaacagtcttgttagcagcaccttcttgcttcaaagctctagcaattctagagacagaaacaggtggtctgttgatcttagacaagaacaaagccttcaagacaaccttgttgaatggagcatcagtacgacctaaaaaaaaaaaatgaaaaaatgttagtaactaatggatcgaaggaccggaaaacaatagttttccgtacaaatatttcattaaattagaaaaagattctgctcactggtttgcaataccgcacaaaacgtgatgtaaaagaaacatatcgttcctcaaatatacccgtttgcactcgcagaattttaatacgtctagcttcttctggtatgactattttagccagattcagttcaataaattgaccaataatttgtcacatcagaagcaaagctagatgatcgcgaaaaacattaaccaatatttttcagcaaaccataacgaatatttatagaaaaccaatgaacttaccaaagttcaggataatctattatattcaatgtaacagaatccttctaaccataattggcgttggttaaaacccttgatattattcttgaacatacgagctaagaaagtgtataatttgactaacaatttcaagtagacattgtcagactttggagcagttctgtgaccagatctcttgtgttgcttggaagtgtgatcgatacccattgtgaatccgtaagcttgatgatctcttcttgtgatggatccaaaatggcagaattgatgaatcttcaactcaatttgttttaaattatctcatacaatattccttgaggaaccagaatctcacggcagcaccaagtcagagagagtgcgtgtgttggagcgaaatttccactgtaatctccagcaagaaaaaaatttcattctgaattagaaaaaaaaaaaaatagaattaacacccatgcattattgtcttcggtaaaaaaattcatatccgtacaccacataagatatgtagaaaacagtcttcgaaattatgaattcttggcatgacgctaaatatgtatatatgtatatatgctttagagtttttaaagctagatcgactatatagccacataggtatcaacgaaatacccccccccccccctattggaacgcttctgaacgctgaccttaaaacttacaaagcttcgcaccaacgcaaatatgccttgatattatataacatgccgcacctgccgccattaacgctgaattgaatattataaaatggttataatttgcaactgtacctttaccgattaaggtaccgccgataggtaaaaccggaatcgttaccaacgcttgcaatagatataccgttgcataacgtttaccaaaatcagtagttttagatatctgcccgatgcaaacgggtgtcagtgataggatagaacccgtcgaaaacccccacaaacaaacgtacgcccaaagtacctttgtattaccgccaaatggcagccacatgacaaaattaaataaggcagccattgaaatggtgataatttctacattgaatctcccgatgaacttatccgcaaaatagcctggtatataccttccaagtataccaacagcattcgaagcagtgatcatggtataagcaacattttctgtgtttcctcttgtcatagaataagatgctaaatatgtagcgcatgaagttagggaactttctgcaaaagaagcgcctattgcgacgaacaagaattttccttccaaaaaatatctccaattgaacacagaggaaatgtaccactttgctacttccgccttggatttgaatggttgaacgaccggtttagttctttctctagccaaaactgaagcacaaatgaggcatgttaaacaaatgaatgataggattctaatggcccattgaaagcccacttctttatataactttctcagcataatagggaaaactataccccctattgaaccccccatggtacttatagatgttgctataccccttctttttaaaaaccaggttgcaacagttcctatcagaggagtcattaaaattcccgtcccaagtccagagcacacagaaaatgccaaaatgaactgccatacggacttacaatttgccaatgcgaatagtcctccagcatatatgactgtacctgtgcacatcaaaccaatactaccatttctatcaaaatagccaccggataatatacagcttaaaaagctgatagctaagtatagggaaaaaatccaagatattgttgaagaagatatatttgccaattgatgtttagagatatatgattcaatagcccctaaggagttgattaagccaaaaaccgggaccagtcccataaacgcaccaaatactaccagccatgcttttaacccaccatctgggaactctctgtcatcatcataaatcaaagaggcctctggggtgtttaaaactcttgaggtgacgttcgttaacttattaacgtcaagatctacttgatcgctgttctttttcaaaatcgcgtccgctgcattgaagtttggattatatcctgaacttgggccctcccttgtctccagctccacatcgtgatctctcgtagattgcgcttcgtgatcctttgagaacaggaacctcttggagttagcaattatgggaatgttcaacatcctccgtttgttaagtttatgaaaagctctttcaatatggttacaaataaaacagaatcaatactttcgaggttatttgccgtgtgccaaggaatattttccttctctgaaataggccttttgttatattttagattcgcctgtgactctttgccatctcgcctgttaattaccgctcataggcacggctgactaatttgaagctatcgaaattgctataaaaggaaaactctcttatcatcaagatcaggcggatctcctgagtttctgacctatagagccccaaaaaatgggatgacatgtacatatatagtggtcaacgttaatatgagtggcctcccaatggtacagatgaaagaaaaatttgtttttggctgtacggaattgcttcgtatagaagaaggtcttatctttcatacgtgcttttatgtactggttcttgcatccaatcatccttattagtgttttcgtgcggtcaatatagctcattatggagtcgtttataataaattgactacccgctggaggtttgagttttttctttctaaaagacattcaagatcatacggggggtagacaactcagccgtttccggtagttatagtccatcaagtgttaccataatacgactgtaaaattagccaattcctcgatgtcaaacatccatttatatactgagaaaatcttttatagatgccgcttttactgcgactagaatttcatctatcgcacaatagaacgttttcttctaggttacttgctttagataactaattcctcgaaagcagtgacagtgatcttacactttctggatttcattatgggaatgtcgagtttgagattcgagttttatatgatggcaacaagattgcacaaacttactttcttacctttttcaaatttgatctcttaatacacactaagtatataatgagtataacatttgtgcatgtatgagagtagtggcccatatatgataacactggcgaaagtactctgtagctaaatgccaggttggcacgtttttctcgtttgcccaaagtgcagctccttttcgaagaaatttatctggtcctcgctgaaaaatattataaggggagctggatcaattgttttgtgatctctttgactaaatgaactattgaaacgtttgacgcggtaaaaggcaaaaaggttcactatacacaaaatgtctgatgaagataacaattatgacgacttcatgttatcggatgacgaaggcatggagtcaattgaaatggaggaagaaaccgatgatgaagacaaacaaaacattgaaataaatgaagacaatagtcaggatgatcaagatcgaggagcggcacgacataagcaacatgaacaaggcaccttcgagaaacatgacagagtagaagatatttgtgaaagaatctttgagcaaggccaagctctcaaagaagacgaacgatataaagaggctcgcgatttatttttaaagatatattacaaggaagaattttcatctgacgaaagtatagaaaggctcatgacatggaaatttaaatcacttattgagatattacgtttaagagccctacaactctattttcagaaaaacggtgcacaggatttagttctacaaattttagaagacacggcaactatgtcggtttttttacaaagaatagactttcaaattgatggaaatatatttgaattactttctgatacttttgaggtattggcacccaagtgggaaagagtattcttgttcgacatcgagaaagttgatagggaaaatatgatctgcaaaattgatttccaaaaaaacttcatggatcagtttcaatggattttaagaaagcctggcaaggattgtaaactccaaaatctccagcgtataattagaaaaaagatatttattgccgttgtttggtatcaaaggttaaccatggggaatgtattcaccccggaaatttcttcccaaatagagattcttgtgaaagataatgaatgctcttcttttgaggaaaataatgatttggaaagtgtatctatgttactgcagtattacatattggagtatatgaacactgcacgaataaacaatagaaggttgtttaagaagtgcattgacttttttgaaatgttgatatctaagtcgcttactttctcacaagaatctggactgatggtaatattatatacctctaagattgtattcattttagactctgattcagagaatgatttatcctttgcgctgatgagatattatgatcggaaagaagagctaaaaaatatgttcctctatatcttgaaacacttggaagagatgggaaaacttcgggagagggatattacctctttgtttcacaagttcattcttagcggcttcattttcacgagcatgattctagaagcaattagcacagacaagattaatccttttggtttcgaacaagtgaagattgcgctaggcagccctattgttaacgtattagaagatgtctacaggtgcttcgcacaactggaactaagacagctgaatgcaagtatatctcttattcctgaattgtccgtagtactaagtggaattattcaagatatttactatctggcgcagacattaaagttgtggagaaaaattgcacgattatactcctgtatctccataagtgacattataagtatgctgcaaataagtgatgacaatgaaatgacaagagatgatttgctaacaattttaatgaggtcaataatgaaaaatagatcggttgtgtattttaagttagatttgacaagtgatttagtctatttcggagacgagaataaagtcatgctaccgagatgttctaaagaagaatttcgtcttatgatctctcccaaggatgaagaaaccactgaaaaggccaggctaatagattttgagtacgttaacgatgtcgcgatttataataacccaacaagaataagaaccaaatcctctaaagaatttttcaatacattaagaaaatctagggaaactgtaaaattaccgagggtaagcaaccagtcgaatgaagatacttttctaccatcgtatatgaagttttccaacaagtacctcgagctgtgcaaactggcctctaacaatctggaatagaatgtcgatcaggcacgttcgtgtaaacattacgattttggaattccacttacataagatagcttctttgtaaaagccgttcgaagatttcgtttatagtgatgctttttctggagagatttaagataataaggatatgtggaaggaaatgaaaatgtacacctacaaagcgttgatggtatggaaactatcgaccatagtttgttaaacaggaaatatttgcttgagggtaaagtgttctgattcattatacaaagccccttgcttataagaaaagaaaccaaatcagaaaaggagattatttcaaggtaggcatcgaaatggcaagtaaccagcacataggagcttcaaacctaaatgagaatgaggctatattaaccaaccgcgttgctgagctggaaaggcgtatgtcgatgtttgagggtatatttcacgcgttaagtaaccgtctcgatcttcactttaaaaaatatgatgtagtggtaaactcccaacagcaacaaatcaacgaactgaccgcgtttttatcaacattgctgaatgaccaacaacgccacgctgaaattctcagtgaaaaattaagcggaacgttgcatggggtgtcagctacgtcaatatccttaagccaaactcttgacccacaaggcttcactgatggaactacggcaccaggagctcctaggaattatacttcagtgcctatgaataatgatcaaactgctcatccgcaaaatgaaggagctgttagtaatgaaacactttttgaggacattttgaatggaaattcacaagaaaatgataagagtcaacaacaaactaacagctcaaattctataagccaagaaaataatagcaccaacccttcagtggacactcggttcaacaagccgcaaaattataattccaatttagtcccatccttggaagagtattcagcaaatccacctaacaatgatggtggccaaagtcaaggactgtacataagcagcaactcttctcaatcacggcagtctcctaatctccagaaagtttctcctaaccatgaaaatgcggttgaatcaaatgcacaagagagcgtgccgacatttgaggaggaacagtatgagactaaaacaggattgaaacggaaacgaatagtctgcacaagacccttcgaatttatcaagtcaccacactctgtgatggaggtttggaaggagtatacagaaggtgttaacgggcagccttctataaggaaaatggaagctctttatcaaacggcatggaggcgagatccagcagtaaataaaagatattcgagaagaaaggttctttggaaagccattcaaactggccttaatcgtgggtattcattaaactatgttgttgaaatattagaaaactcaagatatgttaatgataaacagaaggttaaacaacctattggttggttatgccacagttctcatattccagagactttgaagtgacatttgcttcttgtgtattcacctttatcccaaattagcccttgtaacacttatgcttttcttaataaattaataattggactttcctttaaagtgggttgtatctgtaacaataatctctaataatatcctataaaactcagaagtcagccaacaacaattgtatacgtatacatatctatataatatgccttgtactttacgctcttgaatttagaatagctgaacacctaactgaatttaagtaaaggatcccaagcgtgagatatttaggtttactcagttttcttatcttgccttttgattatcacgttgagtgtcgaagaaacctgtattcatcctcggcttcttgtatatgattctaaaataatgtgtgaaaaaaaaaataaaataaaaaaaagaggaaaataatatagaataactattaagtttcattaaaaaaaaaccatttgaatatacgaccaaaaacgttacgctttcataaagtgtgaataagcaagggaactatacttgaaatatgggggcaaagagtgtaacagcctcttcttcaaagaagattaaaaaccggcataatgggaaagtgaaaaagagcaagaaaatcaagaaagtacggaaaccacagaagtctatatccttgaacgacgaaaacgaagtagagattttacctagtcgtaatgagcaagagacaaataaattacctaaagatcacgtcacggcggatggaattcttgtattagaacataaatctgatgatgatgaaggattcgatgtctacgatggacatttcgataaccctactgatattccctcgactactgaagaaagtaaaacgccttcattagcagtgcacggggatgagaaggatcttgctaacaatgatgattttatctctctttctgctagttctgaggatgagcaagccgaacaggaagaggagagggagaaacaagaattagaaattaaaaaagaaaagcaaaaggaaatccttaatactgattatccatggattttaaatcatgatcactccaaacagaaagaaatctcggactggctaacctttgaaatcaaggattttgttgcctatatctcaccaagtcgtgaagaaattgaaattcgtaatcaaaccataagtacaataagagaggctgtcaaacagttatggccagatgctgatttgcacgtgtttggatcatattctaccgatttgtatttgcctggttccgatattgattgcgtggtaacgagcgaacttggtggtaaggaaagtaggaataacttgtattcgttagcaagccatttaaaaaaaaaaaatttggcaacagaggttgaagttgtcgccaaagctcgcgttccaatcatcaagtttgttgagccacattcagggatccacatagatgtttcatttgagagaacaaatggtattgaagcagcaaagcttattagagagtggttggacgatacccccggcctgagagaattagtccttatcgtaaaacaattcctacacgcaagaagactaaataatgtgcataccggtggtcttggtgggtttagtattatatgtcttgtcttttcctttttgcatatgcacccacgtataataactaacgaaatagatccaaaggacaacttgggtgtgctcctgatagagttttttgaactttatgggaaaaattttggttatgatgatgttgcactgggatcatcggatggatatccagtatactttccaaaatcgacatggagtgctattcagcctattaaaaatccattttcattggccattcaagatccaggtgatgaatcaaataacatcagtcgagggtcctttaacattcgagatattaaaaaggcatttgctggtgcttttgatctgttgacgaatagatgttttgaattacattcagcaacttttaaggatcgattggggaaaagtatattgggaaacgtgatcaaatatcgtggaaaggcaagagatttcaaggatgaaagaggtctagtactgaataaggctattattgaaaatgaaaactatcacaagaaacgtagcagaataattcatgatgaagattttgccgaagatacagttacctccacagccaccgctaccacaacagatgatgattatgaaataacgaacccacctgctaagaaggctaaaatagaagaaaaacctgaaagtgaaccggccaagagaaatagtggagagacatatatcactgtctctagcgaagatgatgatgaagatggatataatccttataccctttaatatgtgcctttttgtttaaatgatgcactgaactgtacatcactgtgtacctggatagaatgtgtgtttaaatatgcgtattatgtattaataattgaatttaattttacttctgtttttctttttatcgctgtgaacttttttgtcaagaagtcgctctttgttggctttctcttttattttattccatttctttgaggtctcagcagtggtatcattaggaaattggcacgtttgccgaatttcttgaaccaacttctcgaagcattttaatttgttggtttcccttgacctagtttcatcagattgaattactatagaatcgctgcccttagcgtagtatcgaaacctgccgctacttaagatgtttctcacttcctgaggaatccaagcacagtttgataaaccagaaagtgtcaaagtacatttactatttaccttattaacgttttggcctcctggcccgctggctctatcgtaacgtaaaataaattgatttaagggcaagcccgttacgttaagtgctcctacccagtttcttgcctggacgaagtcagatttctttccgatctttttattactaatcaatctgactgcctcttcaacgaactgttgtttcttgcagtgcaacattggttgaagtacaaacagaggggagcgcccagtaagtttaaactttcccatcaatgttgtcatatgatatttcttggcgtgtttcccttcaatttactgaaaggcaaacagtaatgttaaggattctgttgtttttttttaccgtatacgcttgatttcgtcagccccttggaagacacgaaatgttgactatccgcttccagatctggtaaaagattgatttgcgataattcctgttgttgtcatcacgggtgttatggtttgttgtaaactaaaaaaagaatgaaggaacaggacgcagattcatctaatcaagttctgtggggaggtccccagtggtaagtgaataaatattcgctttatgaagacctacacctggttttctcaatggatcagacgataagtacaatttttgtagagctatactcgaggacaatcagacaaaacgaaagaatatctttcgatgaagggcgtaaaaaaggaaggatggatatcttataaagttgatggattgttttcgttcttatggcaaaagagatacttggtactgaatgattcgtatttagcattttacaaaagtgataagtgcaatgaggaaccagtcttatctgtgcctttgactagtataacaaatgttagcagaatacaattgaaacaaaattgttttgagattcttcgggcaacagatcaaaaagagaacatatcccccataaactcctacttttatgaatcaaattccaaaagatcgatattcatttccacaagaaccgaacgggatttgcatggctggcttgatgccatttttgccaaatgtcctctccttagtggtgtttcatcaccaacaaattttacacacaaagtacacgttgggttcgacccaaaagtgggaaactttgttggagtacctgatagttgggctaaactactacaaacctcagaaattacgtacgacgattggaacagaaactcaaaagctgttattaaagcactgcaattttatgaagattacaatggactggacacaatgcaattcaatgatcacctcaacacaagcttagacttgaaacctttaaaaagtccgacaaggtatattataaacaagaggactaattccatcaagagatcagtaagtaggacgctccgaaaaggcaaaacagattccattttacccgtctatcaatcagaacttaaaccattcccaaggcctagtgatgatgattataagtttaccaacatagaggacaataaagtacgcgaagaaggcagggtgcatgttagtaaagaaagcacggcagattcccagacaaagcagttaggaaagaaggaacagaaagtcattcaaagccatctgcgaaggcatgataataattcaacatttagacctcatcgactagcaccatctgcacctgctacaaaaaatcatgatagtaaaactaaatggcataaggaggatctccttgaacttaagaataatgatgattcgaatgaaataataatgaagatgaaaactgttgcaattgatgtaaacccaagaccgtatttccaactggtagaaaaggctggtcaaggagcaagtggtgcagtatacctgtcaaagcgaataaaattacctcaagaaaatgacccgagattcttgaaatcacattgccaccgagtcgtaggcgaaagagtggccattaagcagatacgtttatctgaacaaccaaagaaacaattgattatgaatgaactcctagtgatgaatgattcgcgccaagaaaatatcgttaatttccttgaagcctatattattgatgacgaagagttatgggtgataatggagtacatggaaggtggctgcttaacagatatattggatgctgtagcaaggagcaataccggtgagcactcatcgccgttaaacgaaaaccaaatggcatatatagtaaaagagacgtgccaaggtttgaagtttttgcataacaagaaaattatccatcgagatatcaaatctgataatatccttctgaattcccaagggttagtgaaaattacagacttcggtttttgtgtggaattaacagaaaaaagaagcaagcgtgccacaatggtaggtactccatattggatggcacctgaaatagtgaatcaaaagggatatgatgaaaaagtcgacgtttggtctctagggataatgcttattgagatgatagaaggtgaaccgccttacctaaatgaggatcctttgaaggcgctgtatctgatagctaacaacggttcaccaaaattgcgtcatccagagtcagtgtccaagcaaaccaaacaattcttagatgcctgtttgcaagtgaatgtcgaatcaagagcatccgtgagaaaactactaacgtttgaatttttgtcaatggcatgcagccctgagcagctcaaagtatccttaaagtggcattgaaatttagcttttttttatttaggagaaacaatatatatatatatgtatatacgtatgtatgattcatattttaatcgcatttttatttcatctaaaacaattactctttttgattatttatagaaaaaaaacaacaatgatacgtttgcttcgcgttatgtcaatagaaaatgtaaaaggaaaaagaatgtgttgctattcgttaggcggatttacggatggaagacatatctatgaactgagcttacaaacgcttttagcggggacagttaatcattttacggatgattttataagaataaactatttttgaaaagttaggatagtattttgtacatttggcaccgaagtaattcaaaatcgaggaagactcgcacacttttacaatcacagaaggcaaaacccggcatgacaggatgataatgtcatcaactatgtcgacagaagccgccttggtaccgaacgaaagtgtttttgacacagtttcgtcattcaacgaagacgatgccaattatagcgttcttgatttatacgatgacgacgatgaaggggatgatagttctacagtagaacgaaaagaaatattgacaacacgtgagcttgaaaaagcaaaggcgtttaccagcttaatcatggcagatcctgagaattttgatagatatggatttagcaagaaaggatatttcattagtcaggaagaatacgacaaatggtggacagaatataatagatacaccgaaagaagaaaaaaaaagtgggagaactttcttcttaagaataagattgagctccacaatgataatcctctagtatatcctgcaaggacagatgaattgtcaaaatttgttagaaaaggtataccagcagaatggagagggaatgcctggtggtattttgctggtggacaacgacaattagacgcaaatgttggcgtttatgatagactgaaaagtgactgtcgcgagggtgccgtatctggtaaagatatggaagctatagaacgggatctttatcgaacgtttcccgataatatacatttccataaggagtccttccaaaatggagagccggcgatcatccgatcattgcgtcgagtattaatggccttttctgtttatgacaagactattggatactgccaatcgatgaattttctcgttggattgctattattgttcatggaagaagagaaagcattttggatgctggttattattaccggtaagtatttacctggcgtgtatgaatcagacttagagggtgcgaacgtggatcaaggggtgttggtgttatgtatcaaggaatatttacccgagatatggtcacacattgagtcatcgtatatgaatggcaatggcagcactgaccagatatcagggccagcatcgggggaagaatatctctgcaggctgcctacgctgacgctgtgtacggcaagttggtttatgagctgttttgtgggcgtggtgcccatcgaaacgaccctgagaatatgggactgtttattctatgaagagtctcattttttatttaaagtggctttggggatactgaaattgagcgaaagcgagtttttggagagtaaaagccagaaactgtttagacagtactcttcgtacaccttcggtggtagtaatgactctgattcaactttcaaaagattaaagaacaagattaagacgcaggaagaggcagatatggagattttgcaagtgattcaaaatttcccaaaaagattgctcaatccgaatgatatctttgagaaagtcctgatgaagaagaaggttgcgttgaatggtattacccaggaaaagattgatcgcggtagagagtatgtggcgatggcgagaaatagacaaagggcgagtagccgcccaaaggaaagaagaaaatagtaagcgcaaccgtgataaaaagcgcaactgtgtaaaataacaagtatgtacgtactaactatactaatcttatttggccagagaccagcctttttgtagacgctccatgacttgcctaaccgcagcctgatcgttctcgaaattgttcttcagaagagcctcgatatcatcccagggcacagtgagttcctgtggaggagcaggagcaggggagttagtggatttctcggcttcgggttccttagatatagtcggattcggcttaatcatgactgtgattgtggaattggcaggcgtgaccttcaaatccgataagaacaggttatcgtggaggactttgcccttcaaaagcagttttatctcgcttatgtgggaggccttttcctcgctgatcaagtgctgttttatttgtaagatagtatctgatgggctgaaatcatgctcgatggagaacttgggagcttgaattttctttaaggttaagtggacggcggcgttgtcttgaccttgctgatcttggtgcagttttaacttcttggcacgattctgcttatatttatacttcaaagtaggcaacgggacacccaaattggtaacatccttcagaggtttagtatagctttttggtagcttcggttcagttaaagtggctaaggtcaagaatttactaacgaactcgtgttctggaccgctggcggatgtgctcatgattaattttgtataaagttattattcttcgctagtttatctctgtatcggtctgttctaacccttttctccaactatgttctcctgtgcatgttttcttcttttcgtttttcctttgttttttttggtcgtagttgtcgcaagctcggcctccggcctgattttaaaactattcctaattcaagattcggtaaaaaagatatataatagctaaggggaggagaggaataagaggaaaaagttacattagaggacaatactcaatctaacccttactagatgtgcgatagccatcaaaaggaagaagataacgcaaatacgagcgaaagggcgttattttttaattaccatgagttttcgtattcattctacgaagacctcggttccgaagacgctaaacccacagagcacgacgaagaccacaaattgtgtattacacatttcccgaatgtgtatgctgctcggggctctgccgagttccaggtgacccgggtggtacgagtgccccggcggttcgatgagtctcgcagcagccttgaaacgccacaatttagtacacagcttcccggtagcgagccggcggcaatcgtgggcgacgatggcactagctttgtgcggtgcgggcgttacgacattggggatcacgtgtttggctgctcctccgtctcgcctctgtcagaatatcttagtgcggcagagctcgcggaggttgtgcaccgggtaaacggattcttgctgcgtgaagaaggtgaggtgttcgggtggcgtaacttaagtggcctgttgctcgatatgcttacgggcggtctgtggagctgggttttggggccccttctttctagacctgtgtttcaggagtctctcgcgttagagcagtacgtggcgcagctaaactcgccgggaggtctgcttcacgagcgcggtgtgcgcctagtattgccccgacggtccgggtgcctatccctagatttcgtcgtgccccgacccaaatagttaaacgtgtggtttatgggtgcaccagggctttatcgtgttttatatcgatggcgatttgtgcctccagtgtatttttgtatatccaattaaggtttcttacctaattttatttttatcatctttagttaatgctggtttgctctgtttctgctgctttctgtgcggttctcctcttctcttgtttcttcgtgttgtcccccatcgccgatgggcttatatggcgtatatatatagagcgagtttttacgtcgaagatcatctcagtttgcttgatagcctttctactttattactttcgtttttaacctcattatactttagttttctttgatcggtttttttctctgtatacttaaaagttcaaatcaaagaaacatacaaaactacgtttatatcaattaataatgtctgaaattcaaaacaaagctgaaactgccgcccaagatgtccaacaaaagttggaagaaaccaaagaatctttgcaaaacaagggccaagaagtaaaggaacaagctgaagcttctatcgacaacctaaaaaatgaagctactccagaagctgaacaggtgaagaaggaagaacaaaacattgctgatggtgtcgaacaaaagaagaccgaagctgccaacaaagttgaagaaactaagaagcaagcttccgccgccgtcagtgagaagaaggaaaccaagaaggaaggcggtttcttgaagaaattgaaccgtaaaattgcttccattttcaactaatcacacttgaatgtgctgcactttactagaagtttctttttctttttttaaaaataaaaaaagaggagaaaaatgctgtttattctgaccttttacataaatttttcttaattgtatctatctaataactaatcaatataataataataatactaataataataataataataataataatagtagtagtagtagtagtagtaataatgatgatgatgatgatgatggatgatcaaaagccacaaaaaagaatgctccgagaataacctcggcggttatttcacgtcccggaggaaaaaaagtttgataagaaagtaaaaatatgagcggtacgagaatcgaacccgtgtccccaccttggaagggtgggatgataaccactacactaaccgcccgggttaattgttattagttggtgaaactgatctcaatcactataacattatggtctcttaatagcaaaggccaaccaactgacttcttgcaaactgatgttcaattttagctctaaaataaaacaatgtaaaagaaagataaaatgacataaagcactatcgcttcaacggcaaacaatattgaaaaagtatcacattatagtaagttgaacactaaaagattaaataaatacttcggcacactttcgatgaaggaaagcattagtagtaacgtatatatatcattgttgttgctacttttctttgtgggatatgcaccactcccctctgcaaagtgaagaaaaggtatgggaagaatttcttcgcttatattacttactttaccctactccttgaatcactgaccactctgtccatcacccagctcccaaattaactccttcggtactaaatcccgaatgtttccattttgttcttgtacgggatcgctgctgctgctgctgccggtttttgcctcatgcttagctatgatttgttttctcagcttttcattcctttcatacaaccaacttaagtaactcaagcttttcaggtatatgattagttctgaccgactttcctggggttgcaggtcaggtactactgctaccagttcgtcaaatatagctctttccaattctctcctttttttttcagacgaaacatgatttatacgtatttgaccatcagtcaatttattaatcttcttagacctgcgtttccttttcttcacattagccagttcaccctttatctccttaatctcggacaatcccggctgtattgtttgtatctccttaatatcgttcgtcattattgcttttctctttttagttcaagccgccctcttaactccttcgtcaagcttatcttgttggcattggaatttcgcaaacgcaatcgcgcctctgtctttaaggtgagaaaaacatgtgaatattttgtttgatacgtaacaagctcatacaaaccaagccaagaaaaagaagacgactaatctatttataacaaagatatttgttcactataatgcaatatagttcgaggttcctagaattgaatatcccggattcatttttaaatatcaataagattcctgatgctactaaatttattacagtcacttatatatgcttaactgcaacccttttctgtataaggagatccttgtacaacaagctagttcttgaagaccctaacttggactacaacttgattacttcgccgcttttgcaaatggtaccttcgcagatttggaggtaccccacctcattagttctatccaacttcatcgacactaaagcttggaaggtggtagtgaacttattgaatttgatcattggtggatccttcattgaacgcaattggaactcttccaaagaaatgttcaaatttatcatagttttaggttctcttacaaacgttctgatcatcatgctgactttgttagtatcttttttctctaataaggtaaggctggatattcccttagacgggaactacacaattttaatcggtttccctatcatttatagacagttattgcctgaaacaactataatccatctgaagacacctcaatttttggccaaaaactttaggttcaaattactacccatttttgtaatgtttacaatgacggtaacccaaataatatggtttcatcattttgctcaattgttctccatttgggttaccttttttgccagttggtcgtacttgaggtttttccagaaacttgcacccttgaattgtccctctttgccaacaactaattctcaaggtggtcaggaaatattggtcggcgatgcatctgatacttttcaattgatttacttctttcctgatctaattaagccgattttgaggccgattttcaatttcatttataatgtagttgttgtaaaatttaaagtcattaaaccttttcatgatattgatatagatattgggaacaccatcgcagaaagtagaggcgccaaaaaaattatgactgtagaagaaagacgaagacagttagctttacaagttttggaagagcgtatggtaaacccttgatatatggatctatataacttgaaatatgctctattatatcgtgatttaatgacggctgttggcatttcggtctttaccaaggtagtaggatttgtatgctgaatgtgcgccagtactatcgaaccatagaaacccatatattccccaatattaataattctactgagaaatgggtgaattttgaaataattgttgggattccatcgttgataaaggctataatattaggtatacagaatgtactagaagttctcctcgatgatataggaatccccataatggaatctatatttctatgtaccaatattacgattattcctcattccatttcatatgtttcattatcctattacattatcgatccttgcatttcagcttcctctaacttcggtgacagcttctataataacttatgtcactatctaacaccgtatatgataatatattgatagtatgactactagttgatagacgatagttggtttttattccaacatctacatagtggcactcactacgctgctaaatttgatcatttggtgaataatttgataattagtagttcttctccgggatataggaatcaacaaaaggaaaacgatagttttacataataatattaatttatcttgcttggttcgcctttgaagagcgcagctttcagagatttagcttctatggccaagttggtaaggcgccacactagtaatgtggagatcatcggttcaaatccgattggaagcatttttttttaatattttaaaattgtttatatttttgtaccacaaacatcattagaagctgcaaatgaagtgaatcagaaaatttaaaaatgaaactaaatactaaatattattgttctttttctaacagttgaagtgccaaaagcagtaaattgtttaaatattagggtataaaacatgatattataaagttaatgatttagaatggctccgtccagcagaaccagttgattaccattaatgttgagagtttatgcgagtttttcaggctcgattatgagatacggtactagataattcaggattatcaggattatcagggtttaccacttgcaatggtccgctcatcatcatgtcgggtaaagaattggcactgaacctttcatttgcactattcaaagtatttgcctcttcaaaaactgtcgatggaaggttctgtttctgaaccgtagcatcttgtaagccagccaagttgtttatgatgcttccactggtgtttgaactaggactactataatttgcaccattactcatagaaaaaccatacatattacttgtaccgatagaacccgctgtattaccccttgaatgtctcatccaatttgtcgtaccagaggagggaggcggtcctattggatttgcatcctcatcaccgaacgaatagggctgataatgtttcgtttcctccaagtctaattggtcgtgcgatttccgtctcctccatatcaggaacaatagaatcaaaataataaaaattacgccaaacacaacaccaataacaataccggcaatggctccaccactcagacgctgcttcgaagtcgaattagatctattatttgaggcggcagcagtagcagtagctacctcagaagatcgttcaaccacggatgtcctcgtaacaaatattgtttcctgatgttgatcagaagtactcacgatcgcttttgtaaccacactagtcactagttccactgaggtaactattggtatcgttgatgacgtactaggggtcattgaggtcacttttggagttgatagtgtgctgctactcgaggacactggcaccaaggtggaagagggtgaagaagtacggctatcgactgtggtatgctcagatgaggacaatgtaatggatgaggagctagacgtaacagaaaagatagaggtagtagaggaggtagtagaggaggtagtagaagaggtagtagaagaggtggtagaagaggtggtagaagaggtggtagaagaggtggtagaagaggtagtagaggaagtcgaggaagaggtagtagaagaggtggtagaagaggtggtagaagaggtggtagaagaggtagtagaggaagtcgaggaagaggttgttgaagtggtagaaactgtcgtggctatcatttcagaacttttcatatctgttgacgttctcctagtagttgaagaaatttgggcggaggacaatgaagaagttgttgagggcatataggaagtgctagacccttctttggaagaggaagattcaaccgatgaaacaaaagtttcagcatttacatacacgttcatgtacgatgaccctccacacatttggtaaggccagccagagcatttagttccacagtttgaatctgttgatttcgtcaaagaagtcagaaaacttaccgaattaccgcagtaacaatctgacccgttaaataatgctactactgctgactcagggcactggttttgacagtatgacactgattgatatatgtatgagtttttcagagacagtccagcagactggatatccgcggcactgtaacagccttcataattaaaatcagcattaaccagcccaatcagagattgacatagcaaacttagaagtataaatgagatatacccgattttaatagttcctttatttgttaattttgcaaaccatactctttccattttatattgtcttctgctaaaaaaacaaactatacggacatgaatttcatataatgcacaaagaaaatagctcaccaaatatttctcgaggattatcactaatttcgaggaacaatagaaaattagtatggcgagggatcaaaaaattttttatagcaaatgtttggaaagaaaaaaatgtataacgaatgcaattgttttattgaagtgtaagaaaaatcaatatctaacctagatactatttcaggcaatgaagtaaaacaatggtcctggtctgcagtataccacttacgttaaaaagctttttaagattagtgcggaggcataattactttttttataataaagaaaaaaattctcgagtggctaaaataagaagtttgcccggatctcaaaggagagcgggatgacgtaaaaattcctgattttggaaaaatgcattcctactaacgaatcggctggtaaaattaggttaaaaatctcctagtgaaagggcaaacagaaaaaaatcttcacattaagcaagatttaaagtaaacagcaaagaaaagttttttttggttcagatgtaatatggatagcccgttttaacaattcagaatctcatctgtaaagcattgtaatatcgctgaaaaagtgaaaaacattagtttcttgactgcttcatcatttgaatggtcttccaataccaagagatgtgctggcctgacaaaggatttcaccctctcacttgtaatttcatctgccatctgcacaataccatttgtaaaaattaaaataccgttttgacaatctagccataaaccaaaattcagtttatattttctgggttttctgaaaacgtccaagagactcaaagcatttttattaagtaaaattgttgtgaattcatcaatcgaacaactgtatgaaggttggaatgtaaagtacctttgtgttaattttattacgagttccctgagaacattcggaatgttctgatggaccgtggcatttggctgagttaattcagaccattgttgccatttcaccaacaggtcatgtaaaataagctcattaaacgactcaatgagttttgaccagttagcgtaaactttggtgaaatctttttctgggccaaattttgttaaaacggtttcaaagcgattaacatattcctgaattagcttgtaggttttggagttggatttgtcaaaggaacaaattctaggtataatacacatctttagtaattgacttctatggcgggatactccagaattgacgacattaaccaaggtggtatcactatcgttccgatcttccccttccttttgcctgctgagttggaaatagtgtgaaaaatccttctgaaccaaagaactcaattgacaatctttaaatatttgcagtgggtagtaacgttttgtagaatcctgcaaattcgtaacgagatcgacttgattcaaacaatataacacaaacacgtagttcttatgacctctaaacatcggcgggcaaacattcgacgcaactccttctagtggcaagaaattaagttcctcttgcagagtatgcaactttgagtcatggaattcagtacaatttccagaggatgatgctacaggctgcagcaaaatacttgctaacctattatccttactcattatagtttttctacctgtatttttatcctaagttgtatatggtatagttcatgacaatatttttgatatatctgtcaaaatagccgcccaacttctacgcccggtacgtcactgagtacgaaacggatatatatcttccatttgtaactattactctcaactacaaaacaaaacgtggttgctagtcttagtgattttatttaccacatggattactttaattcgcatacttttccatccactccttctgttggaataaaaatccactatcgtctatcaactaatagttatattatcaatatattatcatatacggtgttaagatgatgacataagttatgagaagctgtcatcgatgttagaggaagctgaaacgcaaggattgataatgtaataggatcaatgaatataaacatataaaacggaatgaggaataatcgtaatattagtatgtagaaatatagattccattttgaggattcctatatcctcgaggagaacttctagtatattctgtatacctaatattatagcctttatcaacaatggaatcccaacaattatctaattacccacaaatttctcatggtagcgcctgtgcttcggttacttctaaggaagtccacacaaatcaagatccgttagacgtttcagcttccaaaacagaagaatgtgagaaggcttccactaaggctaactctcaacagacaacaacacctgcttcatcagctgttccagagaacccccatcatgcctctcctcaacctgcttcagtaccacctccacagaatgggccgtacccacagcagtgcatgatgacccaaaaccaagccaatccatctggttggtcattttacggacacccatctatgattccgtatacaccttatcaaatgtcgcctatgtactttccacctgggccacaatcacagtttccgcagtatccatcatcagttggaacgcctctgagcactccatcacctgagtcaggtaatacatttactgattcatcctcagcggactctgatatgacatccactaaaaaatatgtcagaccaccaccaatgttaacctcacctaatgactttccaaattgggttaaaacatacatcaaatttttacaaaactcgaatctcggtggtattattccgacagtaaacggaaaacccgtacgtcagatcactgatgatgaactcaccttcttgtataacacttttcaaatatttgctccctctcaattcctacctacctgggtcaaagacatcctatccgttgattatacggatatcatgaaaattctttccaaaagtattgaaaaaatgcaatctgatacccaagaggcaaacgacattgtgaccctggcaaatttgcaatataatggcagtacacctgcagatgcatttgaaacaaaagtcacaaacattatcaacagactgaacaataatggcattcatatcaataacaaggtcgcatgccaattaattatgagaggtctatctggcgaatataaatttttacgctacacacgtcatcgacatctaaatatgacagtcgctgaactgttcttagatatccatgctatttatgaagaacaacagggatcgagaaacagcaaacctaattacaggagaaatctgagtgatgagaagaatgattctcgcagctatacgaatacaaccaaacccaaagttatagctcggaatcctcaaaaaacaaataattcgaaatcgaaaacagccagggctcacaatgtatccacatctaataactctcccagcacggacaacgattccatcagtaaatcaactactgaaccgattcaattgaacaataagcacgaccttcaccttaggccaggaacttactgaatctacggtaaatcacactaatcattctgatgatgaactccctggacacctccttctcgattcaggagcatcacgaacccttataagatctgctcatcacatacactcagcatcatctaatcctgacataaacgtagttgatgctcaaaaaagaaatataccaattaacgctattggtgacctacaatttcacttccaggacaacaccaaaacatcaataaaggtattgcacactcctaacatagcctatgacttactcagtttgaatgaattggctgcagtagatatcacagcatgctttaccaaaaacgtcttagaacgatctgacggcactgtacttgcacctatcgtaaaatatggagacttttactgggtatctaaaaagtacttgcttccatcaaatatctccgtacccaccatcaataatgtccatacaagtgaaagtacacgcaaatatccttatcctttcattcatcgaatgcttgcacatgccaatgcacagacaattcgatactcacttaaaaataacaccatcacgtattttaacgaatcagatgtcgactggtctagtgctattgactatcaatgtcctgattgtttaatcggcaaaagcaccaaacacagacatatcaaaggttcacgactaaaataccaaaattcatacgaaccctttcaatacctacatactgacatatttggtccagttcacaacctaccaaaaagtgcaccatcctatttcatctcatttactgatgagacaacaaaattccgttgggtttatccattacacgaccgtcgcgaggactctatcctcgatgtttttactacgatactagcttttattaagaaccagtttcaggccagtgtcttggttatacaaatggaccgtggttctgagtatactaacagaactctccataaattccttgaaaaaaatggtataactccatgctatacaaccacagcggattcccgagcacatggagtcgctgaacggctcaaccgtaccttattagatgactgccgtactcaactgcaatgtagtggtttaccgaaccatttatggttctctgcaatcgaattttctactattgtgagaaattcactagcttcacctaaaagcaaaaaatctgcaagacaacatgctggcttggcaggacttgatatcagtactttgttacctttcggtcaacctgttatcgtcaatgatcacaaccctaactccaaaatacatcctcgtggcatcccaggctacgctctacatccgtctcgaaactcttatggatatatcatctatcttccatccttaaagaagacagtagatacaactaactatgttattcttcagggcaaggaatccagattagatcaattcaattacgacgcactcactttcgatgaagacttaaaccgtttaactgcttcatatcaatcgttcattgcgtcaaatgagatccaacaatccgatgatcttaacatagaatctgaccatgacttccaatctgacatcgaactacatcctgagcaaccgagaaatgtcctttcaaaagctgtgagtccaaccgattccacacctccgtcaactcatactgaagattcgaaacgtgtttctaaaaccaatattcgcgcacccagagaagttgaccccaacatatctgaatctaatattcttccatcaaagaagagatctagcaccccccaaatttccaatatcgagagtaccggttcgggtggtatgcataaattaaatgttcctttacttgctcccatgtcccaatctaacacacatgagtcgtcgcacgccagtaaatctaaagatttcagacactcagactcgtacagtgaaaatgagactaatcatacaaacgtaccaatatccagtacgggtggtaccaacaacaaaactgttccgcagataagtgaccaagagactgagaaaaggattatacaccgttcaccttcaatcgatgcttctccaccggaaaataattcatcgcacaatattgttcctatcaaaacgccaactactgtttctgaacagaataccgaggaatctatcatcgctgatctcccactccctgatctacctccagaatctcctaccgaattccctgacccatttaaagaactcccaccgataaattctcatcaaactaattccagtttgggtggtattggtgactctaatgcctatactactatcaacagtaagaaaagatcattagaagataatgaaactgaaattaaggtatcacgagacacatggaatactaagaatatgcgtagtttagaacctccgagatcgaagaaacgaattcacctgattgcagctgtaaaagcagtaaaatcaatcaaaccaatacggacaaccttacgatacgatgaggcaatcacctataataaagatattaaagaaaaagaaaaatatatcgaggcataccacaaagaagtcaatcaactgttgaagatgaaaacttgggacactgacgaatattatgacagaaaagaaatagaccctaaaagagtaataaactcaatgtttatcttcaacaagaaacgtgacggtactcataaagctagatttgttgcaagaggtgatattcagcatcctgacacttacgactcaggcatgcaatccaataccgtacatcactatgcattaatgacatccctgtcacttgcattagacaataactactatattacacaattagacatatcttcggcatatttgtatgcagacatcaaagaagaattatacataagacctccaccacatttaggaatgaatgataagttgatacgtttgaagaaatcactttatggattgaaacaaagtggagcgaactggtacgaaactatcaaatcatacctgataaaacagtgtggtatggaagaagttcgtggatggtcatgcgtatttaagaatagtcaagtaacaatatgtttatttgttgacgacatgattttattcagcaaagacttaaatgcaaataagaaaatcataacaacactcaagaaacaatacgatacaaagataataaatctgggtgaaagtgataacgaaattcagtacgacatacttggcttagaaatcaaatatcaaagaggtaaatacatgaaattaggtatggaaaactcattaactgagaaaatacccaaattaaacgtacctttgaatccaaaaggaagaaaacttagcgctccaggtcaaccaggtctttatatagaccaggatgaactagaaatagatgaagatgaatacaaagagaaggtacatgaaatgcaaaagttgattggtctagcttcatatgttggatataaatttagatttgacttactatactacatcaacacacttgctcaacatatactattcccctctaggcaagttttagacatgacatatgagttgatacaattcatgtgggacactagagataaacaactgatatggcacaaaaacaaacctaccgagccagataataaactagtcgcaataagtgatgcttcgtatggcaaccaaccgtattataaatcacaaattggcaacatatatttacttaatggaaaggtaattggaggaaagtccaccaaggcttcattaacatgtacttcaactacggaagcagaaatacacgcgataagtgaatctgtcccattattaaataatctaagttacctgatacaagaacttaacaagaaaccaattattaaaggcttacttactgatagtagatcaacgatcagtataattaagtctacaaatgaagagaaatttagaaacagattttttggcacaaaggcaatgagacttagagatgaagtatcaggtaataatttatacgtatactacatcgagaccaagaagaacattgctgatgtgatgacaaaacctcttccgataaaaacattcaaactattaacaaacaaatggattcattagatctattacattatgggtggtatgttggaataaaaatccactatcgtctatcaactaatagttatattatcaatatattatcatatacggtgttaagatgatgacataagttatgagaagctgtcatcgatgttagaggaagctgaaacgcaaggattgataatgtaataggatcaatgaatataaacatataaaacggaatgaggaataatcgtaatattagtatgtagaaatatagattccattttgaggattcctatatcctcgaggagaacttctagtatattctgtatacctaatattatagcctttatcaacaatggaatcccaacaattatctcaacattcacccatttctcaccttcagctcaaatcctcatcccggaaccttttttcttatttgttccctcttctactacaagagctttcaaattgtagtcaaaaacccgctttactaaaaaaacatcgccaaaaaaatttccaaaatcgctcgtcttgccactaaaagtatgcaaaatattatgtgaagcaaagttatttcgtgtcttccgcctaacagaacgtaagcagttgaccatactttagtatagagtacgaaaaaacacaaagaataccttaataaaataaacattgtcgttcgctaggaaaacggtaacgaaaacaaaaaactaaaagaagaaaagaggcaggacgcagtaaaagcaagaaaactgcttttttttcatggctgaaatgaagaattcgacagctgctagttccagatggacgaagagtcgtctctcccatttctttccctcgtacactaatagcagtggtatgggggccgcctcaactgatcaatcttctacgcagggagaagaactgcaccataggaagcactgtgaagaagacaatgatggtcaaaaaccgaaaaagtctcccgtatccacctctacaatgcaaataaaatctagacaggatgaggacgaggatgacggtcgaattgtcattaaaccagttaacgatgaagatgatacatcagtgattataactttcaatcagtcaatatccccttttattattacattgacattcgttgcgtccatttctgggttcatgtttggttatgatactggttacatatcgagtgcgctaatttctatcaatagagatttagacaacaaagttttaacttatggagaaaaagaattaattacggccgccacatcattgggcgctttgattacaagtgtgggcgctggtactgctgctgatgtgtttggaagaagaccatgtttaatgttctccaatctgatgtttttgatcggagcaattttacaaattaccgcgcacaagttttggcaaatggcggccggtagactgattatgggtttcggtgtcggtattggttctttgatttctcctctttttattagtgaaattgctcctaagatgatcaggggtaggttaaccgttataaattccctatggctgacaggtggtcaattgattgcttacggttgtggtgcgggcctgaaccacgtcaaaaacggttggagaatcttagttggtttgtccttgatacctactgttttgcagttttcttttttctgttttttgccggatacaccaagatactacgtaatgaaaggcgatttaaagagagcaaaaatggttctcaaacgaagttacgtaaacactgaagatgaaataattgatcaaaaagttgaagaattatctagcttaaatcaatcgataccaggaaaaaatccaataacaaaattctggaatatggtcaaggaattgcacactgtgccttcaaatttcagagctttgattattggttgtggtctacaagccattcaacaattcacaggttggaattccttaatgtatttctccggtacaatatttgaaactgttggattcaaaaattcttctgccgtttctattattgtctcaggtactaattttgtgttcacattaatagcatttttctgtattgataaaatcggccgtaggtacattttactgattggactacctggtatgactgtggcgctggttatatgtgctatagcgttccatttcctaggtattaagtttaacggtgctgatgcagtagtggcatctgatggattttcatcttggggcattgtcattatcgtatttattattgtgtatgcagccttttatgccctcggtatcggcactgttccatggcaacaatcggaattatttccacaaaacgtcagaggtgtagggacatcctacgctactgccaccaattgggcaggttctttagtcattgcgtctacgttcttgactatgttacaaaatattacaccaacgggtacattttcattctttgccggtgtagcatgtttatcaaccattttttgttacttttgttatccagaactatcaggattggagttagaggaagttcaaacaattttaaaggacggattcaatatcaaagcctctaaagctctagctaaaaagaggaaacaacaggtggccgaaggtgctgcccatcataaactcaaattcgaacctacacaggaaattgtagaaagttagactgctacaccaacaaaaaataaaagataaagaacaaaaaagaaggaagaaagctataaaagggagacaattcatttcatctaatcttaaaagtttttatttaaatatataagtaagagcgaagtatttaaaaataaaaattcataaaagttgagcttgatgaaagttatatcttttcgagcggtatgtttctttcgtgtaaaattcttcttaaagtatctaacttctcctcatctttcaagtttcctttaactacaactttttggatcaattcaacgggaatactgctgcttaagtaaacattattgagcgacctgaacattttcaaagtttgaaagaataatggagaatggcagtcgatgaaaatatagacgttacttgaagaacgcattccactaataactcccttcgcgtgcaacatccccggcgataaatggacatgatttctactcattggtgatattgctccggattcaataatctttatgacagattgaagatttgttccatgaattagttcctgtggtaactgcgacgcttcagtaattggtacgagaacctcatctgatggctgaatcgatttgattgaatgtccctgagtagcacagatccattcttcgtccgctcctaacgtttttatatgaaagcgttgtttgtcattttccttaacaatgcgatggatatcatccaccgtacatttatgagttttcaatctattatgagacaatagttctttcagcggtgtataaccgtttgagtcaatagtcaacttttctttcaccgctgtatgtcgaagcagatatgataaagctttggaaagctgtacatcccttttatctttttgtagtacctggcgcattgtcaagtccacctttcccagtcattctgctcaattctgtaataatgtattatgcattttgccattattttgatgagctttcctcgcgtcacggtgtcagtaaaaaagaacaaatacatcacgaagacagaaatacggacaagaaccgcagaagacattaaagtcaaaacatgaagcttaattcaactcgtgtaagtatctttaaaggagatacacttcccattcttgaattatttttttatttaatttgccttatttattcaattatttattatgtgagcaccagctgagtctaagacttgaaattaattaattcgggctgattcaaacttgaatgcatcaaaatataagattgaatcaaaatgaaaaaatggtaaaaagccgtaccagaaatcaagagatggaaaaggtactcggaatgattccaaccttcttcctttttatttcgtctgaacaatgattcagggaacctggtaacgtaaattatagatgccgctaccaaagccacaagttcccacgtaattgcgttcacttttatcctctctttcaggttttctaaaccatcaaaggtgattattgcggttaatagtggcaaggaacaacacactactgataccgaaatgaagaaaactgttttattgaatcttttcgaggaaatgagtttgtccgtcaatataaaaaagtatgccactaatcctatgaagttcattaaaagggtaaaaattttgaagaaaaacacgtaatcatagaatagataataaagaattgtgatttgtgatgatatcaataagttgatattcgataaatacgaaaacttctgccaatgttcgagatgttgttgtagagaaatatttttgacgaagtgataaatgaaatgcaccatacaaaatacaaaaacgttcaataaataaaaattgaatacaatgtagtctgtcattgtagtggtggtggggaacaaaggtatcaaataaaagtccgtgaaaaatattaggagacaaaatgacagcatcgaacccaagagatatattagtgctactagtgactcgttcctactggatttatttttgtactgtttctgcaattttgccaagtcatggaatggaaaacccttctttgtttcttttgtctctgcattctcgttcgaatctgtccccctagtatcattgctctctttctcagtggttgtctcgcatttgactgggctttgctctattgtagtcaatgaaaccatactgtcaatatatatgtacctttataccaatattatatgcgctgacaagaactttaagaaattaatttccttttctactttttttcatttttattttacttctgcgtccatatatccggaccatatatatgagtgtaaatcatttagctgttgacaccattgagtatttacaattaaaaccaattgagctcaacaggcttgcgttgaataatgttgagctgcccaacgagcccttttctcgcggagtgctgtccgaattgtccgagtttttatacggacagaactatcgcttctttgaagtatatataagaatagaccggctgttcaccccgtatcctccttttctatctcttggcttgctatgtttcaatgtcagcctttgcttttatgtgcccttgcatacacgtgaatatgtctattttatgtaaactataacagctggtactgcccgtacatatgcttaaattaaatagctattgacgaaggcccattttctcgtagaatatcagggtaacatatggaataatcatttttctctgtctataagtagtaagactattgcttctgatccttctgtcaatcgcctgtctccagttttatttcttgtcacctagagaaacatacgctggagttccctgtactatcaaaagttgtttcggtcccgccatttccgactagctctatagctaatggttgagactcaaatagttctgtagcaatggaagctgatgtaccccaaatacgaaaagtctaaggctcaaaaatatatggtgggcccatatatgcctagaataaggtatgaaacatgacagatggttaacgatcgactcgacacattgttgatggaataattggtccctagttaaacagcggagaaatagccgcccaggataatcggagaaaagtcacgtgcaaaaagaaatcatattcgacgaaataaactagaataacttttgacgtttagcaataataaccccaaatggaagcgaacatttcccgatccttttagttttctttaaggcgctattggcattcatcttcaaagcttccgcaacacagaaattatatattcacatttctgaggcagagaatagttttgacaacgaaactgttaatatttttactccagttaccgcctttgaagtctgatattggtgtacaaaggtacttaggggtatttaagaacaagaaactacataaaatagttcgaaaagggaaaacaaaagtaacatcttgatgaaccgagaagccactaactagtttttaaaaagcaaaagaaattaaatctctccttttttttttttcatttcaaccaaatgtattttgataaggataattccatgagccctaggccgttattgccaagtgatgagcagaagctaaacattaatcttctaacgaaaaaggagaaattctcgcatttagacccccattatgacgcaaaagccactccacaaagaagcacttcgaatagaaacgttggcgatttacttttggaaaaaagaaccgctaagcctatgattcaaaaggccttgacgaatacggataatttcattgaaatgtaccataatcagcagagaaaaaatcttgatgatgacactattaaagaagtaatgattaatgatgaaaacggaaaaactgtcgctagtaccaacgacggcagatatgacaacgattacgataataacgatattaatgaccaaaaaactttggataatatagcgggaagtccccacatggaaaaaaatcgaaacaaagtaaagattgaacatgactcttcatctcaaaaaccaatagctaaagagtcatccaaagcccaaaaaaatataatcaaaaagggaatcaaggactttaaatttggtagtgtaataggtgatggcgcgtattctactgtaatgttagcgacgtcgattgataccaaaaagaggtacgccgcaaaagtactaaacaaagaatatttaatacgccagaagaaagtcaaatacgtcagcatagaaaaaaccgcccttcaaaagctcaataattctcctagtgttgtgcgattattttccacttttcaggatgaatcaagcctatactttctcttagagtatgcccccaatggggactttctttctttaatgaaaaaatacggttcattagacgaaacctgcgcacgatattatgctgcgcaaataatagatgccatagactacttacattccaacggtattattcatagagatataaaaccagaaaatattcttttagatggagaaatgaagatcaaactgactgattttggtactgcgaagttactgaatcctacaaataatagcgtttcgaaaccagaatacgatttatcaacaaggtcgaaatctttcgttggaactgcagaatacgtatctccagaacttttaaatgacagttttacagactatcgttgcgatatttgggccttcggatgtatacttttccagatgattgccggaaaaccaccattcaaagctaccaatgaatacttgactttccaaaaggtaatgaaagttcagtacgcctttacaccaggtttcccacttattatcagagatttggttaagaaaatcttagtaaaaaacttagaccgaagattgacgataagccaaattaaggaacatcattttttcaaagatttgaattttaaagacggctctgtttggtcaaaaacgcctccagagatcaaaccatataaaatcaacgccaaatccatgcaggcaatgccaagcggaagcgatagaaaactggtgaagaaatcagtcaacacacttggcaaatcgcatctagtgactcaaaggtcagcttcaagtccctctgttgaggaaactactcattcaaccctatacaataacaatactcacgcttctactgaaagtgaaatatcaataaagaagagacccactgatgaaagaacagcgcagatacttgaaaatgcaagaaagggtataaacaataggaaaaatcaaccaggcaagagaacaccaagtggtgcagcttctgctgccctagcagcttctgctgctttaaccaagaaaaccatgcaaagctatccaacttctagttcgaaaagtagcaggtcaagctctcctgcgacaacatcaagaccaggaacttataagcgtacttcttctacagaaagtaaaccatttgccaaatctccacctttgtcagcatcagttttatcgtcaaaagtcccaatgcctccatacacacctccaatgtcgccccctatgacaccatatgatacatatcaaatgacacctccctatacgacaaaacagcaggattattctgataccgcaattgccgcacctaagccttgtattagtaagcaaaatgttaaaaatagcacagattctcccttgatgaacaagcaagatattcaatggtccttttacctgaaaaacatcaacgaacatgtactaaggacggaaaaactggattttgttaccacaaattacgatatcttagagaagaaaatgcttaaactaaatggttcattgttagatcctcaactgtttggtaagcctagacatacttttttatcccaagtagctaggagtgggggagaggttacaggttttcgaaatgatccaactatgactgcttattccaaaacagaagatacgtactattcgaaaaatattatcgatttgcagctcttggaagatgattatcgaattgaaggaggtgacttatcggagttgcttactaacagaagcggagaagggtacaaatgcaatcaaaacagctcaccaatgaaagacgatgataaatccgaatctaacaataaaggaagctctgttttttctggcaagattaaaaaattatttcaccctacctcagcagctgaaacgctctcttcctctgatgaaaaaaccaagtactataaacgaaccattgtaatgacatcatttggaaggtttctagtatttgccaagaggaggcagccaaatccagttacaaatttaaagtatgaactagaatatgacataaatttgcgtcaacagggtaccaaaataaaagaactaatcattcccttggaaatgggaactaatcatatagttgtgattcagacaccttacaagtcatttcttttgagcactgataaaaaaaccacgagcaaattgtttactgttctcaaaaaaattcttaattcgaatacaaataaaatagagaaagaactgttgcaaagaaaccaaaaggtaattgaaagaagaacatcatcatccggaagagccatacctaaagatcttccaacttccaagtctccttcgccaaaacccaggacgcatagccaatctccatcaatttcaaagcacaattcgttttctgaatcgattaatagcgctaagagcaacagatcaagcagaatttttgaaacctttatcaatgccaaggaacaaaattcaaaaaaacacgctgctccagtaccgttaaccagtaaattagttaacggattgccaaaaagacaagttaccgtgggattaggtctaaacacaggaacaaatttcaaaaactcatctgcaaaatcgaagaggtcgtaattagtaattttatctaatgttttcatcaagctacttaaatactctaaaaataaatatatgaggaatttcaagtactcatataaatataataataattctcgatcaatcaaatgaaagagcgccgtaaggcagaatcccagaattcgaaaagaatgagacaatgctccttttgctatttattgaatgcagataatacgcactgtttctgtgttgaaagtgaagctgaaatggaggtcatgtactcacgcattttcgtcttcttcactatcaatttcgtcatcgtcatcttctagctcttctatttcgacagtgaaaccttgagtttcaaagaattcttgaactgattccaatttagctggatgacagctcacaaaggcaacgcttttattggaatcaaacatgttgacaaaatatttctgcatggcatttttcagatctgttttggtaacattctgcaacctttccaaatacaattcattgaagttgttccccctttgcaaacagaattcatcaacatatttggacagggctgtttcaaagtatccgcattcgatagtagccagcctgttaataatactactgatggcaccttggattaactgctcatcaaattccaaggcacctgatgcataatcttgaacaatctgttttccaacttcataacatttaataatatcagcgccgcggtaaatattgaatccccaagaatttatctcacataattttaacatgctggcaccataggccaatccggcaccacggattcccttccaaaatggaccttcaacacattctagatattcggaagccaatgagacaatagcgtattcgggatcatggtagtccaagttaaatgggatagacgttattagattcatataagcagattctgaggcgggagtagttattataaaggccttttcaccaggtgttctgcaaatcgatgaaatggtatctagggctcttggaactggtggaatttttaacttctcaactggatgtgcaatgttcaagcacttaattaagggattccatggttcataaacgtcatcgatctttgagatgtcaccaagaaccaaaatatgaaacttgttgaaatttgctctcagttgctttctcattgtttctattcttggcaaaatttctttctcaaagttgccattctcaatttctgcaaaaatctcttgtaattttgcttcaacaaataatggatcggtggattttttcagcgatcttgccgaatagagatttctgttagttaaagaacttaacataacattaccatttcttttccattctacaatagaattcaaataattctccagcagaatacgaacacgattttcatcaaaaaccatgtcaaataggcagtgcttgatccattgaacagagttagagtaacccccagctctacattgaattttaaaattaataaggtcaggacaagaacccttcaaaccttggttgatctgtgcgtcaatagtttctgattttaacttggcgacaacttcctcaaacgagagcatagtttctacattactctcctcatcaaggattttcattggcatggaaaatagctcgtcaaacatattaaaatatggtaaaagcgaggtatccttaatagatgcggagttgaccaaaaaatgcagctctataaattgagacgggaaatgatttaagtgaatgaaaagaggaaaattgtctggcctcgtttctaaaatttttttggtcagcggatcactaacattattgtatttatacgaatcgacagttgcaatgcttttcgtgttgacaaattcaacactctttgaaggattatcaatctcaaatttctgtagtagagatttcggaattggcctatcattaatattttttgcattgttcaatcttttcaataaaaccagtttcttttcatcatcaaattcagcttctctttgtttgatcaaatccgatttttctttctctagttgttcatacatcaaagcgcttggtttagcggtaactatgataggtttgttgtctacgaatattctgttcagcaaagattgccagtccttttgggaccattgtaataaagcatcaaaatcacttaaatccttgagagaagacactaatgaagaaccatcttcattaccataaatatagtcggtaatcacagcactagaaaaacgactctcgccatttttttcatagttcagcaaatattcccatttagtattttcaactacctgtctaactcttgataaatcaatggtatgggttttcaaaatctccagtaccttggtctttgttgctgctattttttctgttgggacaccttggatacgaagatcaattatggttctcatgaaataatcagtgcaacaatcagtggaatttgccatgggatcgtcaatttcaaccagttctcttgtaaacactgccaatgcagagtcagtaaagtaatctaatagcacatcaaccgctaggtcattacgaaaatctgagtagggaacaccaatccaagaaaagagtaattcaccctgactttcatcaagttcaggaaattctacagtagattccgtaactttatctctagattgcggtatgtgcgaaagcttgttgtccaaaaatggtcttttctttggtatattcgatggaatctccggcaatttgttatcccattcttccatgacggttaacagttcatctgttggtacgttaccacaaacaatgacacaaagattatcagaagaatacagagatttgtgaaattgtctgatttcgtcgttggttaaggttcttaaatttttcgttagcccaccagtttctgaccgatagccacttccttcaggaaacattaatcgctgcttttctaaccctgaaatgtaccagccctgagtttcaatggcttccatttcactaaataccacacctttatcacccaaattttccgggtcgatgtgataaacctcagttaaacaagcctcgtctgttaaagttggatgtaggatgtgatctagataagcaggtagcaactttgagaatcccttccagccagcactgcttaatgtataaacagtttggtcggtatcagtccaagcattggtgttagacaaagacagattaccagctgtgtctaataaacctttgtatgggtaagatttagaacccatgaagatcaaatgctccaaggtatgcggagcacctgaatcattaagacattctgtaggaacagcaaagtaaccgtgaaccaatggggaggttttgtggtttatatgtaccagttgcagtttagttcgttccgagatatatttagttatatggtattgtgggacataatccggttggaatgatacgagcttcttgaaccccattgtgaagattcgacgaactgtgttgaaagtgcgtataattggtcttcgtgccgttttttgggtcactttcaacttttcagcgagtagtttctctcactatatcttacgctctgttaaaatcttttgccactacttcaaaattacgatctatgggatgaaaaatttacatgaatttaccaatactcggaaaaatgcaggacaagaaataagaacatttgtataatacaagagacgcatatacacatacctactcagataagtttaacgagtttctcttccataggagggtctaatctccttcagaagtctaacgtctaaaagttcgtaaagaatatcatcataaagtatggtatacaaaatttactgtgcaacaacagcacaatgcagtccatgatctgctcatctgagcacgaaaacctaacctgcaagtactggcctgttagcttcctcgcttcttggtgtgagaatgggtctggcacactgatgcagaaagatggtagtcttttatatgccgtgaaaaatttttcccatatatttgaaaaaaaaatttttcataccaatctatagaaatagtgaggtcaggagacatcgcaacactattgttctattgcattatttttttagtgttaaactacaatttcggattctatatcattgtatataatagcgtcagaataagcgtgactacttacttcttttcttgcttagtttttggcttaggtgcgacaagtctttccttttcgccccaaaccaacttatgtgggaccatgaatttgtccaaggtctcttcgtccacctgagctctgcgttcctggaacgccttaacgaattcttgcagagtctcgatacacagtttcttcatttcacctgatagtaattcaccggacttatatttgtcatagcattccttcaagaaaacatcgtcatccttgaaaaatgacaagtattggtatgcaacatcgacatcgggattaccacctaattctctatgtaggtcggcggacacttgaccaccgctgaatgcgtacttgttaattttcttttgaatttgctttggtgtatcggtcatgaaaatggcagtggtatcatcagaggctgacattttggtcgtggaaccttgcaaagctggaaagaatctggaatgaagcaaagcaggtttggagtacttcaatttatccgcgacatccctacaaactctgaaatatggatcttggtcaattgcacatggaatcaaacatggtgtcttatcaggcaagcctaacacattaggaaatgagcttgggaatgcggtagcaatttgaatggaggcaaaatggaacttaccaatacagtcggagtcattaaacccgaaaacagcctttgcagtggatcctgtaatttgtctggaaactcttactacagtttcgtaaaatgcaccacccatgtattgcaaatcagaaaagataaaggtgttctttggatcaaagccaacagcaatgatatccttggcattttcacgggcaaaattcttaacgtcattgatggtcaacttgtgtttgaataaaaatttttcgtcatctgtcaactctatgactaatggtacgtcaaacacttcctgtaaccatttggtgaagacaaaagggatcatatgacccaagtgcatagaatcgctcgaaggacctctaccagtgtataggaaaaatggtttgccttgttcgtaaaggtctaatattttagtgaagtcacgctcactgaaaaacaatcccttacgcaaaaaatgatgtggttcacgacccgtcacttgcttgaatctcttcagggtttcttcgttgaccggcttagtaccgaattgtttgatcaatttgtcgtaatcaatattttgggctctaccttgttcatcaaccccaccttccacatcccaaggtgtaactacttgctctttaacatctgtgctttttagttccgacacttgttgggtgactttctctacagtttcgtcgttgctcatcgttgttctacgactattttttgttattgagttttatttctgatacctcaatgactaaaaaaaatttttcaacgttttgatcttttttctctcttttccattataagcggaaaagagatactgtattgaataaattactggcgtcttgaaaaggatacatcatttaataaacgcaggaccatgccattgctttttgaactcatgctgtacgtgaaaaagtgtatatatatatatttatataagaagatatttacagtcagatacctacttttcgtttgatttcaattcagtctctgaatagccataaaataattaccgacatcggaacaatcgtgctcaacccacccttgatatgggaggtacatggtccccttgagatccaacaagcgaaattggccactgtagttgtcattgaaccaggcaaggatttcctttgagtttatgtatttgctcaaatgatgagtaccctttgggacgatcttcaagacgttttcacccataaaaattgtagtaaaccatgagatgagatctctgtttatagtacttaaaaagagtatacctttttcgggatttaacctcgaccaacaatgccttaaaatttcactaggcatatccacgtgctctagcatttccatacaggtgataatatcaaattgtccagtaacatcctccagagccttgcactcataatttatctttccctccagcatggggtctttcttggcatgctcttttgctaccatgatacaatcgcgagtcagatcgatcccttgaacattcttcacccattttagtctcgcgagcgattcactcaaaatgccaccaccgcatccaacatccaagacgctcacttctggcctcttatctagattagtctctatgctttcctgcatttcccgctgaatattgtcgcagacgtattctggtagaaactccttgtaattaaatccagggacaaatatttcaggattctgaattttaacctggttcctcacagtcctctgcacaaaatctaacctagttagattcattttgtgtagaattctttgtgatccgtctgtatcccaccaagtaggggctagctcctggaaatgcttcacttcatcttcagaagcatctgtgctcttacatctcgtttgtgtttgaattgcaaatcttgaacaggcgctcaattgtttcctcacatgaataaccttcaaaaatctagatcttaacaacattatgaatcccataagacttcgctgtacctgtttccctttaattgttttgtatgccttttagcatactttaccatccctctttttgaacaatggaaatgaaaaaaataaaaatatctgcttctaaaacttgtattatgtaaaagggtgataatacattatgaaaggtaagtaaaaaactattctatatacgtctgaaaacgctcttacaacctcttagtgaagaatatgctctataaaatccaaaatttttacgtaactgattgtatcgctgcacattataaccatgtgtcaccttaacgtcacatacagatcgtttcaaatccttattgtagtaagtccagaataaattattagacattatgtttcttgagtatggtgatgatttactgaccagtctctcgtgcttcatgttgcacatgtacaacaagtttcttgccctagttatccccacataaagggcgtttgtatccattgggaaattggacatgctcccgtttgttagaaatactatgggaaattctaaaccctttgcagaatggatggtagatagttttactgtccccggaccggtagtttgtaatgcctgctgagactggtgaaagaccatcgtttgatcaaaatatgtctctagaaaccatttaacaaatgaaatacccgggggcttattagattttgagaccttcattacttgtgccatctcttgtagatgtgttttaaactctaaagatgattgagcatcacttaaggattggaagtaggtaggatttaggtttaagttatttgtgatgctagcaactttttctaaaagttccatcggatcatctaattgatgaacttgatcattttcgatcatttcatataaatttgaagtgtaattttccatttttttctttatggagaggcccaatggccattcaaaattgggaaccatagttaggtatttccaaattgacagatttttcaggctgcatgctttatacaaggcttgtattgaagcatcgccaatccctttgagagcgctcattgtgaccaaaatgctgaagttactttgccatttatcacccgtattgaactcacgattatgcttttcgtcggaggctaaagaacacacttttagaatatctaaaaggaattgaattcgtaaatcgtccatccaatcaggttgactctttagtttttgataaggaataccatatttcttcaaaatactggctatagccgttagatgtgaatttgttcttgatagaattgctatatcggaaaactttgcagaagaacaaatcaattgggtaattttatcaataataaattcagattctgcggctagatcatcaaatgtcattatttgaggtgaaacaccactcggtagcttgcgaactagctctgatggtgtttcatcagtatcatcgataatctgtttctctgctagtggacgattgataatttttgatgctagagagattatttcgggggtagacctaaaattatcaaataatttcaggacagtcgtggaattttttgggtgaagattgtctaattgtgacataatctcgttgttactccccaaaaatccgtatatgctttgatttgtatcaccaaacataatgagctgcttgcctttgcaaatcatggtaattaagggtgctaaacttggatagaggtcctgaaattcatcgataagaacaaccttgtatttattgcggagatcttgagtaaaagacgatgcatctgaatcagaagaatcaagctctaagtatttttttgcgcgaatgatcaaatcatcattggtcatcactttacagttatccatcagttcaactagtttctcaatgacggggttattattttttgcgttgtttagcttgtaatccttaacaactttctcgagttccttatatgatctgaaatgatggggggttctctttgacggcggtaacaacttcattaatcctctccatccaatctcttctataatgtttatcatcccctcattctctacaacgattctattagccaacccatgaactgtgtaacacccaatctgatggacaatttccttatttgtatgcgagttttcgaaaatggacagtaaattttctattatactatcaactgctttgtttgttaacgaaaatataagtatttcttcaggcttaatattctccacagtaattaaatgtagtactttatatagtagcgttagcgtttttcctgagcctgggcccgcaatgacttttatcgtagacgctggttcatatgacttatttattaccttccattgagatggagttagcttgtccatctgtcttcaacgaacgacgtataccttctctatattttttctacatattatgactatgtaactgcactgcgagttgtaagttttgatcaacaaacaactttaaagcttaaattgtgcaaaaatgaaaaaaaaaaaaaaattctgacacatcacaagggaagagacaagacaaagaagtagaatttaaagtaatgcactaatatgggagttttttttatagttttcggatatttaaatcaggctttattatttagtttatgaattttcgctaacatactagccagttgcaagtacgttccaacaccctccagaattctcatatgggtcaaaccgatttcttttatcatttccaatcttactgattctttcacttgtgctaagtttttggtaacgcggaaagatgttgtgacgatatcaatcgaggaataaccctttttccaaagatctgttcttaagatttgaattgaatcttctaggttggaggctagtaacattttcttcactattagagggtgaggagaatcaacaattttgaagacattgtctgcgttcactaaaccgtgtcctgctactgtactttgtagattgtttatggcctgtctcatgtcaccctccgctgtaaaaatgattgcttctaacccatcatttgtatacttaacatcctctagctttatgatttgtaaaagacgttttagaacgtcttcatcggatagtttagaatacctcaaaatcgcacatctactttgcagcggctcaatgatcttgtttgattgattacaagcaaatgcaaaccttgtagagttcgaatatagctccatggtccttctcaacgcttgctgagcaccagcagtcatggaatccgcctcatcaagaataacgattttatgtttccctggaggcaaatgtagtttcttctgggcaaaatgttttatttggtttctgacgacatcaatacctctgtcatctgaagcgttcaactctaaaacaccgtcagcataagagcggccaaggagctcgtgagcaaggcaatgtaccgaagtggtcttacctatacctggcatacctgatatgatcatatggggcatgttaccatctttagcgatttgctgaagtctatcaatggtctctttattaccgactatatcagataaaacttggggacggtatttctcaacccatggaagttgcaaagataaagttttggacattataagggactttttatatcttctgggaagctctgcaatgttataatagatccaatcagatttataaatgctactattttacagtatttaaaatatgtggttggttttcccacctttttgtcaagaaaaaacgcgtttaatctaacagtgtgatgtggtaatgaaaaattttcattgtctttaagagagatggtgatgtttaatatagcgtaaagctttcaaggtaaataattaagtgtcaatctgcaggcaaaacaacatgtccaatgatgagataaaccagaacgaggaaaaggtgaaaagaacaccacctttaccgcctgtgccagaaggcatgtctaaaaagcaatggaaaaaaatgtgtaaaagacagagatgggaggagaataaagccaaatacaatgcggaacgccgtgtaaagaagaagagacttcgccatgaaagaagtgcgaagattcaagaatacattgacaggggagaagaggtcccgcaggaattgattagagagcctcgtatcaatgtgaatcagactgattctgggatagagatcatacttgactgttcttttgatgagttaatgaacgacaaggaaatagtaagcttgtctaaccaggtcaccagggcatactccgcgaatagaagggcgaaccattttgcagaaataaaggtggccccattcgacaaaagactaaagcaaaggtttgaaactactctgaaaaataccaattatgaaaactggaaccattttaaattcctaccagacgacaaaatcatgtttggagatgagcatataagtaaggacaaaatagtgtatttaacggccgatacagaggaaaagctggagaagctggaacccgggatgcgatacattgttggcggcattgtagacaagaatcgttataaagaattgtgtctgaagaaggcccaaaagatgggcattcctacgcgaagattgcccattgacgagtacatcaatctcgaaggcagaagagtgttgacgacaacgcacgtcgtgcaactcatgctgaaatactttgatgaccataactggaaaaatgcctttgaaagcgttttaccacccagaaagctggatgcggaagcaaaatccgcaagctcttcgccagctccaaaggacacataggcagccatcactgtagtattattagtaactgaatagcaaaatagtaatagtctccgtagctacaataggtgtatattgatgtcagagatacgggttaaacatgcgcaactggtagtagttcttcaaagggtgtttatgcttatcatagtacttggacattagccgccgaaactggctccactcgaaatctaaatggcattccctttttaatattaacaacaccaatcttagtgtccgagaggtccaaatctaatgtagggccgtgggaggatacttcttatttctctttgcttattttgctttgatgttgtatgtgttttacctgtaaattctctaatatggtcatttttgctcttaatgactcttttatttttacccggattgcaatttttcacatatcgtctttttattcactacgtactttaatcgtcttcgcgatgatatgtactgctaacgaaagaatgccatacaaaaaaaaagctaccacatcgctcgacgacctcaattatgcaacttgtgccgctagaattgaatagatccactctaagtgggatatctgggtccatctccatctcctgctggatcattgtgtttgtccctcaaatttacgagaacttttaccggaagtcgtctgatgggctgtctttattgttcgtggtactttggttggccggcgatgtctttaaccttatgggtgccgttatgcaacatcttttgtctaccatgatcattcttgctgcttactatacggtggcagatatcattttactaggtcaatgtctatggtacgataatgaggaaaaaccagcagtagaccctattcatctctcccctgccaatccaataaacgaaaacgttctgcacgatgtgttcaatgaacaacaaccgcttttgaattcccaaggtcagccaaatcgtattgatgaagaaatggctgctccttcatccgacggaaacgctggtgatgataatctccgtgaagtcaattcaagaaatttgataaaagacatatttattgttagtggtgtagtttttgtaggtttcatctcgtggtatgtaacctactgcgtaaactacacgcaacctcctcccgtggaggatccatcactgcctgttcccgaactgcagatcaattggatggctcagatattcggttacttaagtgcccttttgtatctgggttcaagaattcctcagatattactgaattttaagagaaagtcttgtgaaggtatcagtttcctattctttttgttcgcctgtttgggtaataccacatttattttctctgtgattgtcatttctttagactggaagtatctaattatgaatgcttcctggttggttggaagcataggtactttattcatggatttcgtcatattttcccagtttttcatttacaaaagaaataaaaaatttatactgaattaacatgttctatctaatatttatttaacatatttttgacctcacaaactttttttttttttctctctgtcattgacatttttttaatgtcacaaaaagaaaaattaaatgtattataaaatttcatttaaataggaaaaaacccgtgattactaaaggcatattaaagatctattaaagatctattaaagctttctgctaccagtatggataatattttaaaggcatcaaatatggaagggacttcaacaatgacagttacctcgcgtagttctgaagactctagttgtatctcaaatcatgaacaagataccgatacacataaggacggcgacacaagtggtctggaaaacagtaaaatttcgaagagaaagtggatgaaagagttttttaaactttccaaatctccagcttccaaaagcagccggagtataggttccatgaaaagtaaccagagcctcgtttcaatgaaaagtagtgacgatggcaacagttataaaaatgattactcttctatctgtggtaacagccttccatctgcaggcttgagtcgttcgaatagtgtgaaagaattaaaattagattcaactggaagtcagagatcaaaaaataatgttgccatgttagcacgttcttctacaacatctcagacaacgtgctcttcttcttcatcatcatcttcttataactctataaaaggaaatgaaaatgatattttattgcagaataacaatcactttaggcataacaaagaaattcctcaaagtaaagggagctccaacattaacaccgcatcgattatgagccaatacaatgtcgatacgcaagcaaccgctataatgagcgatatgcaaaagcaatacgactcgcaacagatgacatcaccatttgtaaacgaagacttgcatttcgatccaaatggtgaagtttcacacgtaataaaagcaatttttaaagaaattggttataaatacgatgatttcagtgatattcctgtttttcaattaatgcaagaaatgtatcaactagtgaagaagaattccagcgctagaagaacaaagataacagactatgcctctaaacttaaagaaaaagaagcgcaattaaaaagtcaaaatgacaaaattttgaagttagaaacaacaaacaaggcctacaaaactaaatacaaggaggtctctctggaaaataagaaaataaaagaggctttcaaagaactagacaatgagtcatacaatcacgatgaggaattactaaaaaaatacaaatatactagggaaaccttagatagggtcaatagagaacagcaattaatcattgatcaaaacgagtttttgaagaaaagtgtcaatgaactacaaaatgaggttaatgctaccaacttcaagttctctttatttaaagaaaaatatgcaaaattagctgatagcatcactgaattgaatacctctacgaaaaaaagagaggccctgggagaaaacttaacttttgaatgcaatgaattaaaagaaatatgtttgaaatacaaaaaaaacatcgaaaatatatcaaataccaataagaatttacaaaattcgttcaaaaatgaaaggaaaaaagttttagatttgagaaatgagagaaatttgttgaaaaaggaaatactgttgattgaatgtcatggttcatattctctactccttgtatctaatattctgacatgttatcggttcttactgccaagtgatactattattgaaactgaaagcttaattaaggagctactcaacatgaataattcactttcgaaccatgtgtcttcttctgacgagcctccagcggagtactcgaaaagattagaattaaaatgtgtagagtttgaggaaaagttactttatttctatcaagaacttgtgacgaagaaaattatagacgtcatttacaagtgctttattaattattacaagaaaagtaggcaaactgaccaaaaatccaatcagaactccagcactccgtataaacaaagccaaagacaagttccgcactccatcaagtgaacctcaacagctacacattcttttataatccttaatattctatatatacatatatgaaaaaatagaaaacgcgaaaacttgtcattttttttttaggcgtttttataatatactgaaaataaaaagaggctctttaaatgttgacactctactccaatatcaactgtaaaaaatctctttatctgctgacctaacatcaaaatcctcagattaaaagtatgtcctccactaggccagagctaaaattctctgatgtatcagaggagagaaacttctataagaagtatacagggttgccgaagaaaccattaaaaaccattagattagtggataaaggcgactattacacagttataggttcagatgcgatatttgtggcagattcagtctatcatactcaatctgttttaaagaactgccaattggaccctgtaacggcaaagaacttccatgaaccaactaaatatgttactgtttcgctacaagttcttgccactctgctgaagttatgtttgttggatctgggatataaagttgagatatacgataagggttggaaattaataaaaagcgcatctccagggaacattgagcaagttaatgagctaatgaatatgaatattgattcgagtatcatcattgcaagtttgaaagttcaatggaattcccaagatggaaactgcattattggagttgctttcattgataccactgcatacaaggtgggaatgcttgatattgtcgataatgaagtgtattccaacctagagagtttcttgattcaattgggtgtaaaggaatgtttggtgcaggacttgacatcaaattcaaactccaatgctgaaatgcagaaagtaataaatgtaattgatcgctgtgggtgcgtcgttacattattgaaaaactcagaattttctgaaaaagatgtcgaactggatttaaccaagttactgggcgatgatttggcattatcgttaccacaaaaatactctaaattatctatgggtgcatgcaatgcattgattggatatttacaattgctctcagagcaagatcaagtaggcaagtatgaattagttgaacataaattaaaggagtttatgaagttggatgcctccgctattaaagcccttaatttattcccacaaggaccacaaaatccatttggtagcaacaatttagctgtatctggatttacgagtgctggtaattctggtaaagtaacttctcttttccagttactgaatcattgcaaaacaaatgctggtgttcggcttttaaatgaatggttgaagcaaccactgaccaatattgacgaaattaataaaagacatgatttagtcgactatctaattgaccaaatcgagttaagacagatgttgacttctgaatatttacccatgattccagatattcgtagattgactaagaaattaaataaaagaggaaacttagaggatgtcttgaaaatttaccaattcagtaaaagaataccagaaattgttcaagttttcacttcgttcttggaggacgacagccccactgaaccagtaaacgaactggtccgctccgtttggctagctcctttaagccaccacgttgaacctttgtccaaattcgaagaaatggttgaaacaacggttgatttggatgcttatgaagaaaataacgaatttatgattaaagttgagtttaatgaggaattaggaaagataagaagtaaactggatacgttgcgtgatgaaattcattcaatccatcttgattctgctgaagatctaggattcgatccggacaaaaaactgaagttggagaaccatcatctgcatggttggtgtatgaggttgacacgtaatgacgccaaggagttacgtaaacataagaagtacattgagttgtcgacagtaaaagctggtatattttttagtaccaaacaattaaagtcaatcgccaatgaaaccaatattcttcaaaaggagtacgacaagcaacaatcggctctggttagagaaattataaatattacattaacgtacacaccagtttttgaaaaactatccttagtcttagcgcatttagatgtgattgcctcttttgctcatacttcctcgtatgctcctataccatacattagacccaagttgcatcccatggattcggaaagaagaactcacctaataagctcccgtcatccagtactggaaatgcaagacgatataagctttatatctaatgatgtcacattagagagtggaaagggcgactttttaatcataactggaccaaacatgggaggtaaatctacttacatcagacaggttggtgtgatttctttaatggcccaaattggttgtttcgtaccttgtgaagaagctgaaatagccatagtagatgcaattctttgcagggtcggggcaggagattcccaattgaaaggtgtttccacatttatggttgaaatattggaaactgcttctatactaaagaatgcgagtaagaattctttgattattgtagatgaactagggcgtggtactagtacatatgatggttttggtctagcttgggcaattgctgaacatatcgcaagtaagattggatgtttcgctttgtttgcaactcactttcatgaattgacagaattgtctgaaaaattgcccaatgtcaagaatatgcatgttgttgcacatatcgagaaaaatttaaaagaacaaaaacatgacgatgaggacatcacgttgttatacaaagttgagcctggtatttcagatcagtcttttggtattcatgttgcagaagttgttcaatttccagaaaaaattgttaaaatggctaaacgtaaagccaatgaattggacgatctaaaaactaataatgaagatttgaaaaaagctaagctatcattacaggaagttaacgaaggtaatattcgtttgaaggctttactgaaagagtggattagaaaagtgaaggaggagggtttacatgacccaagcaaaattactgaagaagcttcccagcataaaatacaagagctattgcgtgctatagcaaatgaaccagaaaaggaaaacgataattacctgaaatatataaaagccttgttgttataattaatattacaacgacatcttaagtgagaatcgatagataatatatagatacaaatagtacatataatatgcattgggaaagaatttttattttttacaatctttgtagacaaggtacagtttattcataatccctaaaagtgttcacgaaagaataatctctgtcatagatcaattttcctaaaggcaataaggctctaaaagcttcgaaatcttcctttattccactgtcactattaaaattagaattttcaggggtctctagaccactggaaagagtatctccggtatcagaactatggatgggataaacaagagatgttaggtccgaacgaattgggtacaaagatgagtcatcagatattcctttcctatttgaagatggcgataggtctccaaaatttgagatgggggagtgagattttaatagttttaaaatttcgactgataactctccaaataagtttattggtgcttcctccgcaaagtcttctgaagaaatatcattcgtattcagtccatcatcggcgagatcggcttcgttgcccttttgtaaagaatggagagaaccatatgattttagactcataattagttgatcgactgtttcatcttttatctttcttgaatgcataataactttcgttatcgtttcatcataaggtttagaatcaaatattgacgtagaatcgttcaaagcatgataacgttgcaaaacgtatttcaaaaagtggctgtagaacacaatcaaagtgttccatttgacattgtcaaacagtaactgctcatcattttctcccactaatcgatcataagatttttttaggatatcgatgatctcttttacctcacctttcttttttagatcgttcatattatccacaacgtaaaagaagagaacaaacatagcagtagagaactgatacataacctcgttatacatatgcgcctggtaattgatgccttgaaacagctgtaacatttctttactggcgtttaagtattgacttgaaaaaagaatgaatagctgaggaatatcatggcgagaacctttgtataggcgttcgttatcaatcaataaggatgtagtcatcatgctcaaaatcactttagaatatagcgccctaaaatgacaattcaaaacacgagagcatgcaatctcaaaacttaaagccggattttcttgggatttttgagcgtaaagtaccgataaatactgtttataactttttagtttcatacttacgtgcaagttgtctctccaattgttcaaagaatcattgagatctttgattttatcaagcatggcatcgaatgaaagatctagagtacttctgacagcaaaacaagtagagtatattttactctcaatactaaccaattttgaaacataatatgatatgaaaagggatatgtgctgacaaaaatttacaactacattcaatgcagagttgacatcagtaattttatcgagatcttcctttttatcaataagatcaggtagaatattagtttttatcacttcataataattttgatctgttagcatatccatatcgcgttcccccacaatagggggtctggataacattaaagaatatagtttatctgtacaaaaacaatgccaccacattcttcttctccttatggcttcttcaaagtctagtgacttgtaagaggattttctatttaattccatgtcaaccgccaatctaatcgcggttcctaaaatacaatttgctagttcagtatcgtaggtaagttgaaaatatcggttcagtagtaataaagcttgtagtgttcttgtacctgaacagatggtggacagcttatgataataatacatggcatttagtaaggcaacgttttcgattttttttaactcttgggaggttggatcatatctatctttccttagaaactttgaatcacctcttataattgattgagtggcagatgcacccgagcagagacacacgtttaataataaatgttcaggatatgtgagtttttcgccgctttcgctgtagtacttttctgctaagtctagacattcttttaacgatattataccagttacagaggataataaggtagcatgaaaattctcaagaagtctctttgcttgctttttcggaggtaatgagtataatattatttcgctggagaagaaagccggagatgacaaatccataaattttttcatttgagttgcataccattttaaagatatgcttaatatttcgctgattggagaaagaaactcctcattggacgctttcactcctaaactttgtttgaaccaatagagtttttgagcagttaaaagtgccgtagagtatatttttctcgctggtttgggcaaattgttcttttccttgtatttgccttcctgctttttaacagccttgtccaataaccactcaagtctagccacactgtcaataatgtaagacatttttctatccaatttttcaatctttgaattcatttttttgttaagattattttgaatattggagactttatcgatgatattgctttctaagggggaattaccgtttaaaagttcaaaccttccactgttcggtactgaagaagacgctacaggattgctaatactatttgaggtttgaagtgattcccctggtgttgcatgatgtttgatttctaattttcttttcttcttaagaatctcatcacgatgtttgaaagtgcaaggcaactgaaacttaatacagtttgaacattttttggtctgctggtccacttcatcacatctgatttttctttttcggcaatggtcacaggcctttgatacacgtttcttgagatttttaccagagccgctcatatcattactgttagtgtgttccatcatcgtgctgatgtcacggttctgttgtgtctgaaattgcgactgatgctctgttggcgagtatattgtattgggataagccacattcatggggatatttggacctattgtactacctgtcataagggtgttttctctgttaggcatcgtcatcagttgatctggcacaggcatcgaccatatttgagtttcaggaaccagacgtggggtaccagtttgatggtttacatttgaaatgtcacttctaccggtgatttcattgttaaaaaccgcattcatattgcttgctgagtttgaaaacccatttgggctgtaatctccaccttgattttccattatttcaaaccgaagatttggagtggagagtgctgatttcctaagttgaattaaagtacgataataagctccctaagacatttattcttttttcgaattaaaggctttttatataaagccatctttcatgtacgtaattggagattataccaaaaccaaacagggtaagagatgtttctctaatgaataaaataacagtgttaccttagcacaagccaatattcaaaacacatgtggtagaccttctgtaatatttatgtatatctccataatctttcacctacacaatctcacttatattgcggctaacgtacattgttaaatatatatgtatctgtgtatttgttgtacctcagggtgagggtcccgcttccgtctgtagtcggtattcgtaaagtaaaagacagagcgaagcttatgttcaaagctcgtcatgactactggtatcttctaactggtcttctatgtgtgataataggctcaattgtagacgaatgattttcagtttttctttaacttctttactcaagtcatctccattttgcttaattaaagcttctagtcttcgcctttccttttccagcccattcacgtcaccgtataatttagataaagtatcagagtagtattctttaccagctttacacagaagctgttgagaacgtaattcttcattgcaattcctagaatcatcgaaaatatgttctatgaatctttcttctgtatctttacttcttacagtatcgataaagttgcttaaactctttaggttcctactcccttcaaaacgaacaaccctagacgtatccagttggtacttaggattgttgaaccacgtcttgattctttgccatagtctttcatgaaatttcatagacgaccaatcgagcttcggaagaactaagggcttagtacgaggtttgaccagttcaattattggaaatccaggcaagtcggtacataaagttggcccgaagaattcacagttaacttcaaggaagttaattggggtatcatctttattagcttttttggcgtatagctcaccaagctcttcgtatactggggccagagttttacaatgttggcaccaagaagtgtagtattttatcattgtgtaagaatcattcctattgcagatatcgaagtactgctcaatcgacttgaccatcgtgacagcttcactgtaggccaacgctggtaaaatgacgacgcatgttgataatacggaaaataaaaagccgtgcaatttcatctcctttgtgttttactttgccgacgtacttgcactagactcgctgtgttttttttctgttgttttgttgttatgctgttctttagctcaaaaaattggccactgttccccgctctgtaaattaattgctcttaaagaaacaaaaatgattaaaaaaaattagaaatatttgagataataagaacatcattcaggtcgcccatattcacaattatttacagactgtattttaatgaagaatgtgtgcataacttgatggtacctattcaatataaaatttgataaataaataatattataaaaatgtctatgtaattattataaagctctagagtatgtatgagttgttacacatagcattccaatgagtacttgcttttttcttcgttctttagacatttcagaagaatattctttatcttgtcattgttactgcaactactattatagtattattagtattattgttggtattgttactatatatttacgcttaaaaactccaaattcagaccccaaaatataatttaaataaacattatcatttcccctcattcccgttgacctcatgaactagcggtgaattatgtacttttcttctgtattctagaactatgtcaccctgagatttccagtaaagtgttctaacggtatttaaagtcatatcgttatcaagcacttggcccctacatagtagatccaaccaaagactaggttccatttttgctttcatttcaggagttttcgtttcaaatctgtcagcgacgtaaagtttaatttttttcaccctaatcattccaggcgcaaccagcttgacattcgcctcagagattctcggtaaatctgtggggtttaactcctgctcgctggtcttcggacggccaaactttagcatattatggaactgttgctgtgttgatggggaaacggcttcattaccatttccaaggctgctatcgctactatcgttgccagaagattctgtggtatctgatgcactaataaacttcttcttgttttcattgccagctgcctcactcccaccaacagaagaccatggcatgattaagaagttcaactttggttgctcttccaccgtcttaatatctctaaataaagcttttgcaaaccagtagggcaaattttcctccaattgctcaaaaatttgccttctgttgagtctgcttcctaactcgccatcaataagatcatattttcctaatttgtcatcatctacagcttgaaggtctacttcttcatcatctggcggtttggaattttctttgccgccgctgacggtttcattatcgacatgagatggcggtaatagggtggaaaataataccctgccaccacatgagccttccttccaaagatggaccaaaactaacgtggcagattttactctaataattggacatgaactagccttgattatcttggtgactggaagcctcttcgtcaggtattttagagaagaagtattcatatattgttgcttgtaagactcttgaatttgctccagtaaatcgggcatgaactcaggcttcttcttttcgttgccttccaaggttgacgtggaattcgcccttgagttttcagatgatcttagtttgttatgagtgttgttactcggtaaatcttgtgatgaaatagcggatagtttttgctctagcttgaaaggatgattccataacatagattctggagttgcatccttagactgctgagttgtattgatagcttgagggaaggccgagtcatcattaataacgtgcggagtatctggcagaattcctttgggctcctctggagtgtttaaccctgttgtggcacgaccagaagtagacctaaatgatttgaactttctacttaacaaggagccagagctctgcgttctaaaatatggctttttggatgcaggcaatggttgcacgagttctaaagagtcatctattgctttatcagaagctgactgcaacaatggttgttcttctaatactatagtctctgccattaccggggttgcaggtgccgaatttggtggagttccactgctgttggtatttccaatggacagagttgaactaattttgaaggttgattttctctttttatctttattattcttttttgattcactgttatatcccgtatccaaggttaatgaattggttaagtcttttttcttcaaactaaaaattttcttccttaaaagtttatccttttggacttcatatgatatgaactcattgaaaagcgaattaataacaattttacccaaattatatctctcatctgagttaatttcaatattgttcacaacctgataatcctttagcgcggatccataaacttcagttttcagaaattttgggtttatttttacgaacagcataccgaccttaacggaaacagtacaccaatgagatagaatttcctttgaggtgtatttcattacaatatcatcaaatgaaccttctgatgaatcaaaagtattcaaaagctcacatgaaacgatatcccatctctgcatttggcctttagtgttttccgttattacatgcctcctgttggttagcagtgagcttctggtcagtgcgaacccaccttcgttgacactgaaatggttattagttaaatcgagcacgtttagatttgagtcagtacaaaaagaaaacaacaatttttcattaggtaaaagggcaatatcaaggataccaccatatttttttactttcgcatctgtagttgatatattttgctcttcgtgttcatggtgatgatgatgatggtggtgatgatcaggcttgaaaattcttgtaagtttagcatcttcataactggataagtttgctctcataacattgccctgagagtcaccaaaatacaacttatcaaggctcgttccttggacacaccatatggaagaatcccaggaccaagatccaatttttttgggaagctgaagggcaccagtagtctgatcatgcctacaattcaagtcccatacatttattacaccatctgagctggtactgattagtcgtgtggagtcatcaagagttcttactacttttatatttgttctgtgggcgttttgaattcttatcacctccttacgatatttacacgaataaaaaatcaaatcaccattacagtctccggcaacaaaatcaaagggacgagacgtttgattgtcatcaaaactgtattttgggatgatgggactcatggagtatattgagcctgtgtcgtttgattgtgcattatcaaatgtgtgtagtagcgtagccattttttctggcccgctgctcaggcaccaaagtttgatttttctatctagaccacctgtcacaaaaagaaagttgttctgttcatcaacaacaatgccattatttattccatcgtgtacattatcaggaccaccctcttgttcttccaattcatagtcatttgacatttcataatgtatgggcactatgcacttgatataatcgtcgtggtcaccgattattttcttatcccaggtagttaactgcgcattcacactaattaatactatcgaaaaatcgtgacttactgatatgaatgtgtcccctgcagatgggtctgaatttttcatattaacatgtattagatcgcttgcccaatcgctatgaacttgcattcttatcgcatcgttttttatggtagttgcagcagtctcaggctcgttcgagagctgtgtgttcttgtgcaaaattatggaaccatcccttcctgaagtaagaaaatagtttttaccaggtatatccgggtacagaatctttgttatcggtaagatgtgcgcatcttgggaagtgcagtaatctggggaaattaggccataactcactgtcaactgattcattattacctttctattttctccggctttttattggcttgctcttctaaagtcagaaaagcgtagatttgctagaatgtatcgtttcctcgttaggaatggcttgaactaattcctgtatctatgcaattgcaatccaactacacttatacgacgtcaaaaggaaggggcggagcgttctaattgtagttgcaaaaagcgatgtagtcgttcttcaagtagtaattaataccaggataggacacggtgttatggtgctggtagttacttgttataatgttattattgggcaaaaagagagttcactgtttaacaatagcaatggggtttttttcagtatacatttgaactgcaatggaatttgggcggagggagcagtaaaggggcgatcagagttgaaaaaaaaatgctgccgtaaaaaaagcatgcacgtatacacttgagtaaatatatttatgtattcatatctcaagataagatcatgatacataaaagcgatataacgtcttgaagctcaggtaaggggctagtagatgcaatgaatgacgatgaagatagagcccaactgaaggctaggctgtggatccgtgtggaagaacgattacaacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttatttagaagtgtcaacaacgtatctaccaacgatttgacccttttccatcttttcgtaaatttctggcaaggtagacaagccgacaaccttgattggagacttgaccaaacctctggcgaagaagtccaaagcttctctggtgtcagctctgttaccgacgtaagaaccaacaatagagatggacttgacgacttggttgaagacatcagaacaacacttggcaccagctggcataccgaccaaaacggtggtaccgttagctctaacgtatctggtagaagcttcaatagcggcttcggaaacggaaacgttgatgacaccgtgagcaccaccgtcagtggcctttagaacagcaccgacaatgtccttttccttagtgaagtcaatgaagacttcaccaccgatggatctgaataattcttccttaccttcaccaccgtcaatacccaagactctgtaacccatagccttggcgtattgaacagccaaagaacctagaccaccagcagcaccggagatagcaacccagtgaccggccatcaagttagcagacttcaaagccttgtagacggtgataccagcacacaagatgggggcgacttgggccaagtcggtaccttgaggaatgtgagcggcttgaacagcgtcagcggtagcgtattgttggaaagaaccgtcgtgggtgtaaccagacaagtcagcgtgaggacagttggattcgttacccaattcacagtattcacaggccatacaagaaccgttcaaccatttgataccggcgtagtcaccgatcttccagcccttaacgttttcacccatgccgacaacgacaccggcaccttcgtgaccaccgactaatggtagcttaactggcaatggccagtcaccgtgccaagcgtgcaagtcagtgtgacagacaccagagtatttaacgttgatcaacaattcgttggcctttggctttggaactggaatatctttgtattccaacttaccgtgggattcgtagaagataacacctttttgagtttctgggatagacattgtatatgagatagttgattgtatgcttggtatagcttgaaatattgtgcagaaaaagaaacaaggaagaaagggaacgagaacaatgacgaggaaacaaaagattaataattgcaggtctatttatacttgatagcaagacagcaaacttttttttatttcaaattcaagtaactggaaggaaggccgtataccgttgctcattagagagtagtgtgcgtgaatgaaggaaggaaaaagtttcgtgtgcttcgagatacccctcatcagctctggaacaacgacatctgttggtgctgtctttgtcgttaattttttcctttagtgtcttccatcatttttttgtcattgcggatatggtgagacaacaacgggggagagagaaaagaaaaaaaaagaaaagaagttgcatgcgcctattattacttcaatagatggcaaatggaaaaagggtagtgaaacttcgatatgatgatggctatcaagtctagggctacagtattagttcgttatgtaccaccatcaatgaggcagtgtaattggtgtagtcttgtttagcccattatgtcttgtctggtatctgttctattgtatatctcccctccgccacctacatgttagggagaccaacgaaggtattataggaatcccgatgtatgggtttggttgccagaaaagaggaagtccatattgtacacccggaaacaacaaaaggatatccgaaatattccacggtttagaaaaaaatcggaaaagagcgcggaggggtgttaccccccttctctactagcattggactttaattaatatatgtgcataggagaagtgtaaagttcccttccatattgtaacataataaagtgcacacccaaatgaattgaaagcgtactcaaacagacaaccatttccagtgttgtatgtacctgtctatttatactggtagcaaccctattgctgtttcctcttcaaagtactctagcggttatgcgcgtctcaccttcaaggtcatggtcgctctattgttcgcaccaccggcaaactcgcgtctcgcaagtcttggctcattcttctagtatactcatgttgcaaatgcactcaggttctttcggcaacttaaataatgacaccagttgtcgtggtcgtcatcatcgcaaccccaaccggcattcttattgcttctccaatctcgccccttagcgcagggtaaaccttggaaaatgcaggcgcaaaaaactccgccgggcacagcctcacgcccagcgttatcgccgggccggcaagagcgcgggtccgccacagagtcagcatgattgtgcaattgcgtaaactcgttttttcggcgccgcaaagccaaatacatcatatcaacacttttcactttatttttcgttcgacccttatatttgtcttttgccttcatgctccttgatttcctatttcatttaccatcatttcttcgatccccctcatcgtgatgtagtcaaccctcttcttgttttaatacgttaatctccctgaaatactttaaatacgtatgtgcgcaagtgcttagaaacatgtatacatcgagtatatatatatgtatgtattcgcttgatgtgggttcttggttatctatcctttattgtatttactatgtctactacgtctacgatatttagcaaatagtactcctttttgttatactattatattaagttatatttgagcacatcatattcaaagcagcgaaaggttagatatttatagcacatacgtactatggctgacagttcttcgacttcggcgttcatttcaaccctgattatctacggtcttaccgccgtcgtgtttgtctggctctttttgctattgcggcccaagaatagaagagtatacgagccacggtctcttaaggacattcagactattccggaggaagagagaacggaaccagttcctgaaggctacttcgggtgggttgaatatctactctcgaaaccgcactcgtttctcatccagcacacaagcgtggacggctattttctgttaagatatatcggtatcgtgggttcactttcgtttgtgggctgtttgcttcttttaccgatattgcttcccgtgaacgctaccaacggtaacaaccttcaaggctttgaactgctatcattttcaaatgttaccaacaagaacaggttttacgcgcacgttttcctctcgtggatcttttttggcctgttcacctatgtcatctacaaggagctgtattactacgtcgtgtttagacatgctatgcagacaacaccactctatgacggactgctgtcttctaggacggttatcgtcacagaattgcacaagagcatcgctcaagagggggagatgcaaatgcgtttccccaaggcttccaatgtggccttcgcgtatgatctctcagacttgcaagaattgtgtaaagaaagagctaagaacgctgcgaagtacgaagctgcgttgaataaggttctaaacaagtgcgtgaaaatgacccgaaacaagacccaaaagcaacttgacaagttgtacaataacggtaccaagccaaaggacgatttagagacatacgtgccacataaaaagcgccctaaacatcgtttgggaaaattgccgctttgtctaggcggcaaaaaagttaatacgttgtcttattctagtaaaaggattggggaattgaacgaagagattcatgaaaaacaagccgattgggccagtaatgataggcaacctgcctgctttatccagttcgagactcaattggaagcgcaaagatgctaccaatctgtggaagcaatcttgggtaagaaaaattttggtaagcgtcttattggctactcgccagaagacgttaactggggcagcatgcgtctcagttcaaaggagagacactccaggagagctgtggcaaatacaatcatggtgttattgattatcttttgggctttccccgttgctgtggttggtatcatctccaacgtcaatttccttaccgataaagttcccttcttacgtttcatcaacaacatgcccaccttcctgatgggtgtcattactggtttgttgcctactattgcgttggtcgttttgatgtctctagtgccaccttttatcgtaatgttggggaaacttagtggttgcgtcactaggcaagaaacggatctatactcccaagcatggtattacgctttcgctgtgattcaaatctttttagttgtcaccgctacctcttctgcatcttccaccgttgactcgattattgacagaccaagatccgccatgacactattggcaaataacttgccaaaggcatccaacttttatatcatgtacttcatattgaaaggtttaactggccccacatggacgatcttgcaggcagttaacttgctgctaagtaaagtcctaggtagagtgttggattctaccccaaggcaaaaatggaaccgctacaatactttggccacgccgcgcatgggcattgtttacccaggcattgaaattctggtttgcatttatatctgttactcgattatcgcccctatactgctatttttcagtaccgtaatgttgacgctactttatgtggcgtatttgtacaatttaaactacgtgtttggcttctccttcgatttaaaggggcgcaattatccaagagcacttttccagatttttgttggaatttacttgagtgaagtatgtctgcttggactgtttatcatggcaaaaacctggggtcctttggtcctggaagtgttttggatcgtggtcactgccctagctcatatatatatgaagaggaaattcataccgctattcgacgcagttcctttaagcgccatcagacatgcaagaggtgagcccggctattcctatcctacatcggacttgggtctccaggaaatcaaggacattgcagatgaaatgaagggcaaatacgaacaagacaatacacacgggattttgacgcccgtgaccaaggatgatttgaaaaaggccaatctgataccagataacgatggcagctcagagaacggtactcctagtaacccctttgagtctggttctgaacgtgcctctctctctggatcgaacgcagagagtgactcgatcaagaaattaaatgatactgttatcaaaaaatcaagcactctctcctcctctaccaaggacaacaacgaatctacttttgttccagagggtgaaaagtttcgcaagtttcactacagcgatgttgaggcattgagaaataagcgcccttatgatgaggatgatcatagtaaacatggacctgaaggtgccgtgccagtaaacgctgacgcgggagttatttacagtgatccggcagctgtcatgaaagagcctcaggcatttcctccggatgttttggaaaccaatacttggacaagaagaattctacaattcttcaacccaagaaggtcgtatcctttcgacagtgtcaggatgagattcccacttgttttcaacaccagcatcgaatacgatgaagaatatttgagctctgcttataccgatccatgtgtcagagagaaagatcccattgtgtggtgctgtaaggatccgttaggagtttcaaaacagcaaattcaagaggctaggtctaatggcttagatgtaagagatgatttcacaaggtacgatgaaaaaggaaaagtcatattcacttacaaccctcctgattatgaacctgaggctaaaaaatgatgaattagcttcattcttcacttctatctttttctttgatttttttttccctaatgcatacatgatttttacgtctttatataatactgttctattcatattctagcctagtttaattataataatatctataatgtttttttatatatccgcatatctgtgagcttgggtatacagaaaaaaatggcacacgcacccctaaagtaggtggggaggaaaaaggaagtaagagaagggaaaatcatatgagagcatccaaatagatcactctaaaaaatataaacaggcatgaaactcagtcagtcaaatcagagttaatattgtaattatctgaaactagttcctataggttgagtgtctatcaaaaatttacggagacgcgatgaaaattgcggtagaaacgacactattcgacttctttgtcatcgatcagtttaaaaaatctactttttcagcgccaaacaccaaagttgacactattaagggttgtattaacaagtttattgaacaatttaatgtatatgatgagcaacacatattttggcaacctcctggaaaatcaaacgtcagattgctgtcaaacgccaatgactttggccaattgggaaactttttgcataagaaaatcaaatgtaacatttttattggagaagaagcattaaggaaatacgatttaaatatctgtggaccttatgacaaatttgtagaaaattctgaccctagtgttaaaaaggttgtgaacagagatgatgtcatgttgtcgcgcaaatgtttaaacatcatatcggaacaactctctatacttgagaagtccataagtaaggctcaaaaccaagtgttgcagtcaagtgaggttgaaggaaaaaaatgtattatcttgccggaagataaaccagaactcatcaagtttttttctaaatttgaaacgagtgttcagttacaggaggtttacgagggctataaggtatatgaaaagctattacaaaaatttggtgggcaaaaaaaaagaatggagtctttcttgaatgaaaacacgccaatgtcaggtgccgaagctatcaagcaaataaatatatctgaggagctcaaggaaaaaggggaacgtttaacaacaccaaacgatccgttattacacgttgaggtgagtaatgaggataactcgctgcactttatattgtacaataaaacgaatatcataattccaggaaattgtacatttgaattttctagccaaatctccgaggtattcagtatcaaaatgggaccgcatgagataggcataaagggtcagaaagagctatggttttttccatcattacctactcctctctccaattacacaatgaaagtcgtaaaccaggatggagaaactattctggttggtaaatgtgctgactccaatgaaataactctaaaatctccactagcctcattttcgacaggcagtttccagacaggcagtttccacactttgcaagatcctactaatgttttccgggcagacgcgctttcttcccctgatgaatcaagcatcatgagcactccctttctaggcgagacagatgaagtttataattctggctctacattaagtaggccatttacttgggaagaaatataaatgcttttttatattcttccagtttctttggctatagtacttatttaacttttatttatgttttcgttatattttcaacatttccggaaaataaaaaagcgactttttgaggatattatcctatcatctgttgagaaacctaagacagttagtttctatgataataccatctgaaacgtaaacagttttaaatttagcaataaaagctaggtaagaagccgtgaaatttcagtcaacatacagaaacggtatatgtggctccaatcagaaagttccaatactattaagatgctgacacaattaatgttggttttaaaatagccttgaagtaaaagaattcccttgcaatagtaagtgcagttaagggaaaatgtggtaacatattgtaaactaggaagttaaaaatattccaaataaatctgagtgatagtccttgcaacaacgccgttggagttttcttcacacaaagaaaagggtaatgagaacgaatgaagagtaccgagtagtgttaattcaccatttcgaacacaccctctcatattgcagtacaaacaacgcaactatgtatttccaggattttagtgcaatctctggctctccccattcacaatacaatgtgagaatagttaaagcgttatacacatatactaaatagtaactcgaaataagcttttgtccgctttgagaaagtttactattgtttactagacaatagcaaataaacaagaagttagcatcaataaaatattattaaaatttactttatgcgacaaaacaccctgttggtttacgagaaacgttaggttttacagtaattacacattaacgcttttcctctcaaacatggtttaattgctgaagtccttgacattcaaagcgacaactttggccaaaaaagtaagcagacagcgctttttatgtgacatatttctagcaaatctattattttttcagtttacatattttcatctccaaaaatactatcaatttaacaatcctcatttacgtataaaattacaatgctcttgttttcacatttttcgaatatgtttcgtaattgttacgcgttccatttgagaagcaattgtgagttaatcactgtcaaaaggaactcagaacgaacaaaatacctttttcggcatatttttctgttcgtaaatgtttccagtttgttacattatcctttcttgttataaatgaagtctcaaacttttctgacttggtaaacttaaatataggcacgggtgtttaaagccgcccacacatcacattgagaacgaggttattagtagtttgcacatttcattaataaaagcacgttaaacaattcttattatttactaaaaacctactgatgtaacgtaaccatgtgtcaagcatctataaattcttgccaaatattgtcttttgctatccatagacctctgtaaatgttgggcaactcgtatcttaaaaaacaatatcccgtatattcgtgatgtagatgcttcctttatagagaaacatatagcacgctgagagtatcatccattatagcggttccatgcggaacatagcaccaaagaggttattattttcttaattcttattgtatgacccggaaaaggggcgtgtgacattgcatagtatatgtttacctgaggaaaaaggaattcaaggctcacgtaaatctccatgatatgagtttgataaggtgtatcagacgaaagaagactgaatcgaggtaattgcggcggcacttgcttcagtaacgcccaaaggagagttctggtaaatgaacaactcaaagactaaccaacagatgaacacctcaatggggtaccccttaaccgtctacgatgaatgtaacaaattccaactaattgtgccaactttagatgcaaatatcatgctttggtgtattggacaactttcactgctgaatgattctaacggttgtaagcatttgttttggcaaccgaatgacaagtcaaatgtccgaatcttactaaataattatgactatggtcacttgttcaaatacttgcaatgtcaaagaaaatgctcagtttatatcggagaaggaacgcttaagaaatataatttgactatttctacatcctttgacaactttttggacctgacgccctccgaggagaaggaaagcttatgtagagaagacgcacacgaagatcccgtatctccaaaggctggttccgaagaagagataagccctaattccacctctaatgtggttgtgtcaagagaatgcttggataacttcatgaaacaactccttaagttggaagaatcgttaaataagttggaattggagcaaaaggtcacaaataaagaacctaaccacagaataagcggtacgattgacataccagaagataggtccgaactagtgaactttttcacagagttgaaaacagtcaaacaacttgaggacgtttttcaacgttaccatgactatgagaggttatcacaagaatgtgacagtaagacggaaatcgcctctgaccattcgaaaaaggaaactaaaatagaagtggaacccccaaatgagcgctcattgcaaatcacaatgaaccaaagggacaattcattgtatttccagttgtttaacaacacaaactctgttttggcaggcaactgcaaactgaagtttactgacgctggcgataagccaaccacgcaaattattgacatgggtcctcatgaaataggaataaaggagtacaaggaataccgatactttccatacgcacttgatttagaggccggctccactatcgagattgaaaatcagtatggagaagtgatcttcttgggcaagtatggctcttctccaatgattaacttaaggccaccttcaagattatctgcagaaagtttacaggcatcccaagagccattttactcctttcaaatcgatacgttaccagaactggatgactctagtatcatcagtacatccatttcactctcttatgacggtgacgacaatgaaaaagccctgacttgggaagaactctaggtcaaactctatttttatacagcaatgagtaccttttcacatacacataaatatattaaatataataaatacaataaatataaaataacccttttcgaaactctttacttcctaaggcctctcattacttatcacctagcatcatgctcttcatacatgccatctactttcaaacgatatacggctaaccagaaaagtacggacaatcagggacgagcagggacatgacgccttccgcacagatcccagagaaaagcagggaaacaagaaaataagaaaacaagaaaaacagtagttacccttgtaagtgtcatccacaacagaaccaatactcttactcttccgctcattccccgcagaatgatagaactattctaaatccccttgccttgcttggccttgacttgggttgggacttggacctctagaaccgatgtgccttcaaacatcttagcgagataagagtctgccattaatgcatcgagccaatatcttggactagtacgaggttcacgtagcctttcttgcacggcaccagcgtcccaccccaagttctttgctatactgaccgccttacacattttagtgtgattccaacccaaagtagctcctcaaaaagggtcacccgatcggtgaatcaatccgcggcgcagaaatgttcgtagagctctcgtttcttctagaacgctcccttgatgaaacgaaaatttccatcacaataaagctcgcacgcctttttgaaaaccccaagctttgctgtgtcttcttgtgaaaagttttgcccaacgattatctattctacatataaccggggagttaagcacatcctattgccctacattctctccgcttacttcattgtctagagctcctgggaaacaaaagaccgaaaaagcgaaaacaaaatcagaacaaggcttaagtactttttcaccaattgtagcaaacatttaaccacattttagcacactagcatatagcattgtcctctgttattcgttttgcttttctcctttagtgttacttttcccccaacgttacaccattttttgatatcaactaaactgtatacattatctttcttcagggagaagcatgtcccagcccactaagaataagaagaaagaacacgggaccgattccaagtcatcccgcatgactcggacgttggttaatcatattctttttgaaagaattctcccgatccttccggtggagtctaatctaagtacctattcggaagtggaagagtattcctcattcatttcatgcagatctgtgctcattaacgttaccgtttcccgagatgcaaatgctatggtggaaggcaccttggagttgatagaatcgcttcttcaagggcacgaaatcatttcagataagggtagcagtgacgttattgaatcaatactgattatactaagattgttaagtgatgcgctagagtataattggcaaaatcaagaaagccttcattacaacgacatttcgactcacgtagaacatgaccaagaacagaagtacagaccaaagcttaacagtattctgcccgactactcgtcgactcattccaatggcaacaaacactttttccaccagagcaaacctcaggcactgataccggaactggcatcgaaattgcttgagagttgcgcgaagttgaagttcaatacaagaactttgcaaattttacaaaatatgatcagtcatgttcatggaaacattctaacgactttgagttcctcgattcttccccgccacaaatcctatctgacaaggcacaaccatccttctcattgtaaaatgattgactctactctaggccatattctccgatttgtagcggcttccaatccgtccgagtattttgaatttatcagaaagagtgtgcaagtgcccgtaacacagacacacacgcattcacactcccattcacactctttgccatcttccgtttataacagcatagtgccccactttgatcttttcagcttcatctatttaagcaagcataattttaagaaatacttggaactcatcaaaaacttatcggtgacgttaaggaaaacgatttatcattgcctacttttgcattacagcgccaaagcaataatgttttggataatggctaggcctgcggaatattatgaactcttcaacttattaaaagataataacaatgaacactcgaaatccttaaacacgttaaaccatacacttttcgaggagatccattcgacttttaatgtgaatagcatgataaccaccaatcaaaatgctcatcaaggctcatcttccccttcgtcctcctcgccatcgtcaccacctagctcatcatcatcggataacaacaatcaaaacataatagcaaaatccttaagtcgtcagctttctcaccaccagtcatacattcaacagcagtctgaaagaaaactacattcttcatggactacaaactctcaatcctctacttcactgtcatcttcaacgtctaattcaacaacaactgatttctctactcacactcaaccaggagaatatgacccttccttaccagatactcccacgatgtctaacatcactattagtgcatcttcattattatctcaaactccaactccaacaacacaattgcaacagcggttgaactcagcagctgcagccgccgccgcagctgcttcaccatcgaattccaccccaactggatacacagcagagcaacaaagtcgcgcttcatacgatgcacacaaaactggccatactggtaaggattatgacgaacattttttgtctgtcactcgtttggataatgttttggagttatacacgcactttgatgatactgaggtactaccacacacatccgtactgaagtttttaactactttgacaatgttcgatattgacctttttaatgaattaaacgctacatcattcaaatatattcctgattgtactatgcatcgtccaaaagaaagaacaagttctttcaataatactgcacacgagacaggttccgaaaagacttcgggtataaaacatattacacaaggcttaaagaaattaacttctttaccttcctcaaccaaaaaaactgtaaaatttgtgaagatgttgctaagaaatttaaatgggaatcaagctgtatcagatgttgccctcttagatacaatgagggccttactatcattctttacaatgacttctgcggtctttctcgtggatagaaacttaccctcagtactttttgccaagagactcatccccataatggggacaaatttaagcgtcggtcaagactggaattcaaaaataaataacagtttgatggtttgtttgaaaaaaaactccaccacgtttgttcaattacaattaatattcttctcttcagctattcaattcgatcatgaattattactggcacgtctgagcatcgatacaatggccaacaatttaaacatgcagaagctatgcctttatactgaaggattcaggatattcttcgacataccaagtaagaaggaattgcggaaggcaattgcggttaaaatttctaaatttttcaaaacattattctccattatagcagatattcttttacaagaatttccgtattttgatgagcaaatcaccgacatagttgcttccattcttgacggtacaattatcaatgagtatggtacgaagaaacatttcaaggggagctcaccctctttatgttcgacaacccggtcaagatcaggatctacatctcaaagttcaatgacaccagtttctccgctgggactggatactgatatatgtccaatgaacaccctgtctttagttggttcaagtacttcaagaaattctgacaacgttaattcattaaacagttcaccaaagaacttgtcttctgatccatacttgtcacatcttgtggccccaagagcgcgtcatgctttaggtgggccatctagtattataaggaataaaataccgactacattgacttcacctccaggaacggaaaaatcttcaccagtacaacgtccgcaaacggaaagcatcagtgccacaccaatggccataacaaattctactccattatcgtcggcagcattcggaattcgatcgcctttgcagaaaataagaacgaggcgttattccgatgaaagtttaggaaaattcatgaaatcaacaaataattacattcaagaacatttgataccaaaagatttgaatgaagcaactcttcaagatgctagaagaataatgattaatattttcagtatttttaagagaccgaatagttacttcatcattcctcacaatataaactcgaatttacaatgggtttcgcaggattttagaaatattatgaaaccgattttcgtcgccatcgtaagtccggatgtagatttacagaatactgctcaatcattcatggataccttattatcgaatgttattacttatggtgaatcagatgagaatatcagtattgaagggtatcatcttctttgcagttacactgtaacattatttgcaatgggccttttcgatttgaaaattaataatgaaaagcgtcaaattctcttggatataactgtcaagtttatgaaggttagatcacatttagcagggatcgcggaggcctcacaccacatggaatacataagtgattctgaaaaactcacctttccgctgattatggggactgttggtagggccctatttgtttcattatactctagtcaacaaaaaattgaaaagactttaaagattgcttacacagagtatctttctgcaatcaattttcatgagaggaatattgatgatgctgataaaacttgggttcataatattgagtttgtagaagcgatgtgtcatgacaactacacaacttctggttcaattgctttccaaaggaggacaagaaataatattttacgatttgctactattcctaacgctatcttacttgattctatgaggatgatctataagaagtggcatacttacacacacagtaaaagtttagaaaaacaagaacggaacgacttcagaaatttcgcgggtattttagcctctttgtcgggtatcctattcatcaataaaaagatattgcaagaaatgtatccatacctactcgacaccgtttcagaattgaaaaaaaatatagactcttttatctcaaaacaatgccaatggttaaactatccggatttattaacgagagaaaattcaagagatattctaagtgtagaactgcatcctttgtcttttaacttactttttaataatttgaggctcaagttaaaagaacttgcttgttcagacttatcaataccagaaaatgaaagttcctatgttttattagaacaaataatcaaaatgctgcggacaatcctaggtcgtgatgatgacaattatgtaatgatgcttttttccacagagattgtagatcttattgatttattgacagatgaaataaaaaaaataccagcctattgtccaaaatatctcaaggcaattattcaaatgaccaaaatgttcagtgccttgcagcactcagaggttaatttaggtgtcaaaaatcattttcacgttaaaaataaatggttgaggcaaatcactgattggtttcaagtgagtattgcgagagagtacgatttcgaaaacttgtcaaaacctctaaaagaaatggatttggtaaaaagagacatggatattctatacatagatacggcaatcgaagcttcaaccgctattgcgtacctcacgagacatactttcttagagattccacctgccgcgtcagatcccgaactatctcgatctaggtctgtgatatttgggttttatttcaacatcttaatgaaaggccttgaaaaaagtagtgatcgtgacaattacccagtattcttgaggcacaaaatgagtgtcctcaacgacaatgtaatactttcattaacaaatctttcaaacaccaatgttgatgcgagtttgcagttcaccttaccgatgggctattccggaaatcgaaacattaggaatgcatttttggaggtcttcattaatatcgttacgaactatcggacatacacggctaaaactgaccttggaaaattagaggcagcagacaaatttttgcgatatacgattgaacatccccagctatcgtcctttggagcagcggtttgtcccgctagcgatattgatgcttatgctgctggcttaataaatgcatttgaaacgaggaatgccacccacattgtagtggcacagttgattaaaaatgaaattgaaaaatcttccagacctacggatatccttagaagaaatagctgtgctacgagatcattatctatgctagccaggtccaagggtaacgaatatttgattcgcactttgcaaccattactaaaaaaaattatccagaacagagatttttttgaaattgagaaactaaaaccggaagattcagatgctgaacgtcaaatagagctcttcgttaaatacatgaatgaattattggaatccatatccaactccgtatcttattttccccctcctttattttatatttgccaaaacatttataaagttgcgtgtgaaaaatttccggatcacgcaattatcgccgctgggtctttcgtgtttttacggtttttttgtcctgctttagtcagccctgattctgaaaatatcatagatatttctcacttgagcgaaaagcgtaccttcatcagcttggctaaagttatccaaaatattgccaatggctcagaaaatttctccagatggccagctttgtgttcccaaaaggattttcttaaggaatgtagcgatagaattttcagattcctagctgaactttgtagaacagatcgcacgatagacatccaagtgagaacagacccaacgccaattgcatttgactatcaattccttcattcctttgtttacctttacggtcttgaggtgagaaggaatgtgctaaatgaagcaaaacatgatgatggtgacattgatggtgacgatttctataagaccacatttttacttattgatgatgttcttggccaattaggccaacctaaaatggaattttccaatgaaataccaatatacataagagaacatatggacgactatccggaactgtatgagttcatgaataggcacgcgttcagaaacattgagacttcaacagcgtacagcccaagcgttcacgagtccacctcaagtgaaggcattccaattattacgttaacaatgtcaaatttctcagacagacatgtggacattgatacagttgcttacaagttcttgcaaatttatgctcgaatctggaccaccaaacactgtttaataatcgactgtacagaatttgacgagggagggcttgatatgaggaaatttatttctttggttatgggactattaccagaagttgcacccaaaaattgtataggctgttactactttaacgtaaacgagacatttatggataattatggaaaatgtttggacaaagacaacgtatatgtttcctcgaaaattcctcattatttcattaatagtaactctgatgaaggacttatgaaatctgtgggtataactggacaagggttgaaggttctgcaagatattcgtgtctctctgcatgatatcacgctttatgacgaaaaaagaaatagatttacgccggtatcgttgaaaataggcgatatttactttcaagtcttgcatgaaactcctaggcaatataaaataagggacatgggtactttattcgacgtaaaattcaatgatgtctacgaaattagccgaatatttgaagtacatgtttcgtcaataactggagtggcagctgaatttacagtaacttttcaggacgagagaaggttgatttttagtagtccgaaataccttgaaattgtgaagatgttctattacgcacagatccggttagaaagtgaatatgaaatggataataattcgagtacctcctccccaaattcaaacaacaaggacaaacagcagaaagagagaacaaaactattgtgccacctactgttagtatctcttattggtctgtttgatgagagtaaaaaaatgaaaaacagttcgtataacctaatagctgccactgaggcgtcatttggtttgaactttggctcccattttcatcgctctcccgaggtgtacgtccccgaagatactacaacatttttaggtgttattggaaagtctcttgcagagtctaatccagaactcacagcctatatgtttatctatgttttggaggcattgaagaacaacgtaattcctcacgtttacatccctcataccatttgcggtttgtcttattggatccctaatttataccaacatgtgtatttggctgatgatgaagaaggccccgaaaacatatctcacattttccgaattcttatcaggctctctgtgagagagactgactttaaagccgtatacatgcaatatgtttggttgctacttttagatgatggccgcttaactgacattatcgttgatgaagttattaatcatgcgttagaaagagactccgaaaaccgcgattggaagaaaacaatatcgttactgactgtcctacccactactgaggttgctaataatattattcaaaaaatattggcaaaaattagatcatttttaccgtcattgaagttagaagctatgacccaaagttggtctgaactaacaatattagttaagataagcatccacgttttttttgaaacttctttgctggtacagatgtacttaccagagatcctgtttatcgtatccttattaattgatgttggtccaagggaactcagatcatcactacaccagctattaatgaatgtatgccattccttggctattaactcagctttaccacaagatcatagaaataatctagatgaaataagtgatatatttgcacatcaaaaggtgaagtttatgtttgggttcagcgaggacaaaggacgaattttacagatttttagcgcttcttcttttgcaagcaagtttaatattctggatttcttcatcaataatatattattgctgatggaatattcttcaacgtacgaagcaaacgtgtggaagacaagatacaagaaatatgtcttggaatctgtgtttacaagtaattcttttctttcggcacgttcaatcatgattgttggtataatgggtaaatcttacataactgaagggttatgcaaggctatgttaattgaaaccatgaaagttatcgccgaaccaaagattactgacgagcatcttttcttagccatatctcatatttttacttattccaaaattgttgaaggtttggatcccaaccttgacttaatgaagcacttattttggttttcaacactcttccttgaatcacgtcacccgataatttttgagggtgcccttctctttgtgtcaaactgtataaggcgcctatacatggcccagtttgaaaatgaaagcgaaacatcattgataagtactttacttaaggggagaaagtttgctcatacctttttaagcaagatagagaatcttagtggtattgtttggaatgaagataattttacacacattctgattttcatcattaataaaggactatccaatcctttcattaagagtacggcttttgatttcttgaagatgatgtttagaaactcctactttgagcatcaaatcaatcagaaatctgatcattatttgtgctatatgttcctattgtattttgttttaaactgcaatcaatttgaggaacttttaggtgacgttgattttgaaggagaaatggttaacattgaaaacaagaacaccattcctaaaattttgttagagtggttgagttcggataacgaaaatgcaaacattaccctctatcaaggtgcgatactgttcaaatgttcagttacggatgaaccaagtagatttaggtttgcgttgattattaggcatctattgacaaagaaacccatttgtgcattgcgtttttacagtgttattcgtaacgaaataagaaaaatatcagcatttgagcaaaattcggattgtgttccacttgctttcgatattttaaacttattagtgacgcattcagagtctaattcgttagaaaaacttcacgaagaatccattgaacgtctaaccaaaagaggtttatcgattgtgacttcttctggtatatttgcgaagaactccgacatgatgatacctttagatgtaaaacctgaagatatctatgaacgtaagagaataatgacaatgattttatcaaggatgtcatgttctgcttagaggtgttacataaactaatgaaagaaatatcaatatctatctgtaagcatgaatgtacatatctcatgttagggttttcttatcgctaatttttcgcaatttgttacgtgggttgcttttatacagctacaatttttatatattctatcgtgtaatgaatggctcagtaaattcaagcgccacatagactaatgtacataccaatgcattttaattgtaagaataaaaggggccattcatctaccgtcttagttgaaagtgtttctgtgaattttttcaaattccgttttttcctttttatataatagcatggtggcacgagcatcttcgactgaagaatgctcaccttcttgaatggaaatttttaaaacctccctggttaatttctttaagctgggtgttttacccttagcatacaacttcctgaatgggaggtgtcttgaagtgtccctgagtagtgactttgggtgggataacatcaatgcttcgagatcatgctttaaagcgtgccctacaagaattctaccttccagaatatccgcagtctttttttgagcttctttgaatgtaatggcatttttcatatgctctggtttaataccactaacccaagttctccattctacaactttctctcttggcttaacaaattcatcgaggacgacatgtccaaaataatttacgattgatattctagctaacgcagactctttaccctcgggaccaacgcctacaaattcacaatccatggcgatgtatttcccaatttctttactcttattactattaatacgagtatcttccgaaatacccacttttactggctctttaatagtagtactagtatttgctttatttgggttgaattcaaacacttttccctcgagcttgtctttctcatgcttactaatctccttgttcatgttatataccatgtccataattttactgccgtttttgcgctttcgaggggcatattgggttgtactactgacatttactgttttgctaactttcttaacgtttctgattttcctatttgattgcttattctttccattggaggtaggattgctttcggaggctaatagtgcctgccagtttgaagagagagccattaaaactgtacgctatctactttattaaatctgtaaacgtctatgaagcctctagaaccaggctttaaatggattgtggttgcgatgaggttagtttaacttttgaaatttttcttttttttagccgaccttacatatcagcccgcgtcaaaaaatatacggtataataattctcaatagatacaggctactgaacaggaaaactaaataaaacagtgtttgtaaaacccccaccacaccataataagacgataatggacacggtgacggtattaaatgaactgcgggctcagtttctacgagtgtgtccggagaaagatcaaatgaaaagaataataaaaccgtacatacccgtagatgaattcaacacagagcagtgcttagattcttctatccgtgaattatatatgaactcagacggcgtaagcttgttacctgaactagagtctccaccggtatctaaggattttatggaaaactatgcttcattagggaaaatgaggataatgagggagaatgaaggccaaaaaggaaaggctaaccagaatttaataggagcagagaagactgaaagagacgaggaagaaacacgaaatttgcaagataaaagtgcaaaaaatactctgatagttgaagaaaatggaacacttcgttataatccacttaattcatctgcgtcgaactctcttttaaatgatgacgaccataccagtggaaaacatcacaaaacttcctcaaaggaagactcatatttaaatagttcgatggaaatgcagaagaaatctagtaagagatcgtcgcttcctttcgtgaggatattcaaaagtcgaagggaccactcaaatacttctggaaataaaaatgtcatgaatacaactaatacaagagcaaaatcatctactttgcatccacctggtgctcgccataataagaaaggcagtaaattcgatatgaacttcgatttcgatgaaaacttagaagaagaagatgatgacgacgacgatgacgaagaaggtgacgatatacactctcaattttttcagttagatgatgattttgatgctaagggttctggagcaagtccagcccacaaaggcatcaacggcatgtccaacaataaaaacaacacctacacaaataacagaaacagcatcagcattcttgatgatcgagagagttcaaatggcaatataggaagtgcttcaaggttaaaatctcatttccccacaagtcaaaaggggaaaatttttttaactgacaataaaaatgatggacaaaaatctgattcactgaatgccaataaaggtatacatggagatggaagcagcgccagcggtaacggatcggtgagtagggacggtttgacggaaacggaaagcaacaatatttccgatatggaatcttatatcaatgaaaaagatttagatgatttgaattttgatacagtgacctcaaacataaacaaaacagtatctgatttgggaggacatgaatctacaaatgatggaacggcggtcatgaacagggattcaaaagacagccgcagtaatagcaatgaattcaatgcacaaaatcgtgaccgaatcactcctggctcatcatatgggaagtcccttttaggatctgaatattccgaagaacgttattctaataacgactcgtcaaccatggagagcggtgaaatgtctcttgattcagacatgcaaactaatactataccctctcattccataccaatgtctatgcaaaaatatggcatctatcatggcgatgatgactctaccttaaacaatgtcttcgataaagccgtactgactatgaattcatcgcgacacccaaaagaaaggcgcgatactgttatatcaggaaaggagccaacatccttaaccagttctaatagaaaattttctgttagctcgaatttaacttcaacaaggtctcctcttttacgaggacatggaagaacttcatcgacggccagtagtgaacacatgaaagccccaaaggtttctgacagtgtattgcatagggcaaggaagagcacgttgacgttaaagcaggaccattctcaacctagtgttccatcaagtgtccataaaagctcgaaagaggggaacatccttattgagaaaaccaccgattatctagtgtcgaaaccgaaggcctcacagttatcgaatatgttcaacaaaaagaaaaagagaacaaatactaattctgtagatgtgttagaatatttttcatttgtttgcggagataaagtaccaaattatgaatcaatgggtctcgaaatatacattcaagcttccaaaaaatataaaagaaattccttcactaccaaagtccgaaaatcgtctaccatcttcgaagttattggatttgctttatttttgtattctactgagaaaaaaccggacaattttgaagaagatggattgacagttgaagacatttctaatcctaataacttctctttgaaaattgtcgatgaagacggtgaaccttttgaggataactttggtaaactagatagaaaaagcactattcaatcaatttcggacagcgaagttgttttatgtaaggttgatgatgccgagaagtctcaaaatgaaattgaaacacctttaccatttgaaactggtgggggcctaatggatgcttctactttggatgctaacagcagtcacgatacaactgacggaaccatcaaccaactaagtttctacaaacctattataggtaatgaagacgacatcgataagacaaacggttcgaaaatcattgatgtaacagtatatttgtatcctaacgtgaatcccaaatttaactatactaccataagtgttttagtgacctcacatataaacgatattttggtaaaatattgcaaaatgaaaaatatggatcctaatgaatatgcattaaaagttctaggaaagaactatatactggacttgaatgatacggtattaaggctcgatggtattaataaggtggaactcatctctaaaaaagatgcaagggagttgcatttggaaaaaatgaaacctgacctaaagaagcccgttttgccaacgatccaaagtaatgatctaactccgttaactttggagcctctgaactcttatctcaaagcagatgctggaggggctgtggctgccattcctgaaaacacgaaagttacatccaaagctaagaagatatccacgaagtataagctgggcttggcaaagcagcattcgtcatcaagtgttgctagtggaagtgtttcaacggctggcggtctcgccaatggaaatgggtttttcaagaacaagaattcatccaaatcctctttgcatgggacactgcagtttcataatataaaccgttctcagagtacgatggagcacacgcctgacactccaaatggagttggagataacttccaagatctttttaccggagcgtatcataaatataaggtatggagaaggcagcaaatgtcatttataaacaagcatgaaagaacactagccattgatggcgactacatatacattgtacccccggagggacgtatacattggcatgataatgtaaagactaagtcgttacacattagtcaagtggttcttgtcaaaaaatccaaaagagtccctgagcatttcaaaattttcgtaagaagagaggggcaagatgatatcaaaaggtactactttgaagcagtttcaggtcaagagtgtactgagatcgtgacgcgattacaaaacttattaagcgcttatagaatgaatcataaataagtaaaacccattatactgcatcttaccagcattaattttggtttatatctaaatatggtatagaaaatacttcatcgcgatctcgatggtgattggtcagagtccgcttctcgatgcaaagggaaaaaaaagagctttttaggagcaagtccccccatagagcacataactcgttagcattgaataaggccaggtgacttcaaataataatttataactacgacaatgggtgctgcttatcatttcatggggaaagctatccctccacaccaactagccattgggacattaggactgctaggtttattggttgttccaaatccttttaaaagcgcaaagccaaaaacagtcgacatcaaaacagacaacaaagacgaggaaaaattcattgaaaactacttaaagaaacattcggaaaagcaagatgcgtaaatatagcttgattgctgcgcggttgaagatcttttgtacatacaataaatattctttatatatacagctttcgatattcaagatttaaacattaaattattaaaaagaggtctataactagacagttgctacatccactcttttcttgttatatctttttaatatacaatgttatgtaaaactctctgatagtattatgcttattatttaaacaaggcatcgtttgataaaggatcggcggcaagaacattctctcttctcttaatttttctttccacagcagcttcagctctagactttgcctcctcagcagcttgttgtttaatttgagctcttacgacgtttggcgaaacatattgtttattttcatagatctttggaccaccaaatgaaccttctaggatcaaaatgacagtcataacaaacctagggccaatttccactaatgatatgtcttcttcgccatcttcatattcttctttgttcttagtactgtgtgagatctcatatgtcctcacccatattttatcatctacaatactgaaggacatgacgtgatcaataaatggcttagattttctagcatttggtggtacacaaaaattatgcactagcaactccttaattaattggtagtgtggggaggattcgaaacgttgatcaaacgacaataccggacgagaaccctttaaacagttacctgtaaaattcaactcatccatagtatgcaagttttgaatgtaaaattttatagttggcccatttggcggcttggataaccatagatacaaatcttggtgttttctggcctcaaagaatagaacattattacaattgtacaactcagcgatttcgttcaactgttgaagatcctttttagtatccaattttggctcctttctggaatgaggcaataatccgcttaagtcttgaattaaatgacgatgtctatagttaacacctctactcgaaatcagaagagttctttgcttgttcataaattgcttgacattgccttgcttcttttcagatttattatctttgctctttcctgcgagggctttgtagatagaagacatctttggttgaactctttcaacacctgacgaatgtataaagaaagacgtgaagcaaaataaggctaagtaaccttctaactcgtaaatattatagcaatttctgtatctttttaggtgatagattctttgagaaccatcgcgatgagcatctaaaatttttcagtcacctttaacgaaaatcactgtccacggaccgccgagggctttaggaaaataaataataaatgtcagctgcaacagaattcattggcgaacgaacgatacataacgagctcggtacagcaatcatcgcatcgaagcatgtccgacaagatacaggaggagatattaggactagtaagcaggtccaacttcaaacaatgctatgcaaaactggggcaattgcaaaaacaatttcccaatgcgttgtacttcaagattttggaaacctatgttaaattcaagcagtcacctggtaagttcgattacaataaactgctagaagaaccatatgggctgaaagggacaacgattacgggcgacacgcgttccttggagtttttgcacaacttcttcgtagagttagggaaatacgacgaagcattgcacgtgtatgaaagaggaaatttcaaattccctagctacgaattgtcttatcactggtttatgaaagcattggaagattccaattataaccaaatgagcaaagcatctctacagctagctaaatacagtgacagtggaaacctgcctaaaagagcatattatttttggaatgcaatctcgattttagccgtatcaaggtttcaggaaaacactctttcagatcccaagaaaattttgctctccaggctagcgcgccagtctttgttagacttgaaaccatttcaaaatgttcaagagattatagtttattgtttggtgttggatgaactattccctcaatctagagaaatctcggaagagattgttgcgattacctttgccaattttgatacttcagtaaacttgtatttgaaaaactttatcttgaagcataccaagttattgaattctccacaaaaactttttgaagtttgttcaaaacttattgaaaagggccttgatgattatgaattgatcacaaacttgattgatgctgcctacaaactttctaaatctaaagacgaagtcaaacaatggattgatgaaaatttgggagactcaaggaatactcgattggcgcgcttgaaacttgatataatgtacaccgattcggtttcggaatcatctttgtcgtactatttatcaaagtaccataacaaaccttgttgttcaatcgatttgaatcattacagcggccacattaacatagatatgcttaagagcattatgtctaagtacgatccagaggataaggatttgattcatcattgtaatattctagaattgggacttattggaagcgactcaatcaataactataacaagtttaaggggaccctggaaaaaaaatcggtaacggattattcctcctgttctacattcttattagaaatagtcaaggacaagtgcaagaaaactaatcctgaattgaaagacgtgcttttgtgtataacgatattggaaaattaccaagccaaggaccctcataacttcgatactatgtgctggctgattgttttatacatgtacctgggtttagttcccgatgcttatttccatttcataaacctaaagattaaaaacgttcaaacagattccctagattacatgatattctcgagattttctactttgttcccgaataaacagagcgatttttactccaagacattccatgaacataataatttatacgatacatcactggctaatttaccaagatatattcaggtggcattcgaaagaaattcatatagcaaaatactaggaatgctcgagatgagggataaactaatgaaatcctatacaagatggaccaaaactttagaaaacttacagttctcacgtttatgcaacgacaagcgcggccacctactacaaaaattacacgaagattggagatctttagaaatgacgcaaagtgtatcattttctgacaatagagacttttccatattagatgaaaattttgcccaatttcttaaccgtggtaaaattttggaatatgctaacttgaatgaagaatcaatttttctaactttgataagagaacttattattgaagctttgccaaatggggagaaaacggaacaaataagtgcgctcttaaaaaaacttccatcaattaaccttgaagagttgttgaataataatttaactgaagtggagtcagcgtcatttctgatttttttcgaaatttacgaaaataacggtaaaaatctacatgatttaatttctaggttgatgaaagtcccaataaatgcaaaacaaaactggatggtatcccatacttaccttactaaaatggcaaccttaaaaacactagacagtttgaagagaatcaaagataaagaaattcaaaaactaatcaaaaactccctcaaggagttgaggagttgttgcgatgatgtatttaaaggttattctaaagctttagtacaagcatatgaagaattaaaaaaagatgaatgtggcaacttgttaaaagaacttgatgttaaagctgaaaatgtcaagaacattaaaaattcattactaggcatccaaaaaagtgtaagaaatttatgaacaaaaattacatctccattatagagcagtcgcagatagacaattttcttttatttttttttttttaggtagataaaataacatgtatcgcaagacttttatatcagcagccttttcaagctccataatttctgaaagaaaaagtagtatatgatttttgaggagaataaatttcaaaaaatcataggaaaataataacgatgttcctcccgttaatttacaggtctataagtatttttccaatcaccattttatccactccaattttgcttttaaaataaaaaatgcaataaggcgataaattatggctacgcacacaatgattcccaggtacttttgcgtatttctgactaaaccataagaaaccaacacatcatggccattcgcaaattcacaagtaccgtctgaatttttcccgccatcttcgcaggttaatttcaaattacctgggaatgcgaaattaatgatgatcatagatgtataccctacagggttcaaatagttaaaaccctttaatactctcgacatgcctagtgacattaaccctgacatctgagtaccaatggataaaataatggaaatgcagttaacgacgaagcctggcctttcgaaaaatgtatttgtcattataccaagacgttcgccacaacaggtaacaataaaggaacagtagacggttgcaaagaagttgcctgcagttcttggtaacccacatgccagtactgtaaataccgcgtataacactgaagctaatgcggatagcggcaactctaatgtcatataagctaagaaaaaaggtgctataccataaacattatcattatattcttcgtaaaagtaatctctttcagttggataacatgccaagttccccagcatgcccacaaaatatagtgctgtagattcttgtgccaatcctagacgattgctaatacttgtataattatgcttgactggggcaaagaataatgcgaaaataacacctaatcctggaatttgtgcaatacgcgccatcaaagagtcaaaacttctccttgtcgtagtaaattgccttttaacgttcactatgtacgccaaaaccaaattagctggttttcttacaaactcgctgtattctgtgaaaaatgactcctgagagtattgttgtttttcagaaattggggttggtgaaaggctttcgttatccatattagctttccatgcactaagtatcttttctactcgtgcccttgagcttatttcattctgttcgttctgggtattaactgaaattaaatcaagaaagaaatctgccacgttcgtaaacgaaggacagttatatcccaattcagtgaaataagcaatcatttcatctggtgatccattgaaagcagttctacccgatttagctaatagcaaaacattaccaaatctcttgaataattctgaccttggttgatgaatggtaatgatgatcgtcttgccctgttccctacataacttctccaaaatttccagtatagtagcggatgtgaagctatctaaccctgaagttggttcatctagcaataatatcggaggatcgtttaataattgcacacccatagttactcttcttttttcaccaccgcttatacctttaacaaattcattaccaatgatattgttttcacaatgctttaaacccaaagaccttattaggttgtcagttctctccattcgttctgcctcagtcagatgatgcaatcttaatgcagcggcatatttcagggtttctttaacggttaaagctgccaaaaggtggtcatcatcctgcgagacatacgagcatacatttttaaacataagctctgaaacttgaatatcattgaacattattgaacctgaagtgtcaaatttggcaaagaccgaagattttaatcttccggagattaggtttaacagagaagactttccagaccctgatggccccataattgcattaatcattccaggtttgaaaatggcattaactgattgtagaatttcttttgtttcatggtggaagttgccttctttccagtttgagaaaggggcagaaaaaatgactcgtaagtctatatcttctaattttatagtaatatgtatattttttcctttctccgcttccaaatctttctgatgatacacgtcatctagcagctgaatctcgggtttcattcctgttggggatttctttttgatttttttttgcttcgatttcacttcattttgtaaagttatatcaatcttgtgcaaatataaaataattgcacctactacaaaatatcccacagaccagcaaagtaagacaacggcaggtacggttatccaattcctaggaaacccgtaaacttccaatatctggttacccaagcactcatcgagattatctgtagtacagtacgaattcgtaaaggtgcttgacatgagagtaccgaatgaataccacgtaaaggcaatatatttaatccaacgaacatacacgggcattactttagcattaacgaaaaaaccacatcccatcgataataccgtaaatgtcatatttcctactaatgaagctttagaaaaatctctcgataccgccaccgataacatagataaaccggaacatgatagctgacataaaaatacaacagcaaactgataaaaaaacttccttgcatctgcttccaatccaaacataaaatatgttatactgacaaaaatcatggtcatcgcgaaatcgtcagagaggaaaagtgaaatttttctagctacgatgaatgccaaaggtgttaccgagccctctgctctttctctgtcatataacgcaatatcctgctcacaaagtcgataagtatcaaaaagcaaatacaagtaacattgcaaaattgtggacgcgtaaagacatgcggttgttgtccttaaaccacctatactgcttttgtcaggtttatagtaaatccaaccgcaaacagtaccaataatcaacggttctgcaaaagtagatattaaagtaacgtaatctgaaaaatttaatttgaaatttcgccttgttagcaccgtaacttgcttccaaaatggcagtctggtagtcatattctgaatttgaatttccgttgcgttgcttatataagattctgcctgtagttgcaaatgagttctctcataatcatgccaatgatcaatcaatgaatttagccgactttgcgtggcagcttcttctttatcagatctagagtctacgcttgataaatcaatgaaataatctgctggatttaccagctggggtacgtgataaccaatagactcaaaataagggatagtattatccattttgtcacaatataccacatttccctttgacaaaatacaaacctggtccaataaaaacaatatatccgatctcggctgatgaattgacatgataaaagtcctgccatcttctttagctaattttttcaaagttttaataaccaagaaggcagaatatgcatccagtccagtggtaggctcatctaagaacatgatggaagggtttgaaatcatttgagtaccaatacttagtcttctcttttcaccaccagaaagacccctgtgcgagttgtccccacaagagtatcggcacaatccttgagccctaattcttcaattaattgctcgaccattaatttcttggttcgctcagaagagtttagtttcaaatcagctgcaaacttaagagtttctctacaagtcaacctaggagagagtacatcttgttgaggtaggtacgccattattacgtgtttctggatgggatggtcttggccatccaagtgagccctcttaggctctgtttcattgggttctgaacctgtatcttccaatacgtaccgtatagaaccattatgagttaacccaccactgatcttggatgccagaacattcagcaacgtagtcttccctgaccccgaaccacccataactgccatgaccgacccactgggcaggtccatggaaaacgtattaactagcgtcgtatttgttttggatgcaacgattgacaaatcccttacatgaaggcttattctagggattcttgagaaggaaagtctattttcgattaattcagtggccacatcaccattctcctgctgtgacatagtggctgcaagtggatgtttggcgttggtgattgtagcttaaaatacgatgatcgtttgaaaactgccaagcacttgtgcctacttctgcatttacatcacaaattcgtttatctcatcactagatccttccttttttttttttcactttctgatatttcgtataagtgtcaacccaacaatactaaagccagacatatgatagaagtaactgcctcacatggctgtaaacgatgttgctaaaccgttgctatgtttatttgtttatgtaggtatatgctgatataaatcatctcctaaaggtatccaaaaattggactcccagtggtcttgcaggttcatcggcaccaggctcgtcatcaccagcgctagaggtatttgtaggggtggtgcttgaaccacgaagcggtaggcttgtaggcccagagttgcctgtatttccatttcctgtagcagcagtagctgcttctacagtggctcttgctgctgctgtattcgtggccgcattggccgctatagcaacgttagccctcgtgggtgggccttgagagatgaaataggatacaaacggtattctccaatggtctaatcccggtaacaggcccttatcgatgaaaataccacacatccagcttatgaatccgcatagtattcctgcaaacccctgatttaatataagcaggagaattaacccatttaaaagaaactgatcgttgattttccactctacggcgctcttgtcttctcgcttgttatcattgtgacttgatgctcctcctcgaggtcctagtaatcttatattccattcgtaaatctgaggggtgtattctttgtaaaaatgtactaagcttaaaacaatgggcagtgaacctgtactaaaattgttccattgaagccacttgtactgtccaataaatgcgttccagatcagattcaatccccaaattcctaaggtggtgtaggcccatgacaaaacaatcaaggtcaagtacttgtgggatcctagtagccgttctaaatgcctaaacagataccatatcaacgccagtattactgtatcggattcattgatggcgcagaactggaatatgagcagacggtagtattgatggtaggtctgcagaaaaggatcatattgcaatagaaatatatgtttgtaacttgcaatcgaggcaactaagggaaccacaagcgtcgtgatcatggctagcttggtgacgggcatagccgtaagccccacaggaggctccatagacattatttgtagactattgtgtttgctttttatgtcgttgactttctctccctttaatagttaagtttatacgtcaaatttctcttctatacttttccaaaaaaaaaaaaccatcttcacatcaatggcattcaaagtaagaaacagggcagggataaaaggatagatagcaatggacatggccaaccagttgctagatgaattagcacatggaaatttttcccacctaacgctaaacttgtcccaaaatggtagggaaattgctatcttacagaagcaattgaccggatttgatgataaacagctagaaacgtttgtagaacaacacccggctatgcccaatgatacgagattcaaaatcatgtgtacatcctttttaaattatgcccgagatgtcgacccatggtcagcctggtccagttcggatctaatttttgagttttatcaatgtttaatcaactgtctcatcaacgacaatgctcctcacatagaaatgttgataccagtagcaactagagaaacagaatttatcatcaatctcgctgggaaactagactctttccacttgcaactgcatacgagaagtcaccaatttctatcacatatatcgtccatcctatcaagactatttaacagcatcaaacctccacgaggtaacgcatcttctacaaatatacctggaaaacaacgaatactgctctacctggtcaataaactaaataacatctacttcaggatcgagtcaccgcaattatgttccaatatctttaagaactttcagccaaaaagcatgcttgcacatttcaacgaataccagctcgaccagcaaatagaatacagatatctattaggaaggtactacttgttgaactctcaagtacataatgccttcgttcaattcaatgaagctttccagtccttattgaacttgccgttaacgaaccaagcgatcactaggaatggcaccagaatactaaattacatgatccctacagggctgatactgggaaagatggtcaaatggggaccgttgcgaccgttcctttcccaagaaacaattgataattggagtgttctctacaaacacgtacgttatgggaatattcaaggcgtgagtctctggctgagacaaaacgagcgtcatttgtgtgcaagacagttactgatcgtgctcctagagaaactgcccatggtaacgtacagaaatctgattaaaacggtaataaagtcctggaccaccgaatggggtcagaacaaattaccgtactccttgatagaacgggtactacagctatctattggtccgacattcgaggatcccggcgcccaggaaattaccatttataatggcattcactcccccaagaacgtcgaaaacgtacttgtgacactgattaacttgggacttttacgcgcaaactgtttcccacagttacaactgtgtgtagtgaaaaagactacaatgatacaagagattgttccgccggttaatgaacgaatcaccaagatgtttcctgcccattctcacgttctttggtgatatgtagatatatataggaaatagaagagaaggagcgacattatgctgtttcttacagatttcataagagactagattttaagtatatttaggatatataagaaaggcgaaatttgtaaaaaaagaacaggaggaaaaaagggagtacactttaaaaaggagcacataaatgcacaatatgtttccagcactcacaaagacactgtcgttgcaaggctacaagattatcaactctcaaacagggtccgctgcatggtcgtgcggtcgtaggtggtttagtagtgataaagatgaccacgacgatgtggtgacgaggattaaaattgcccccataaagagaactaacgagccattggataagaaaagagctcggttgatatatcaatcacgcaaaagagggatcttggagacggacttgctgctatctgggttcgctgccaaatatttgaagaagatgaacgaagaggaactggaagaatacgattcgctattgaatgagttggactgggacatatactattgggccacaaaaaatttcaaaaccagccccttgcctgacaagtgggccaattctaaattgctgaagcagctacaagaattcagtgaaaataaagagaaggaaattttaagtatgccggacttgtccaagtatcaatgaatacaagccattgaattactatcacttttttttatttgtatatgacttgtaaataaaccggaagagaaagaaacttatatattaccactatactatactatacttattgctattattattattcattattagtattataatatattattgatattgatattgatattgttattgttattgttactaccactgttactattactattattattgttgttgcaccatcaaaacccttcaagagcctttgtagctttgtctaatcttttcagtccttcttcatagcggtccggatcaagaaccatgtctgctgttaacctggacaaagagtctactagtctctccagggcacgtttctcctcaattttcatccccagttgcgcaaattcagacccgattaaggttccctttgtcacactcaacagttgatttagtgtgtcgatatcaaaggatcgcaattccttcacagatttttttttattgagcttttttttcgtatccttcttgagtttagttttcttgggcgtttcctcaatgatgtcctcgtacatgtcatcatcttgtttgtttgtcgaagtagaggtatgatttgccctatcatgaatagccttcaatgtgtcgtcacgtttcaaattcgatgtaactctgctatcctcattgggtgtgctgggcaatggtcttgtcaagtaagtctcttcctctggaggcatactcgttgccgcagaatagtaagattccgatttttgttcactaactgtggaaatctgagatgagttcttatagtggccaccaggttggaccggcgttggtaatatttcttcggttaaaagatccccctcgccatcaccttcttcgatgaacaaccttgacctaggacggtccttacttctgggcggaatagttggattgtagtcattggtttcagaacgtattgggtttatcgctttgggtgcttcgttggtggttgtatacaactcgggtatgacactggaaacaattgaaagcttatcgctaacatttccttcctcttcttcttcgagctgctcttgaatagattgatggaatttggtattataagtggaagatccgctctcgctggccaaattacctgatcctatagaggaacgcataactttttcctgacgtagaggactagataacagtttcagtgagccacgaccctctactttttttgaagtgttagagttaaaccttcccacaggtttggcattagtaactggtttaatgacaatttcgtctgcattggtattcgattttgtgctttggttatcacttagatgttttgtcaatgtcgcttctgaaggcaacatgggcaacgacggtaactcgttcttgctcacgggctctttcaaggagtacaaactattggaatccttacttgtgcgccgttcttgggtctgttgccggtttttgaccacatatgatacttcaacgccttcttgaataattccagagtagttggaaatcatacttgatctgttatcaccaggtggcagcgaaacgtcaccagcaggtgatctcaacaatctcgatggtggtttaaagacatcactttgatccgccttttcctctgtgatcattgtcctggtagttgtgggagatggaaagagcctgtcatctttctcattgttcagtgaatcgatcattgctgaaagtcgctgcgtattcagcgtagccctagatatcccgttttcttccctctcttctgacatacttatacacctatctggttttgataatggtcttcttgttagtcgaatatatcagcgttctttctcttcttgatggtgccagccatttgatcaaaagatcgcttttccgaatcgggacatgtaacaaacaataacaattaaaataaacaatattatgaaaaaatactggtaaaaagcatgtactgaggagaaaggctccagcatcccttgagcaaaatgagtaggaatcaagatgtgttccccattttggatctacaggaactagttatatgtttgcaaagctgtgattttgcgctagccacacaggaaaatatctctaggcccacctcagactacatggtaaccctttacaaacaaatcatcgagaacttcatgggtatttctgtagagtcgttgctgaatagtagtaaccaagaaacaggggatggtcacttacaggaagagaacgagaacatttatttggacacgttaaatgttttggtattgaacaaaatctgctttaagttctttgagaacataggtgttcaagatttcaatatgacagatttgtacaagcccgaagcccaacggacacagcgcttactgagtgctgtggtgaattacgctcgttttagggaggaacgaatgttcgactgtaattcttttattcttcaaatggaatcgttgctgggtcagcttcgctccaaattcgatgattataacttgattcagcaacagctaaagcaatacgaggacgtagatggggataatatacctgatgagcaagagctccaaaagctggaagagcaaaataaggagctggaaattcagttgaagaaattgaccaagatccaagaaacgttatccatagattataatgactataagatctccaagcagtcaatctttaaagatctggaagctctgagtttccaaatagtggaattagagtccaatcgagataaactgatcaaaatatccaatacagacatggaagagttatccgagggaatcaaagagctaaatgatctgttgatacaaaggaaaaagacgttagacgacttaaccgcacaacagaaaaacttgcaagatacagtgacgacgttcgaaaccataattagtgagctctatgatgtgctgagaataatttccagcgaggtgcaagagtctaatcgaactgaaacggaacttgtgggattaaagcaaaatttaatcaacaataagctgaaattgatgaatgtattggaaacaggtattatgtataaattagaaatcttacaagaacagttagatttgcaactcaagaatttggaaaagctatcgcaagatactaaagaagagtcgcgcctaaatgatactaaattgatggatctacaaatcaaatatgaaaatgaaatcaaacctaagattgacaaaacggacattttcattcaagaggaactgatcagtggtaaaatcaataaattaaatgatgaaattaaacaattacaaaaagatttcgaagttgaagttaaagaaattgagattgaatattctttattatctggtcatattaataaatacatgaatgaaatgctcgaatatatgcaatagcagcggtatacttatttttactcccccttctgtgttttcttctttttttttttttttttttttttggaatttactgttgtttctttcgtggctgtttcttaatcttatacgtacctttatctatttccgtacagttgtaatctatcttctttagatcttgccattttttatgcggtatatcccaatggcattttttagctacgagactggccacgtcatcacagaatcccaacaggtttaagtcaaactctgcatgtgtaaccatatccctattgatcaaaatctgcggaacatgtgaaggtaccatattgacaatttcagacacaggagccactttcaaacttgttcctatacaaatcaatagatcgcattccagtatatctttgcggatggtcttatgaaatcgcgatggcagggcctcgccaaaaaatgtcatgtctggtttcaaaacaccatacgactttaaaatgggtgagttgaaatttatgtttgtttgcaccgtattattgccattactcataggaaaatattgttttcttttttgataacagtagggacataatggtagttcaaggtttctaatattttcgaatattttctcaccaggtatttgccaatggcaagtcacacaagatgcagtggcgaatgaaccgtgacattgcactaatttatcaggatctatccctgcatacgattctaagttatctatattctgtgtgtagtttcttaatagtttgcccttgtcttgtagcattttaatgaagctgtgcaacggagaatacatgttctctggtggtaaaaccatatgggcaatattgtaaaaaacagaagggtcctgtaagaatatatccaagttgaaaacatcctgagggtcttccaatccaaggtgtcggatcttagaataaaacccctcagatgatctaaaatcgggaatacctaaagaagtggaaactccagcgcccgtcagaaccaaaatttttttggcgttacgcaaagtggcggtgaaatgatcaatcgtattgaagttgggtaatcgaagccttgtactaaggactttatttatggctttttgtaaatctttgattaattttactgcatgctttttctctaagggatcggtcaactcgtcctcatcttcagcttttgcatgtatagacgatagttccgcactagaacgttctttattagaagtgatattagagtttaacgccataaatagttctttatctttgacgtcgaatcccagcaattttatcatgaaataaatgtagatcgagttgacttccactggcaaaaaatattctaaaaaagttttcaaatcgttgtccttcaaaaacagtcttgcattcataacatcatctttagtgattgcaggaaagatgaatttgcccgtcaccttatccttcccgaggatacaagggtacgttaatctcgttttcagcttcttcgtagcattattatctgactcttcttcttgaggtcttttcaacattgtcatggtcagctctccaacatgaaagtatcgcccttgactaaccaccaaaataaaactaactatccgttgcattagcaatatgttcatttagatttttttttctcacaaaaacaacaaaaaagaagagaagtgttcgtatcactaccaacgagggttatcacaacatagcaatagtgagagtcagaagtacttttagctaccattaccgtactcaccataccctccgtactcgaaggagctcaacctctttgctggcggtcttactgagtcatcatttgttgcggccagcggtcccacgccaatcctggacagggcgacttcagcgctggtgttctctaagtttatatcgttgacaatggtgcctgtctgcttggccaactgagtggccttcaccatcagttccacctcctctctgttctgtgtgtccacttgattttgtagatgtgatatgtactctaccgcctgtgtgagaatttggcccttgttgggctttccgtccttggtccctgtacctttggccttgctggacaacccaagcgcaccgggagtggattcacttaacgtgtcattgctaccagaattgccgtaataatctctaaagaagtctttgggaatgatactcaatagttcttgaatacggtcgttgatcttatctctgcgcttgcggtcattcttgaaattagcaccgcaggacccaggatcagtgccagctggaatgctgctcatgtttggtgttgtgctttcttttggttcactatctagtgttttttgtctgtgttgtggttgaagttaattccattctttttactcaaaattttcggtggcgcctttttccgtttccagtaatgagtggttattgtagatatgatgtaagattacatgataatatatatgctaaatagtctaagctttgtcgtcactattatcgtggcctttgaaggcaatgatggtgcactcctcctcgtagcctggtatttgtatgtagttcacaccgtgcgattccagcttgttcaaacttgtattgtttttaacaaatgtatcgggctccataacccccacgaagacagtaccaatggcaccttgggtggccaggattctatcgcagcaaggctcattgccacttagcctgaaggaacagggttccatggttgtatagagcactgttcccatagggactatagtgggacagttcgggtgtaactgcgagtactttatcaaagcacactgttctgcatgagtgtttcctggtagctctcttgaatatcctgtggcaagtacttgagttccatgaacaagaacggcaccaacactaaaagcagtctttgtcgggccacacttaccagcttccttaacggccatttccatatatcggcgatgtggctctaaggcccattcagggtattttgttctataactccagagaggtttttgcgtatccgaatttctttccaatgactcgtaccggaaggcatgcagccagaggtcgagatcattagtaccgggatctgtgtacatttcagcctcgcattcttcgcactgacggccaagcaagtattcaccctcgctatgaggatgaatccagctctctgcaggattagtcttgccaatagcgtctagtttcagaacgatgtcatcatagttttgaagtccaccgcggcccaaatctggaccccagatatctgggttcgagtatatagggtcatttgctatgggaaatcccaagtactgcaaatggactcttatttggtgagttctacctgtcaatggtttacactttacaatactcgtctgtccatcatagctaaccctttggaaaacggtcttggcatgtttagcgttttcatcgctcatctcgcaaacagcgtttagtgcaactttagggttaacagatctgacaggcttatctacctctactatacctatagggaactcgcccttcacgcgggctacgtattctttggtgacttccctcgctttcatttggtctcccattctatctgcacctaatggagtcttggctaaaaacattagtccactagttggcttgtctagtctattacatggatgtactgaataacctagctgtctttctagcatttttgtaatggtattgaatctgtatctgcccgttgggtgcactggaatactgctgggtttatcaatgacaaggatatcttcgtcttcaaacacaatatctattggtttagatgtgactggcggttcatgtcgatgtactttatgtgtgatcagatcaccgtcacgaatgatggtatcaaggtttgcaggttcatcgtttaagtatacttttccctctgcaatggttttggaataatagctgggctctcgatccctgaattcgctcacgaatacatccaccaacttacgatctctccacctctccttacagaaagttttataagtgaaaaaataaggctcaatcttccttaagggtccatcaattgtcacttcataatcagggtctgtctttttagttttgtgcccatcggtttgaataactctcagtctgaatccactcgcatctttgactttggaactgttttcgttcctattattattcctgttcgcgaattttcttaacttcacttcctttgcagactcaatttctttgtttaataagttgttgaagtcatcgctggcttcattattagagtcctccattttgattggtttgttaatctaatattgatagttttttttttaatgttcttctctctcttcttcctgttttttcatggcaataattttgactagtttttcttttttttttttttttttcattctttttcattattacttaagttctgtaaagatatatggaagagaaaataaaaagaataaaaccaaagatagtggtacaactgacgttatctgtttcagacataaatgaaaaacttctagcctgacagcccagatcactttacaggatttttaatagtaaatataatagtaaagaacctaatatccaataatgtacattcttagtaactagccaaccgcagtacccgatgactgcgtcaccaatttgtccaatcaggccagagctccatgataaaggatacttttcgatatgtaaggataacggcactggcgtccctgtagaccttggtaatcttacggtaagattaacgggttgatgatcgctaaataatagagcattggacctagggacggaatggtaagtaccttcttgtgcgaaagttggcactgcatagcttttgtagagaatcctatcgcaccacgacgggattctttttgtattatatgtttccttttcaaacaacttgaatttgtatgtcggtggaaatgttatcttcagctcctgaaaacctttgcataacggttcatcctctcctttacgtagcagatttagttcttcatgattttctaatagacgccttaacgttgtggtggacgaataattggtagttggatcataagtactagtaaccctaaaattcaaatcgcctagaaagaaaaagtggtcgctttttgcaacctcagaatcacacacttcactcattattcgtttgtaatcatctattctttgatttctattgttgacaccttcatttgcatttaaatgagcacaaatatagctaaatctttcccagttctcctcgccattgcgtgtcatctgaaaacttatcaaagttccacctttcaagtgtgtaccaaaccaaccgcatttcccattccgtttcaaaatatcatcttttacctttagcgcattattattgtataatactattatggtaatcgccccaagactattcacccctaaacatgaatactgctcatccccttgtgtagctgacactttttcattcagacaattaaccgcagtagttgtaattctatcgattaaatcacgattaacagcagggaaggagccttgccatatggggactacttcttggaaccccaacacatatagatcttgcaattccaattgggagatgccgtcatcgtaggggaaaagcaattgcttaacgattgctttcgaattttcaacgggaaattccttaccacaattgaatgtagttacagataccttccaattcgttttgttcattcggtcagaatcctgctgtattttcttgtctcacttttcttctttgttagcctactcttacctcttcagttttgttcttttcactgtattttccttttttcacgctataacaacaataaaaaaaggttatcatttaactggtatgtacatacacatacacacatatatatatgtactcatatatttatgtctatcaataaagtaaaatatatgttatttaggcgtttcttgactgaatgacatcgcatgatgtagacaccaccaagtcatgtaactcgcgtgggccacttgacgctataactcccttcgtagctagcgttctaccgttaccgaagtctagaggaacatcttccatggcatctgtatggatacctccagcttcatggacaataacgttgcctgcagcatggtcccagatcttttcttggtaagaaagtttgataggcagacgtaaatatacgtctgctaagcccaatgctaacaaacagtacttggcttgagaatccaagtgcaaagatttggatatatttagtttgtttttgatagcagtttgttcatcatgagaggagtgtcccttttcaactccctctaaagtaatcatgtctttagtgtcttttaagtgtctaacgtggattttggtccatgactctgcatctgaagatggagaatagaaggcacctaaacctctaacagcacgaaagatataaccaaatgactcatggcctttcaaatcttgggccccataagaacttaaaactaagttggggcatccaatacaaccaagctgaacaacaccgtccacaattaaggccagacatactgcaaactgttcacctcttaaaaaccccttggttccgtcaataggatccaaacaccaaaatcttccttttctaccaccttcgtaattgccgaaatcgatgatttgcctgacgtcctccaaagattttagcggaaactgatcgtttgtaaacagaaaatcatcctttttataattcttgttataaacttcgtcattggcttttatttcgtttaaaattcctgagacgaatgcgtcgctcaatcctgatgaggattcttcaccaactaccttatcatcaggaaaattgctcttgatagcatttatgatgatcgtttgtgcagcataatcacctgtggttactggagaattatcattcttggtaatagtagtggagtccttgtgagaaatcacttcagattgaattctcttagtcaataaagacgcctttcgtacagcttgagttgcaaccaataattctctttccaatgccatagtaaagtgctgatgtcttctgagttgtctttaaacttcttacttactaactaataaattaaagagaagtgcaaacgttctttatatgtggcatggtttcttctttgcaaactgaaagtaaaatcgcaacacgtgatattgctcgtctgagtcattcgcgcatttcaatgaaggaaggattattatatagatggctatgtaaatgtcaaaatatgctattgttgagttgttccatgctcagttgtgatcttgaatgccctcaaggagcctcttgatgctacgtataaggtagcatatcccttacgttttaactcttcactgtcagatgcataagtgtaatctagtccgcaaatatcacccatggggaaatagacgtcgcacacgccgcagtatgtgtccgagctctctccatctgcaccatacattggtgcgtcaaacaagttcctgttacatctgcactctggactagggttaacagggtcttggacttcccatccaagaatatactcttgtctaaacgaatagatgcctctgtactctgttagtcttagtaatgaaatgagacccaattgtgaagccacggctatgcaatttagttctttgatgtgacacacaaaatttattctgtttagtgcttggagcagcgacttggaagcacacgtcacaacaccatctaagggaaaaatctcatgatgagttgctgatataattatgagtggatttgctttcatcaacaccagcctatgggctgtggttaggaagaagaactcgtcgtgcatttcggatagttgatacccaagaggcgaatcttctgagcccggtactgctgactctaataaccgcttgacgtttcttacatagttgtggaacccccaagatttctgcgattctgatttcaagtgagcacgctgttcagtatccctatatcttcgctggaaacttgttaagctgctaccagattcttcattttcagggtcgctattgacatcgtcctcttctgtagagttcagttgaaggctacaaatttctgggtccttcaagaccgtgttcaaatccttgccaaaaagtgttctccaatcggcagcggcatcggtgttgtaccataaaaagtttcccgattcaatatttggtatatgatttactgaacttagcgatttgaactcttttgaagttcgtagttgtctttgtttatccattttcaaattacgaatacttctattaaattcgcgagatatatcttcaatatcattttcgagatcagtaagtttataagtagacggctcacagatctttctcccagaagtgttttgatattgcgatgttttatttcttccactaggagttatcaactgtggaaaagtattaataatatccttgtatttcgaaaatccacgctcagtagcacgataatgtttataaccagaatcctcccaaaatgtccattggtgtaaatgctgttcacatgaggtgttttttgtcactgcatcattcatatcgtctaagtcaccggcatgtaaaataagtgcaaaatcctctctgctgtactcgtattttatcgagcccgttgtagtgtaatttctatcaaatgaggtaaatcttaatggtataacttcatcggggatccctgctgaagaagtcagtcgtaggtctgtgacaggaacctgaaattgattgagtaatgtaccaataccgaaattcccagagaggtaggcgttatcacagtaatacccaagtaaaaaatcatctcggcaaatagaatataacatgctttctttgaaaccgtcttggtagttaagattcaacaattcgaaattgtcaactttcgcaaaatccttcttagtcagtggagttattgtccataagtcgtcgccaaaaaattgagtatcaaggaaactcgttaaaatggtacaatcatgctcctttaatttaacggtaacaacattcccaaatatagaacaataacttaatgtaatatatccaacagaatcttttgaattaggaacaaagttaacacaaggaacattgtgagatgagggaagatctagaggccgaatgtaccgtctttccttctttacatctttatcgaatgcaaagactgtaactccaggcttgttatggccaacagcgatatatatgatgccatttatatctattacatcaacactccaacaagattcctctactcttaacaccatatatggatcaacatttatgtatctttcccggctgttatctttgcctcccaagatatccgaagtaaatttattaaatatcttaataactttgttgatttcccagatataaacgattccgttgtcaccgcaagctagtagaaaatcttgatgcatgaagttacaaatcttcataaagttgatagaacatagttcaggtatgctgttgaactgtgtatccttaaatttcacatatgatgaattgcggaagtttcttacatctccgtcatctggtattatcacgggcaataaggcgtgacatatttctaatgacgaaacgttcaatagtatatcgaaattatgaacttcgacgcattgaccggcagccaggaaggaataactcccataagtgacgaacaaattgttcttgaactgcaaaccaccataagcaaacctatttgtgtattgaaaaggtgcgaactctagtggtatctcttgaacaagtagtttttcgtcctgtggcaatagtaattcagctggattcaaaagccttgatggtccccagacgggttctaagttggaaaatgcagatttagtatcctccaagaaggctttcttgaatgagtaagcaggatttgggattttccatgaagagtcatgttcttctaggttgtgtaatcgttctttaataaactccacggtttttggatgaaacgaattgcaactggagtttggccacttgagttgataatatttctttaacgttattatctcattcgttatattccagccaccagacgccagaaatacttctgagtcaaagcactctcttgtcgatactgccctttgtatgatggcccgagacttaagccaccttgtaaagagatcatcattttcattgggaatctgagggggcattatattcaaaaccaaattttcaagcctagaagtaccagtgcctcttgattgcgctgttgatcttcattactatggtgtttttggtgtcttgtatggtttttccatgttttttccctgttttcttttcaatgaaaaactaaattgcatgtctctcataatagaaaatattcaatattaacaaaatgtgacttctaaaggaaattactataaaaaatacaggactgataaaaatatatgtacacaaaaattacgggctagtacctcacctcgtaagaaccggctttcgatatatatttaatccattttacagcacgatgcttactgtcttttccagaaatggtaaagtatcgtacgactaagccagaattactgaacatcatgacctcgaattccagggatattggaggtcttgtccattgttgaagattcaattgagtagtatcacttgtggacacagtaactgcacttaaagtgttttccgtcaacccattgtacttgttgaacctccaaatcattgcattttcttctggcacaaacttacagtggccattagagacacttatcttacaatccacagtgcttggtggaacgggtatatgtagtaccacatctttggcggaaagttttccaggaaataaagacttcaatgttatcctgtaatcaatctcgttatctcttgtagaatgtgtaacaataggtgtaaccttgaacggcaggtttatgttatctcgtacatgatatttcatcaactccatcgaaccgtctggtgggacgaattcaatgatatgatttctgttaaatttgtcaagtgagacacattcgtgaaacttgcaatcttccaacaaaacactaccggcagcagctttgggaatgaagttcttgtttccaaaatcgctgccagagtgacgctgctgctgtgctaaccatttcttctcgtcttcggactgcattcccaaagaatcattcaatccaaatctacaaataggggtcccactcaagtgtgtggtgatatctatggtgccatcaacgtatgatttcaagatagaaccatccctagataccagaatgtttatcctctcattgacatacaagaaaacttcatccttcttgtgtattatccccttgggcctccaagtgatcttattgttatcatagaaatcagaagtggagtctccttgacccaggaaactactgcttctttttgtcaaaaatttgggaaaatgtagttctcctgctgaagaagtaggagatgaagaggaagataatacatcatttccatcgggactatctaacaatccgcccatatttctaacgggtttcacagacatctgcgctataacagagttcaattcagtgtcaattggtatcccatttccacccaacattatatccagcatctcatgcacaatcatgaattcctctttcaaggcctcctctctatccaatcgataagcattcatcactgcatcaagcttatataagaactcccagatcgccgcactattagcgttgcttctcgtaatggttaccaaccacaaattgtcaccatgcctcgacctgatgtgatggaaagtagttgagcccagtgtcaaaacaggcgatctaacatctagattattgatcacttgtactcggaagatatcggatatggaccgcttcaacgagttcttgaagaacttgttcaagacaagttcacctctcgatgagtataccagcacaccactaatcattgctcaccataactctatgtgattcttttctccaaccgtttatgaaaggtttccacactttatcatcaagttctcctatactaatcaattaaggaaaatatggctgttacccttcgaccgcagttgaaaaaaattttctatcaaataataaatggctacgattagcgagaagggctggatgagatgagagtaagttggtcgaaagtgactttgttggaggttgctacgaggctaggaacgcagtctggatgtcaatgagtaatattgttgtttttggaggggactcgcaccccgagttagttactaagatctgtgaaaatttggacattcacccatcgaaagtagaattagggaagttttctaatggggaaacgaacattgctcttcgcgaatctgttcgtgaaaaggatgtatatatcatccagagtggttgtggccaggtgaacgacacgttcatgcagttgctgattttaatcagtgcctgcaagtccgcttctgcctcgagggttacagccgtaatgccatatctctgctactcgagacagccagatattccatatactgccaagggtgctcccataatttccaagcctaaagaaaactatacttttgaatcgcatccaggcacacccgtgtcatcttctttaatgacgcaaagaccaggtgctgagagctcgttgaagagtttggatagtgcaatacgatcaactatcaacttagaaaatcctcaacctatcagaacaccaaacagcagtgctacggcgaataacaatttcgacatcaagaagacgctttctttttcaagaattcctatgattcccggtggtaagttacaaaatacaagcaatagcacggacgctggtgaattgttcaacgctcaaaatgcaggctataagctatgggtagtacaagccggtactttgattgctcatttgttgagtgctgcaggtgctgaccatgtgatcacaatggatttgcacgatccacagttccctgggttttttgacattccagtggataatctctactgtaaacccattgcacaaaactacatccagcatcgcattccagattatcaggatgctgtgatcgtttctccagatgctggtggtgcaaagagagctacggctattgcagacgccttggaattgtccttcgccctaattcataaagaaagaagatctcagttattgaagggccctccagatgcgacgttaacctctggtggttcgttaccagtatctccaaggccattagttactactttggtttcctcccaaaatactacttcttcaggtgccactggggttgcggcccttgaaatgaagaaaacaacttcaacatcttccacctcgtcgcaatcttctaattcgtccaagttcgttcaaactaccatgcttgttggcgatgttagaaacaaggtgtgtattatagtcgacgacttggtggatacttcatacactattacaagagctgcgaaattgttgaaggatcaaggatctaccaaagtttatgccttaataacgcacggtgttttttccggtgatgcgctagaaagaatcggccaaagtagtatagataagttgatcatttctaacacggttcctcaagatagaacactacagtacctaggtaaggacagagtggatgttattgatgtctcctgcataatcggtgaagcaattagaagaatccataacggtgaatccatttctatgttgttcgagcatggatggtagtggcattgatgtgttcatttttttattgataaaaataggggaaagtgtctatatattttgcgtataaaattctctacatttttttttctttgtttagtatgtgtattgaaacattttatttataggttagagaaacaaaaaaaaaaaaactgcaatttcttcttgtatgtctgtagaaaaaattttaagctgctctcccctgtgatttcatgcgtctgggactaataagaacggtgatgatggttattatgatgcatgggcaattcttttggcataatctcttcatctttttatggtcgacgaggagccgttggcatcataattggaagttcttgacaaagagtcggtgaaattagaacgatcattgttgttagcgttttcgttcttaaatttattcttaatactggaaaataaacttgcatttgaacttgaactttctctatcgtcacttcgattagaattctcttgattgatattctcgtttccatattcacttttggattcgtcccaatcttttgcggggccaatgatggtttttggaacacctttgactgtgatgacagattccacaataccattcttcgtattttggtaagaggttgagattgtaacgttttgattttcgttgccgtgattcgcgccagaatttggaattgatatactatcagggctatttctcgtggttttagtcgaggtagtaacttgagttggttgacccgaccgttgagtatggagaacagcttggcgagatagctctgcatgatcacttaatagttgttgttcttcggcggagagtgatttatcatttgagtgtggtgctggagaaggctctttgctagaatgaggagtgtgtgtagtaatgattttcggaacattggcaggctttttaatggtaacaaaagatttatttacgttcaacgggttggacgctagatttgaaggtatgatggtgccatgttccgtcacttgtggagttggagacaatacagcgttggacctgtcgtaaccatcatttgacttctgcttccaagacttattattcaaatcttgctgtgggtgctcggatgggtgattagaattggatggagacaagagtggagacgattcatcagcttggtcagcagctttgtgctccttgtgagagctagtgtacaaatgatgcaaataggaagtaatgtgccttttgctcaagggccccggttgttgtctcataatatgctgatgcatgtccacaaagacatcagactcgtccacgatttcttcaccgatcaattcttcaatgacatcctccaaagttaaaacaccaatagcgccatgcgaggagcccggctctttactaacgacgcacatgtgagctttcccctcctggaagtaattcagaatattcaaacaagatgtgttcggggaagtttctggcaacgtggctagggggaagtgggagattgggaggcagtcatcaggatcgtaggagataagcaccctgacaagtaacatgccgatgaagttgtttggttcattgggcaaaaaaatcgggattctagaaaaccctgagttgaagattttttcgacagttttatcgtctaggatggtatcggcactcattgtgaacacgttttcaatcggagtcatgatttcctcaaccctctttgcctttagatccaaaacagcagagatgattgtaacttcgtctttagtcaaccgttccacccccatggtcctatgcaaggtgaccaaagtctttaagccggattttttgtacatcgtaccatgatcttcacccagcatatagtccaggagagtcgcgatcggatatgcgactgggtacatcagatacatcagtacaagaacaaaggggcagaagaatgccccaacttgcagcccgtatttaacacagacactctgcggaataatttcaccgaagatcacaattagaatagttgacgacactacagcctgccaaccacccccaagacacctgtccaaaacaataggcaatgtttcgttggttataacattagaaagcagcagtgtgactagaacccaatgcttccccctagatattaggtcaagcacccgcttggccagtttcttttcagaattcgagcctgaagtgctgattaccttcaggtagacttcatcttgacccatcaaccccagcgtcaatcctgcaaatacaccacccagcagcactaggatgatagagataatatagtacgtggtaacgcttgcctcatcacctacgctatggccggaatcggcaacatccctagaattgagtacgtgtgatccggataacaacggcagtgaatatatcttcggtatcgtaaagatgtgatataagatgatgtatacccaatgaggagcgcctgatcgtgacctagaccttagtggcaaaaacgacatatctattatagtggggagagtttcgtgcaaataacagacgcagcagcaagtaactgtgacgatatcaactctttttttattatgtaataagcaaacaagcacgaatggggaaagcctatgtgcaatcaccaaggtcgtcccttttttcccatttgctaatttagaatttaaagaaaccaaaagaatgaagaaagaaaacaaatactagccctaaccctgacttcgtttctatgataataccctgctttaatgaacggtatgccctagggtatatctcactctgtacgttacaaactccggttattttatcggaacatccgagcacccgcgccttcctcaacccaggcaccgcccccaggtaaccgtgcgcgatgagctaatcctgagccatcacccaccccacccgttgatgacagcaattcgggagggcgaaaaataaaaactggagcaaggaattaccatcaccgtcaccatcaccatcatatcgccttagcctctagccatagccatcatgcaagcgtgtatcttctaagattcagtcatcatcattaccgagtttgttttccttcacatgatgaagaaggtttgagtatgctcgaaacaataagacgacgatggctctgccattgttatattacgcttttgcggcgaggtgccgatgggttgctgaggggaagagtgtttagcttacggacctattgccattgttattccgattaatctattgttcagcagctcttctctaccctgtcattctagtattttttttttttttttttggttttacttttttttcttcttgcctttttttcttgttactttttttctagttttttttccttccactaagctttttccttgatttatccttgggttcttctttctactcctttagattttttttttatatattaatttttaagtttatgtattttggtagattcaattctctttccctttccttttccttcgctccccttccttatcaatgcttgctgtcagaagattaacaagatacacattccttaagcgaacgcatccggtgttatatactcgtcgtgcatataaaattttgccttcaagatctactttcctaagaagatcattattacaaacacaactgcactcaaagatgactgctcatactaatatcaaacagcacaaacactgtcatgaggaccatcctatcagaagatcggactctgccgtgtcaattgtacatttgaaacgtgcgcccttcaaggttacagtgattggttctggtaactgggggaccaccatcgccaaagtcattgcggaaaacacagaattgcattcccatatcttcgagccagaggtgagaatgtgggtttttgatgaaaagatcggcgacgaaaatctgacggatatcataaatacaagacaccagaacgttaaatatctacccaatattgacctgccccataatctagtggccgatcctgatcttttacactccatcaagggtgctgacatccttgttttcaacatccctcatcaatttttaccaaacatagtcaaacaattgcaaggccacgtggcccctcatgtaagggccatctcgtgtctaaaagggttcgagttgggctccaagggtgtgcaattgctatcctcctatgttactgatgagttaggaatccaatgtggcgcactatctggtgcaaacttggcaccggaagtggccaaggagcattggtccgaaaccaccgtggcttaccaactaccaaaggattatcaaggtgatggcaaggatgtagatcataagattttgaaattgctgttccacagaccttacttccacgtcaatgtcatcgatgatgttgctggtatatccattgccggtgccttgaagaacgtcgtggcacttgcatgtggtttcgtagaaggtatgggatggggtaacaatgcctccgcagccattcaaaggctgggtttaggtgaaattatcaagttcggtagaatgtttttcccagaatccaaagtcgagacctactatcaagaatccgctggtgttgcagatctgatcaccacctgctcaggcggtagaaacgtcaaggttgccacatacatggccaagaccggtaagtcagccttggaagcagaaaaggaattgcttaacggtcaatccgcccaagggataatcacatgcagagaagttcacgagtggctacaaacatgtgagttgacccaagaattcccattattcgaggcagtctaccagatagtctacaacaacgtccgcatggaagacctaccggagatgattgaagagctagacatcgatgacgaatagacactctccccccccctccccctctgatctttcctgttgcctctttttcccccaaccaatttatcattatacacaagttctacaactactactagtaacattactacagttattataattttctattctctttttctttaagaatctatcattaacgttaatttctatatatacataactaccattatacacgctattatcgtttacatatcacatcaccgttaatgaaagatacgacaccctgtacactaacacaattaaataatcgccataaccttttctgttatctatagcccttaaagctgtttcttcgagctttttcactgcagtaattctccacatgggcccagccactgagataagagcgctatgttagtcactactgacggctctccagtcatttatgtgattttttagtgactcatgtcgcatttggcccgtttttttccgctgtcgcaacctatttccattaacggtgccgtatggaagagtcatttaaaggcaggagagagagattactcatcttcattggatcagattgatgactgcgtacggcagatagtgtaatctgagcagttgcgagacccagactggcactgtctcaatagtatattaatgggcatacattcgtactcccttgttcttgcccacagttctctctctctttacttcttgtatcttgtctccccattgtgcagcgataaggaacattgttctaatatacacggatacaaaagaaatacacataattgcataaaataatgtctaagggaaaagtttgtttggcttattctggtggtttagatacctccgtcattttggcttggctactagaccaaggctacgaagttgtagctttcatggctaatgtagggcaagaagaagatttcgatgccgccaaggaaaaggccttgaagatcggtgcctgcaagttcgtttgtgtggattgtcgtgaagattttgtcaaggatattctattcccagctgtacaggtcaacgctgtgtacgaagacgtttatctgttgggtacctctttggcaagacctgttattgccaaagcccaaattgacgtcgctaaacaggagggctgtttcgcggtctctcatggttgtaccggtaaaggtaatgatcaaatcagattcgaattgtcattttacgctctgaagccagacgttaagtgtattacaccatggagaatgcctgaatttttcgaaagatttgctggcagaaaggatttgttagactatgctgcacaaaagggtattcccgtcgcccaaaccaaggccaagccatggtctactgacgaaaaccaagcccacatttcttacgaggcaggtatcttggaagacccagataccaccccaccaaaggacatgtggaaattgatcgtcgatccaatggatgctccggaccaaccacaagatttgaccattgactttgaacgtggtcttccagtcaagttgacctacaccgacaacaagacttccaaggaagtttccgttaccaagcctttggatgttttcttggccgcatccaacttagcaagggccaacggtgttggtagaatcgatattgtagaagatcgttacattaacttgaaatccagaggttgttacgaacaggctccattgactgttttgagaaaagctcatgttgatttggaaggtttgactttagacaaagaagtccgtcaattgagagactcattcgtcacaccaaactactccagattgatatataacggtttcctacttcacccagagtgtgagtacatcagatctatgatccaaccatcccaaaatagcgttaacggtactgtcagggttagactgtataagggtaacgtcatcattctgggcagatctacaaagactgaaaagttgtacgatccgacagaatcctctatggatgagttgaccggtttcttacctaccgataccaccggtttcattgccatccaggccattagaattaaaaaatacggtgaatccaaaaaaaccaaaggtgaagagttgactttgtaagtccgctagttcatcgcctcaagatagataacgatctcttcctccacctcctatttctgcacactcttgtgatgtaaatacatatgtagacatatgtaagcttttgtataaatagtttaagaaagcatcataccaattttgaatagaagaaaaaatagctaagagcatagccgctcggaataagttgacgtagcgaaaaatcccaatatcgtaaaggaaaaataccttcatgagaacagaacattgaaaagaagaaaaaaaaaactgagcactgcaccattaagtcctcaaagatgagccactttttcgccgatcatgatgctcctctgagcatgctttctgttaaaacagaatactttcctcaattgactgataaggaacaaaaatatgcgcatttcatgtcaaaggcctcccatgcgggttcaagggttgtaatgagacaagtttctcatgagagtgagccaatttttgacctaatccttgccattcattcaaagctaaacggcaagtacccagaggacgatattacgcagaagcagcaaacgggtttgtatttggaatacgtttctcaattcttatctaatttgggtaatttcaaatcgtttggtgacactaagtttattcctcgttgtgaggtaaaattcttcaaacagcttttggagctggccaagattaatccgtgttcttctccgctcactttatctcctgttgacgttaaccatgaattcacatctcatcatcttttttccaccatcaatgagctaattgatattggtatttaccatgtggaagagaaggcggctctcttagggtttccctctcaaggttatacttcagcctattatctgggtttacctgtgacacctgaagatatggctcttttgaaagagcagttgtttgctgaacttgccatcttgcctgaaaacacaagaatcaacaaagttggtgaaaacagtttccaaatctgggttgcctctgagaatgtgaaaaaccagataacagaaacctaccccagtggacagatcacattatccaatgctgtaaccaaagtagaattcatttttggtgatcattcacgtgaaatgcgtttagtagcatcgtatttaaaggaagctcaaaaattcgcggctaatgatactcaaaaagcaatgcttcaggaatacatcaaccactttgtcactggctcttctcaagcacataaagaagcacaaaaactttgggtcaaagatatatctcccgtcattgaaacaaatatcggttttatcgaaacatatagagaaccctcgggcataattggagaatttgaatcgttggttgcaattcaaaacaaagaacgtactgctaaattttccagcttggttaacaacgcagaagaattcatttccttactaccatggtctaaagattacgaaaaaccgattttcaatccaccagatttcacctctctagaagtattaacgtttactggatcgggtataccagcgggcatcaatattccaaactatgatgatgttcggcttaaaattgggttcaagaatgtttctttggggaatatcttaagcgcggctgccaaaagctcatccaagcatccgccaagttttatatcgcaagaagatcgcccaatttttgaaaaatatcaaagtgattcttttgaagtccaagtaggcatccatgaattattaggacatggttcaggaaagttgttgacagaatttacagacggctttaattttgataaggaaaaccctcctttaggtttggatgggaaaccggtgagcacatactacaaagttggtgaaacttggggttccaaatttggacagttagctggcccatttgaagaatgtcgtgcggaagtaattgccatgtttttgcttactaataagaagattcttgatatttttggtttccatgatgtcgaatctcaagataaagtgatctacgctggatatctacaaatggcccgtgcgggtctcctagctttagaatactggaatccaaaaactggtaagtggggacaaccacacatgcaagcaagattttctatcatgaaaacatttatgaagcactctacagataagaatttcttaaagttggagatgaacagcacgaatgatgattttgccatcaagttggataaatctctcattaaaacagcgggacatgaatgtgtgaaagactatttaaagcatttgcatgtttacaaatgttcaggcgatgtggaacagggaagtaagtactttattgatagatcaacggtgacaccggatttggcgtctttaagagacatcgtcttatctaagagattgccaaggagacaattcatacaatcgaattcttatattgacgacaataacaaggtaaccctgaaagaatatgatgaaaccccacagggtatgctccaatctttccttgatagagaattatgatgtccttaagagcacacgttttaattagcaacctttgctgttgcttttgttcaagctattagattatgtaaacagatatatattatgtaagtgtgacaggatacgacagcactaactgtcagcgaattttgatttgttacttttgctagttttgtgtgactttcctttgttttttaactttttttttcagatttgtattatgagatgataacaatgcgagatttcattgacaagttcgataaaacaatagaagcttccattttatacatatgtgataaaacaacctgcaatcgaggatttacaataaaagtctctttgagaggattgagaaatagtgcaaaaagatctactaataacgaatagttatgactgttactgacacttttaaactgtttattttaaggcatggtcaaagtgaattaaactcagaaaacatattctgcggatggattgatgctcaattaacggaaaaagggaagtctcaggcccgccactctgcaaaattgatcaagcagttttgcgattctaacaatatctctttgcctcagattggctatacttcaaggttgattcgaactcagcagaccatggacgttattctcgaagagttgggactaaaacacaccaattatgtaattactacgaatacaaacattaaggaggagctgcaggacacaagatttgaaggaagtatgcctgtgttgcaaacctggaggttaaatgagcgtcattacggcgcatggcaaggacaaagaaagccagatatcttgaaagaatacggtaaggaaaaatacatgtatatcagaagagattacaacggaaaaccccctaaagtcaacctaaacctggaaatggtccaagaggaaaatgatcaggggtcctccacaggctatgattttaaggagcccaatagacacttaaaatacggccccgaagagaaggctaatgagcgtctgccagaaagtgagtctctttgtgaagtggtcgtcagattgaaaccatttttaaataatgttgttctgtctaccgccaacaaaatcagtcaagaatcgtgtgttatagttgggcatggcagctctgtaagatctctgctgaaagtattggaaggtatctcagatgaagacatcaaagatgtcgatattcccaacggcattccgctagttatagagttggatagagacaattactcttttgtgaggaaattttacttggatccagaatcagctaaagttaatgctcaaatggttcgtgatgagggtttcgaaaagaatccatgaatagtttttaaaaataaaaaattagcgccatttttttcatggtttccttttatatttccttctttctttattgatagaataatgagtaacgaaaagcagctaaataaacgtgtttaaatttctataagaagtttttatagattgtataacaaagaaacttttttcttattattatttttttgtttttataattcattatatgtaggtatatctttatctattgtgcataagccatcttatctactcgtattctagcgcagcggtccaaaaatttgtttctaattcacaaacttcagcgtagattgttactaaagtgtcaagttgctctggagggtatgtttctaagatgtggttcaaaagtttttcaccttcatccatggcttcacgataccatgaagatgcgtaagtttcacaccattcgtggtaaacggacccttcaggtgcggtgactttacccttcattttagttaaagcttcaccataacccatcaaacaaggagtaagggatgcaaccaattcttgccagttacctcttctggaaacatcgttaaagtaacgagagtaagctcttaatgcaggtcctctcttaatcttttgaaagtaatcaggatctttaacaccaaatacttcttttaatctcttttcatgttgacccatttcagtacgaacacctccaacaatgactagctccttttccatatcttctaggcatggagctttactacccgcgatacaatgaactctagcataatcaaccaagtatgcataatcttgttcaataaagaactgaaacttcttacgttctaatgtaccgtccgcaacctttttaacaaactcatggttaatataggaatcccagtgtggcttaactttagggtgattgatcaggtattcatagaaattaccgcctgggattttgtcagcagcacttttgagcggctttttaggtataacatccgatgcagtaaaacattcatcactgagcattttctccaatggaatttccacggcgtaaacatgattaattggtccattatccttgacagtttcttttgtgacatcacaaccaattgccacggcattttggacgtattcaataccaccataaacagactgaggaagagaataaccacgagccaagtttgatgcaatggcagaagctagtgtgcacccagtaccatgtgtatgcgtggtgttaacgaaattgcctttaaagataatgaatttttgttcagcacccaagaaaagaacgtcggtaatgtacttttccttttcatcattccatggaatatggccacccttcactagtatattcgaacacttggttattttagcaaggtcttttgcgatttggaaaatatcctgtaatccgttaacctttctttcctcacctaacaatttgtaacactctgggatgttaggagtcaaaatatcagcaaaaggtgcaaccttctccgtaatcaaactaactatatcctttccagctaaagaagaaccagaagtagcgacaagaactggatcaacaaccaacttaggtctattttcgccgagttgcagcagtttttcgtgcaagacttcgatagcagctgcggtaagcataccggttttgataacattacatttcatatcctttaaattggattccaaagtttggaaaaccacttcttttggtgtgttatttatgctgtagactttaactggagtttgagcatttaaagcagtgatacatgtcatggcataacatctgtgtgctgtgatagttttgacatcagcttcgataccggctccaccacttggatctgttccagcaatggataaaactgttggcaacttttcgttgcaggctaaagtaagatatggtggaggcgtgttgatgctaactgtagaataggtcatagtaaaatgcgagacgttttccttatatattatttattaatctgtctagtatcattgagagaaaaataataacgcaaggaatgcaacctttatcgaagtctcagtatgctttgtctgatggtttaaataataggattttttctgccagctggcatagctctaagggtttcctaaccttcatcggggatcattaatctatcagaaaatagaagctatacatatacatgtcgctaaagaagtacggagggcttgtgtaataaaaggcaacacaatacgtggctgctagaatggattcatcttacacgcggtcatattaggctaaacggcacatgttaacttttttcacatttgtaagtaaaagtaatagatccagttccctttataggataactggcaacgatggggaacgttgacagaaatactgggcccaaaagaggatagaaaaagaaaaaataaagtgtaatcaataattaatcaatctatcaaaagttatatacattgcaatgttgaaattaaaaaaattcaacaaaaaatttgcgcaagcccggaatcgaaccgggggcccaacgatggcaacgttggattttaccactaaaccacttgcgctgaatttcttgatggtattacatctcaggatagcatacctcagtatgacaatacatcatctcgtaaacgctcatatgaaacaaccttataacaaaacgaatagaatgagcaacatgagataaaactccgcctcccgtagttgaaccacccaaacgtataaatccctgaacaattagtttagatctgagattcctcgctttcatcatttagtgtaattcatattttatatgatatatagaataagcaacatcccatgaatcaagctgataatccgttttggcaactgattacttcccaaagactccttatattaggattgtctagacaccccggtattactcgagccctaatacaacagtaaaagtttgtaaatatatagaattaattggtcacaattgtttgatgctcccctttcaattaacgaatatctattgactggtatttatattactattatattatcatataagacgtgacaagatgacataaagactaagaaacagtcattagattcatatgaaagctaaatgcaaggataaatattgtaataagataataagggcctgcacataaaaatgggaagaataaaaagaatagtaataataataatgatgatgacgatgatgatgatgatgatgatgatgatgatgatgattatgattacaatgtatttgataatatactagtatcacgaatattactaaatggatgacactctagagtttcatctgaataattaccaaattattcacctatctcttagtagtatacctattttttcgtttaattagtgtccttattggctttaaagtaattaatgcagatggttcatggcatacaaaaaatactttgtttcgtttgttttttttttctttttgttatgattttattagcctaataatgtcctagagttaacaaatgtaaattgtaagaggatacattacatctacaaaaattaaaaccagttaactctctatcctcatccttttaattttgttgaataagaggcaaccataaaggttaagaaatagcatcagatgtaatggaagctgaaaaatgcaatgattgattattcaataatagtgaataacggcgtgtaaatgaataagaaatggtaataataatactgatgcctttttatggattcctatatccttgtggaaaacctcttgaatactgggtgaataatttgataattgttgtcattccattgttggtgaaggctataatattatgtatacagattataatagaaattttcctcgaggatataggaatcctcaaaaaggaatctatatttctacatactaatattacgaatattcccaattccgttttatacatttcattatcctattacattattagtccttgcatttcgcttcaatcaatctaactgtttcccaatctttatgttatcttcttacactgcatgtgataatatactagtaacacgaatactactaaaaagatgatattttaaagtttcattccaacacctctaacatgttctatatacctaatattaaacctttattaataatggaatctcaacaattgtctcaaaattctcccatttctcacaatcttgtgcattgagaactgtgcatcattaagtttctaaaatttagatctttcataaaatattagactccatggccaagttggttaaggcgtgcgactgttaatcgcaagatcgtgagttcaaccctcactggggtcgttatttttgaatacccaatacttttttttcgggccatttcacacaatggcgttttttatcctatgtccactacaatttagatgagctctcttctagcatacaactgcgatgaggaatttgataatattctattttaagcattaagttttcagaaaacgaacgatcgcgttttttctcagacagaaagttttaatatattgataagaataatgggcgacgaattacacaaccgtttacttcaccaaaacgatggcaccaaggacgccatactttataagataatagaatcgttagtttgctccatctgccacgattatatgtttgtaccgatgatgacaccttgtggtcataattattgctatggttgtctgaacacctggtttgccagcaatactcaaaaagaattggcttgtccgcagtgcagatctgatattaccaccattcccgcattgaatacaacgttgcaacagtatctatcattcattttagagaaattaagggaccagaatgatgaatcttttaaaaaacttttaacaactaaaaccaaggaggaaaatgattacaagaatgacaaggaaaaggacacattgtttgacaaagtatttaagaatagcgcattggcagtggccgacgactcggatgatggtatcacacgttgtagtaattgtcattgggaattagacccagacgaagtagaggacggaaatgtttgtccccactgcaatgccagaatacggaattacgcaggtggtcgcgacgaatttgatgaagaagaatacagtgaaggagagttggatgaaatccgggaaagcatgcgtaggcgtagagagaatcgatttgcgtctaccaatccgtttgctaatagagatgatgtaagttctgaagacgatgatagcagtgaagaggagcccatgcgagaacatatcccactaggccgttgggccaggtcacataatcgtagtattgctgtggatgctgtggatgatgaagacgacgaagaagaggatgaggaagaagaagaggagatggattccgatttgaaagattttatagaggatgatgaagatgacgaagatgaagatggaagtaggaggaatttggtattgtctgcactcaagaacagacatgtaattattactgatgatgaggaagaggagcaacggcgacatgctacagaagaggaagatcgcgatagtgacttttacgagcataatgatgatggttttgtaagtggtgatagccttgatgaggatcagaaggaggttacacggatacaatcgagttctgattccgaagatcgttcactttcgtattccggctccagcgatgtcaaggataacaatgacgataacacggaagaattagatgacccacaaccgaaaaggcagaaacgcttccgtgtagttctaggagacagtgacgatgaataatctgaacattttaactagcgggaacggcatatgtacggaacttttatgtatgtttttaaaaaatttcctttctatccttattacattaagatttttaagcgatagtaggatcggaaatataagcactcgtttatgatataaataggtcaagaatttcgtaaagtaaaatcaatacatatgtgaatctttttttttttttttttgggactgctattggtatttttttagcgtcacgttaatcagcccaattatgtgggggttatgcaagaagcattttccgagcaataaaattcaagtgcaggagagaaacaaagcattaaaaccaaagaagagtggcagcgaacataagacaaagcaactgtttcctgtattcaattgcaagaagaaggaaaaaggggtaatgatacggtttgcgattctacgtaatgctaacacatctctactgtccgcgagaagtatatgcttatttacccaggcgcctacctattgtcatgtaaggttgaataccttgaataaaagcattacaactaaaagaaattcattgacagagtcgaaaaggcatgtccatgatggcaagcatttttttacgacgccacatcaacagcaacagacgaagttgggggaaattgaagagggacacagtcctaacataaaaggagaggacttgagaagcattggtcaagcaataacacatcagcgaaacaagcgccgaaagcaaatatggtccgccatatttggtggtatattcggtgtgatattaggatactcactaatctatagagtgatatatttaaaggaacaaagtttcttaccattgtttccatcatccaagatacgtaaactgagtaccagagatttgaaaaaggttgacgtaaaccaagtacagaagctttctaaattaagggttttagagatattatccggtcatgacatgatcaaggaacaatacggagtaccattgcttgataaagatggcaattcacccacgttaaatgaattcagcatgtggtgcgaagatcaagatccatgtgtaactggtattgtaatggagccagacgataaaagggatagttcgcacacttggtatagaataccctttgtttgcaaatggaggataacgcatcggccaataagtatacggggaaccatcgacgatttactgaaccgcattggtttggaaacagccgatttatttgagattatatcgccggagagggtatacgggtcgttcaagtacgaatacccactgcagggggactcacatgcattacacctttggtttcatggcgaaatcgaactggacgatgattctttgattgtatataatggaaaataccacgttgatgttaaattgcaagaaatcgacctcttcagacgtgaaaagaacggacaactaatacagtacgttctatacaaaaacgaagcgggcgacaagtaagaaaaatgtaaatatttttatcacaattatgattattatcgttattaaactacttattttcggttacgtagatgaaatagtgttatataagaatatttgagaaagtaaaactgataaataaatataatggaatgaaaaaatagagacgaactggaagaagagaaaaaaaattaaagcaccaaatttactactctggggcctatagatggaatatcaaaggggaagatgagaaaagaaattatacatttcagaaacgtcaatagggtatcatcatcgtggcagtaagcggcgtttttcctaaatcaaaaaggccaaagcaccaccaacagcagcaccgacgactccggcgtttagtagttgaccattttgagcgtgcaaagcaggagcagcgttactcgtggtgttggatgcgttttgagcatttacgctagtagcgaggccgaagacagagatggcagaaatgaaaacttgtgatactttcatgtttaaatcgatattaaattagcgtgcttgcttggagggcttttcagaatgaaaaaaaaaagaatgaagaaagaattaaccaaagaatggaggttatgtgtaagaaatggcatttatatatacatttatataaaaatgtataaacatacttgcattattgatgtcccataaggggtgagaaaagacaaaaatggaaacaggggaaaagaagaagagtaaaaaaaggattattttaggagagaaaggggattagaagaacatcgggcataaacctttgagcatcatcctttattgatgtttgacaccttgcgattgatgaaaaatattgatgatattaaggtatttctgatagccactgccccgtcccttgaagcggccttccgtcgaggccttggcaaccgtgtctgggtgtgtgatatattacatcagaggaaataaaagcttgagcggctaaactcccttagctcaggggtggtctggccaggaattttcagtggccatttttcctgttccgggtccggccaatctgtgccggttttctctagaggaaaaaaaaaagcatgcggggtaatgatgtagaagatatacaagcgggttaaactacattagttatgagtgctagaaagcaagcgaaggataatagaagagggctattctatgtaagtatgaggagacacaaatggcggcttttcatattttcttctgcaatttcatatagaaaaggtggtagtcgtccagatcataaacaattttgtctaacttgatgtagtcgggcagtgactcgttgatgcttagtagtttttggaaggattggttctgataatttttggtaaaaaaggtcatcgagaactctcttggttgaaaaacgttcagaatatgtagaagaacgtccaagttgtcttgcttcccttgggaaatgtcaaatacgggtatgttactttcgaaagaggcgtaagaccaacccttttccggagtcacgtgcagggtgtaatagtatttttcagcgagaatcatattggatgagtatccacatggcgtgaacgcaaatgcatcgtggtgaaatgataaatcggagtcttgggccgagttgacatatatttcgtcaagccttgtatttttagtcatttggtagccgaggttgtggcccttatcttcgtttggctccacgagagcggttgtggatgcctcaggcccgcaaacaaacttactagcgcattctgggtccagctccgtcatcagtacttcgaaagtttcgtcgtcatcctcgatgtactcctttcccttaggtgtggagcggtccgtctcggtgacgtacaggttccagtggttgctcttgtcatttcttcccacggaataacttttaccattgtcgaaaaatttgttcaaatagtcgacttcgtcagcccagttttgatggatagcggcttgcttacaggggaaaaggaaacatcgtctagaataaaacactttaaatggtttgtacttgcccccttgtgttgtgcggaaagcccacgataactcttgctcaacgatctggaaaagcttttcgagacagaacaatgtggttgtagtaccgcacgtcttcatcgtcaatttgtgatcgaagacgaagagggaagactcactcaacaaaaaggcatccagttctttagtcttcttcatggaaagaacttcgcatttcactaatttcaaaatctcgatccatctatccatgccaatatttcttaatgtcttttcggtcgtgatggacttcttgtgagggaagaaccagatttccagcaacttctcgggaccctcgaacgcatccgttgagtctaaagtggctgatagttcgtggtcaatgtagttgtggttagtcaattcttttatggtgacagtcattctatggtccgcctatttgcgtaagacactatatgaaaacctaaaaaatataaaaaagaagctacagtacagtaattgattaacctggaagaaaaaaaagaaaaaaagagttgatgcaaggagcgagctgtagcgaatacaatatatacacgtatagatatgcagagatgcttttagtcgattagcaaagtttattcgatgcctaaataccggagaaccgtgtttggaattttttttcttcgagtggaaaaaagtgaaaatttccaaagtcaatcattgtgtacgtacgctgaaattggatgcagaagaggtaaaaggcgaaggaaaagagggcgagggtaaaaagcctgattgccaaaccatggtgcccaatttattggatattactactgatggaaggctacatatctctggcgctttctatcagctgtcatcgatttgaaattcttctagccctaggaacgccattatggggcttatccgggtagccagttggcggttttagttttttcacttcttgatttttttctagttcgaagaattttttccactgatgattgagctataaaagagcctgattaagatgaagagctccgattctcttcgttaacggagcatcaaacatgacgttagcgtcaagtaacctacgatatttgtgcaacagacatgatggagtaccctcatgctttggcgcgtgcgcatctatataaggttagggactgcaaaagaagcggcgaggcagcccacatcaagtggaactacacagacttccttgtcgcgatactacggtcccaagagcaatcctaacaagcaattacatattcccccgctgaacctgtacagtccacggatggtgcagaagttatatgatttgggggaagacgctttttcacatcttcttgcatgataagagtagtagtaactaagtaatatgattcagtcagtctctagttaatataattaggcattaccctacattgtggcggcctcttttttatttcgaatcgggccttccttccaccccggccccggttgcgtcgatcagaaaattatattatggatgaggatgatgaaggtgcttaacctttacagtcaaacttttaatagtcaaccattcacaaggactaggaatttgtctctggaaacagctggttccacaaagaagtacttccacgacattgctatatacttgtgctggtatatttttctttgttagttaaaccccatttttataagcgtatcgtttcgtatagtgccgtactcaaagatcaaggattaaaacgctatttcttttaaatctgctatgtctgctgctcctgtccaagacaaagacactctgtccaatgccgagcgtgcgaagaacgtcaacgggttgcttcaggtgctcatggacattaacactctgaacggagggagctccgacactgctgataagataagaattcatgccaaaaacttcgaggcagctttgttcgcaaagagctcttcaaagaaagaatacatggacagcatgaacgaaaaagttgctgtcatgcgcaacacgtacaatacgaggaaaaacgccgttactgctgctgccgctaataacaacattaaacccgtggaacagcaccatattaacaacttgaaaaattctggcaacagcgccaataatatgaatgtcaatatgaatctaaacccacagatgttcttgaatcagcaggctcaggcaaggcaacaggttgcgcaacaattaagaaatcaacaacaacaacaacaacagcagcagcagcaacagaggcgtcaattgactcctcaacaacaacaattagtgaaccagatgaaagtggcacctattcccaaacaattactgcaaagaattcctaacattccacccaatatcaacacctggcagcaggtcactgctttggctcaacaaaagctattgacacctcaggatatggaagctgcgaaggaagtctacaagattcaccagcagttgctattcaaagcaaggctacagcaacaacaagcacaggctcaagcacaagctaataacaacaacaacggcctcccccaaaatggtaatattaacaataacataaatattcctcaacagcagcaaatgcaacctcccaattcaagtgcgaacaacaaccctttgcaacagcaatcatcacaaaataccgtaccaaacgtcctcaaccaaattaaccaaatcttttctccagaggagcaacgcagcttattacaagaagccatcgaaacctgcaagaattttgaaaaaacacaattgggtagtacgatgacggaacctgtcaagcaaagttttattaggaaatacattaaccaaaaggccctgagaaaaatccaagctttgagagatgttaagaacaacaataacgctaacaacaacggctcgaaccttcagagagcccaaaatgtccctatgaatatcatccaacaacaacaacaacagaacacgaacaataatgacaccattgccacttctgctacacctaatgctgccgctttctctcagcaacagaacgcaagttctaaattatatcagatgcaacaacagcaacaagctcaagctcaagctcaagctcaagctcaggcacaggctcaagcacaagctcaagcacaggcggcacaagcggcgcaagcgcaagcacaagcacaagcacaagcacaagcacaggcacaggcacaggcacaagcccaggcgcaggcccaagcccaagcccaagcacaagcacaagcacacgctcagcaccagccctcccaacaaccacaacaagctcagcaacaacctaacccactacatgggttgacacctactgcaaaggatgtcgaagtaattaagcaattgtccttggatgcttctaagaccaacctaaggcttacggacgtaacaaattctttatccaatgaagaaaaggaaaaaattaaaatgaagttaaagcaaggtcaaaagctttttgttcaggtgagtaatttcgccccacaagtctacatcatcacaaagaatgaaaacttcttgaaggaagtttttcagttaagaatctttgtaaaagagatcctagaaaaatgtgccgagggtatatttgttgttaaattagacaccgttgacaggttaattattaagtatcaaaaatattgggaaagtatgagaattcaaattttaagaagacaagctattttaagacaacaacagcaaatggcaaacaacaatgggaacccaggcactacttctactggaaacaataataatattgcaactcagcaaaatatgcaacagtcactacagcaaatgcagcatttacagcaattgaaaatgcagcagcaacaacaacagcagcaacaacaacagcagcaacaacaacagcagcaacaacaacagcaacagcacatatatccctcctcgactcctggtgtggctaattattcggcaatggctaatgcacccggtaacaatatcccatatatgaaccataaaaatacctctagcatggattttttgaactctatggaaaatacaccaaaagttcccgtatccgctgcggcaaccccatcactgaacaagacgatcaacggtaaggtgaatggcaggacaaaatctaatacgatacctgttaccagcattccatcaacaaataagaaactatcaatttcaaatgccgctagtcaacaacccactcctaggtctgcatcaaataccgctaagtcaaccccaaatacaaatccttctccactgaaaacccaaactaaaaatggcacaccaaaccccaataatatgaagactgtacagtctcctatgggtgcacaaccatcatataatagtgccattatagagaatgcattcagaaaggaagaactcttgttaaaagatttggaaatcaggaagttggagatatcttctcgttttaaacatcgccaagaaattttcaaagattctcctatggatttgtttatgagtacgctgggtgattgcttaggtatcaaagatgaagagatgcttacgtcatgcactatcccaaaggctgtggttgatcacatcaacggctctggcaaaaggaagcctacaaaagcggctcaaagggctcgcgatcaagattccattgacatttccataaaagacaacaaattggttatgaagagtaaattcaataagagcaataggtcgtattcgatagcgttgtccaatgtagctgctatattcaagggtatcggtggtaactttaaagacttgtccactttggttcattcatcatcgccgtccacatcttctaatatggatgtcggcaacccaagaaaaagaaaagccagcgtattagaaataagcccgcaagattcgatagcctcggtgctatcaccagattcaaatataatgagtgattctaaaaaaattaaagtagattctcctgatgacccattcatgacaaaatcaggagccacaactagtgaaaaacaagaagtaacaaatgaagctccatttttaacttctgggactagttcagaacaattcaatgtatgggattggaataattggacaagtgctacttgaacatttgaagtttccatacttttgatacttttgaagttacttcgtttggtgttatggtcaccaacatcttttttttctccttctttcaaactcttttttaactccagaaaagaaattctttatttcacaaaaatttctccccacttttaatgtaatttttctttatataatatatatatatatatacatgagtatcaatacaatataacctaatctagctttttatccaatggacttgactatcatcagtactagaaagtgtcatttccatcagtacgcttttttggccgggttagctagtgctgacaaatagttgaaccttcttgaattatctaaatgtctcccaaatcaaccacatccatatacgatcctccaaaggtagcaaagtgccacttcaagcaattataggaagaaagcactactcctataaaatatggcacactatccaccttccaaggatcaattgaatgaattgatccaggaagttaaccaatgggctatcactaatggattatccatgtatcctcctaaattcgaggagaacccatcaaatgcatcggtgtcaccagtaactatctatccaaccccaattcctaggaaatgttttgatgaggccgttcaaatacaaccggtattcaatgaattatacgcccgtattacccaagatatggcccaacctgattcttatttacataaaacaactgaagcgttagctctatcagattccgagtttactggaaaactgtggtctctataccttgctaccttaaaatctgcacagtacaaaaagcagaattttaggctaggtatatttagatcagattatttgattgataagaaaaagggtactgaacagattaagcaagtcgagtttaatacagtgtcagtgtcatttgcaggccttagcgagaaagttgatagattgcactcttatttaaatagggcaaacaagtacgatcctaaaggaccaatttataatgatcaaaatatggtcatttctgattcaggataccttttgtctaaggcattggccaaagctgtggaatcgtataagtcacaacaaagttcttctacaactagtgatcctattgtcgcattcattgtgcaaagaaacgagagaaatgtgtttgatcaaaaggtcttggaattgaatctgttggaaaaattcggtaccaaatctgttaggttgacgtttgatgatgttaacgataaattgttcattgatgataaaacgggaaagcttttcattagggacacagagcaggaaatagcggtggtttattacagaacgggttacacaaccactgattacacgtccgaaaaggactgggaggcaagactattcctcgaaaaaagtttcgcaataaaggccccagatttactcactcaattatctggctccaagaaaattcagcaattgttgacagatgagggcgtattaggtaaatacatctccgatgctgagaaaaagagtagtttgttaaaaacttttgtcaaaatatatcccttggatgatacgaagcttggcagggaaggcaagaggctggcattaagtgagccctctaaatacgtgttaaaaccacagcgggaaggtggcggaaacaatgtttataaagaaaatattcctaattttttgaaaggtatcgaagaacgtcactgggatgcatatattctcatggagttgattgaaccagagttgaatgaaaataatattatattacgtgataacaaatcttacaacgaaccaatcatcagtgaactaggaatttatggttgcgttctatttaacgacgagcaagttttatcgaacgaatttagtggctcattactaagatccaaatttaatacttcaaatgaaggtggagtggcggcaggattcggatgtttggacagtattattctttactaggtgtacatgtactatacacatagatgctaggaagatgatgctagaacttgattaacaattagttaaggaatatataatcacacttctacataaatttgctgttttaggctcattccttctttctttcaccctttagtagcgaagtacaccatttagctgcaccaacagtgttgctagatatggtgactattgtgaagaagggtattaactctagtagaccggcagacataccgaaacatatgaaacttgcgtaatgctcgtactgaaaatctttggcctgtttcttactgaatccctttagtaaaaagtacctctgcaaataggtaaaggttctttttggggccattagttgatttgccaagattggtcctacaataggaattagcgacagtaatgttagtgaagtaaaattggagactttaaaaaacattctgaatagtaatctgggaatcttaaaaatccgacttccctttattgtgttgaaatttctcaccgcatcaggttcatcgatttttctatgtggcttttgtggtttaggcaataccttcacctcgtttagaaattcatcttggtcttgcaacaccaaagatatatcaaatatctgattcgtaatatgggtcaggaccagtgttctacaaacaaaggcagtcaagacattcgtttgtaaaatccattgaatatgaaccagtatcacaccaagaggccctaataacagtatggcccatgtcactaaaagcggtacaagtgtgacataaaagagaccagcaatagtgacaaaaatcagggcatagcaaaccgcaaacagtaaaatatgcttccaataaacaggattcgtcagcacttcataaaacccctacggttaacaaataaaaattaaatatgttagtcataaaacaagtcatatcaatgcaaacaaaaatcatgtacttactaagaatgggtagataaatgctcttgagttgaaaatttctttaatgaagttttttctaagcagttcgtatctcactttcattgttggtatcgtttcaggaaaccaaatatcaaactgtcttatgaaaatctttagccaacgacttacgttactttcctttgaagaactgtgttctttgaattgtctttttaaacgttgtggccccttttctgcaagggtcatagaattagcatatgtggcgtgagaagcctggctgtgacttataagctcaattccggctttcatccttagtttgtctttacagccaaccaggggtcctcagggatataccttgccctttttttcctttttttgacgtcccttcacctttcttgaaagtgatttactttatttaggttttgaagttccgagtgtaaccaccctgattttcataagtcccctgatttcccaaattttttatgcatatacaaatgttgaaaagaaacgaatattattagcaagtaatatatagtatatagtatatatatatatttatatatgtaaacatataatgaatatataaattggtatgtaaaagagttgcgagcttcatggcggattaatgtgagctatagattgttggattggaggtgcataggatcctacagtaggctcttctggttccgcaggaggggaaggaggtacggctggctggtcccggtcttttatctctttaactatccaaagcgaagcacctactgcgtttgttccaatgaacaacccacccagaatgggaatagactctaataaaccgctggatatcgagtaaaggagccacttggcaaagcccttgtagtaaactttggaaagtttgcgcgaatccaaatgtagcacgtcaacaaaataaggctcaaaatagtaaaatcccattccggggctaaatggtagcatattgattgtaattggacccactattggaacgagcaacaataaaagaaacataaaggctatgaagatgtaccagaagaaaaaaatgaaaaactgcggcaaagagacgaggtaaaaccgtttcgaaaagaggccacccaaacgatgtgaccttctgtagacaaagggcgtgaaacttatcgtttcacaggcttcactcaactctgttaatccctttcttgcgaacgtcactccataaatacgtgtgaaaagaacgaaatcggtacccttcaccatagaattacatagcgttgtggaaatcagaatagtttgcatataagccagaggtaacgcaaagagtccgagaaagggcaaatagatgcacactaacaaggaccacgcaaggattgacgtaaacgcaacaataagcaggagattcagcaggtagtatccaaatattaggaaaaatagatgcaaataatccgagtttcccacggattcgctaattcccttcaaaggcggttagtatgacggcttaaaaaacatgatctgcttattggaacatcaacatactttatacggataccagatgatctggtgcgacgactctaggtctttccaaaaattgtctttaacaagcatagcattcttgtaccatcgaactatcggagccttgtatgccatccaaatttttgatttcttatggttcccttggtcttggatggggagtaattgtggttcctccccttctgccagtggcgtagaggcatatggatgtctatggtaataccaatcaggttggggtctagtcgacatgtttgcttggtgtcttagcagctcttatagttctaatgctataactaagaaagtaataataataataataaaaagctttatataatgttttattatggaagtttcgtttttgtggcgcgacgcgatcagccaaaatcagcggaaaaattcgtcggaacatttttttcttttttggccaagctattgttacaggtggggcaggggcaagagacgatatgtcatcgcgaagctgtaaagacacttgtcgaagtgataaagcgcaagagctgtttgtctacggaaccagcaagtactatctaatagcgtgttccagagaataacagcatttttcaacttctttctcctggtgtgagtaatcagtacgtgaaaagagaacgaagttaaaaaaaaaaacaagaaaaagaaacaagatcaaaagaaacgataaaggctggcttataaaataatagcatcgcgaacgatcaataaggggccctgtttatttttaacaaagtttacatatttcgttttcctctttaagctgacatcacgtctataccctgttttattccttgttagaaacataacggagcaggtagtaacaacaacagtataaactatcataaacttttttccttccttattggtgacttttaacacttagaattctaagtctggcaagaacagtaatcatacttctttgcagggcgttttattgttactcctctgccctgctagattaaagtaaagaatcataaacaaagaacacaatgacatacccggttagtgcagccgctcctgccgacatttcatattctaaaaataccccgttggtagggctctctaaacctccatgcttgtaccaacacgcttcctcgtccgtcgattcgttttcgtcaacattcagtgatgatgatcgttcggaccttgttgctgtacctaatgagtcgccgcatgcattttcgtataatcccatatcaccaaactcactgggagtaaggttgaccatcttaagaaggtctttggaaataatggtaaacagtcctgacatcttacatgagttgaagaaaaaagcacccgtaatagcataccccccctcacttagacacacaagaaacttaacagagactgccacgttatcagcatcgcgagatccgttaaatgggtctctaatttcaccattagtatccaatatgccatctcctgctagtagacccgtgatacagagagcaacgtccttaatggtgttgcctgataatgatactgccagtaaactgaatccagccaagtccgagttagaaaacttgttattcttgctaaatttagcattggaaaacaattccttcgaaagagcttccgatttacacatgctatcgttattgaatatcaagaaaataaactttgattcagacattcaaaaatcagaaactttgaaaaaggttttattagatagtttagcagaaccattttttgaaaactacaagaagttccctcacaaagatttaggttcgaaatcgcaatataatgaatatgaggagaaacacgatgatatagtctccttagcagacatcaaaccacaacaggactatagccgaattcttcatcctttcacatctgcaaaaaattctggtccagaggccatttttacatgttctcaacaatacccctggaacttcaaagctgccaatgatttggcgtgtctaacgttcggtatatcaaagaatgttatcaaggcacttactttactagaccttattcatacggatagcagaaattttgttctagagaaaatcatgaatgcagaagatgataaccaagaaattgtgtttaccggagaaactatacctatcgtccagccaaattcgacaagcaataataatgtaccaaatctgatttgggcttcactatgggccaagcggaagaatggcctactggtctgcgtatttgaaaaaacgccttgcgattacattgacgtcatgttaaacttgagagatttttcagtggacagcattattgatacaacacactttctggaaaactttgacaagaaaaagcagcaagaatcaacttcgccaatgacagaaaagaaaacggtaaaatttgcaaatgaaattcacgatattgggtcagtaagtcactcactgagtaaactaattgatgatgtacgttttggaaaagtgttttctgcagatgatgatttattacccttgtctatcagggtggcaaatcatgtcaacgaagagagatattttacgttgaattgtctatctgaaaatataccatgtgctgttacaacttccgtattggaaaacgaaataaaattaaaaattcatagtttgccctatcaggctgggctatttattgttgacagtcacactttaagtcttttaagtttcaacaaatcagtcgccaaaaacatgtttggcttgcgacttcacgagttggccggtagttcggttactaagttggttccttctttggcggacatgatatcttatatcaataaaacttatcctatgttaaatatcacattaccagaaaataaaggattggttttaacagaacattttttcagaaaaattgaggctgaaatgcatcatgataaggactcgttttacacttctattggtctagacggctgtcacaaagatggtaatttgataaaggtggatgttcaattacgggtcttgaatacgaatgctgtattattatggattacacactcaagagacgtggtcattgaaaattataccaccgttccttcgcagctaccgatgttaaaggagaacgaaattgatgtcgttggcagtagaggtagttccagtgcatcttccaagaaatcttcggaaaaaattcctgtgaatactttgaaggcaatggctgatctgtcgattagctccgctgaaacgatttctaattcagacgatgaagtagacttaaatcaagtgaatgaaaaactacgagaaacttcttgcggtaaagtgagaggtatcgaatctaatgacaacaataactatgacgatgacatgacaatggttgatgatcctgagttaaaacataaaattgaattaacgaaaatgtacacgcaggacaaatcaaaatttgtaaaggacgacaactttaaagtggatgaaaaatttataatgaggataattgaaccgataaacggagaagaaatcaaaaaggaaacaaatgagctagacaaaagaaattctactttaaaagctacgtacttgactactccagaggctaatataggctcacaaaagcgcataaagaaattttctgattttactattctgcaagtgatgggtgagggtgcgtacggtaaagtcaatttatgcattcataacagagaacactatatcgtggtcatcaaaatgattttcaaagagaggattttagtagacacatgggtgagagatagaaaattaggtactataccttctgagatccaaattatggcgaccttgaataaaaattcccaagaaaatatcttgaagttattagatttttttgaagatgacgattattattacattgaaacaccggtccatggagaaactggtagtattgatctatttgatgttatcgaattcaaaaaagatatggttgaacatgaagctaaactggtgtttaaacaggtagtcgctagtataaagcatttacatgaccaaggaattgttcatagagacataaaggacgaaaatgttattgttgattctcatggctttgtaaaattaatcgatttcggttcggctgcctatatcaagagtggaccattcgatgtttttgtgggaacaatggactatgctgcacctgaagtccttggtggttcctcttacaaaggtaaaccacaagatatttgggctcttggtgtgctactttataccataatttataaagagaatccttattacaacattgatgaaatcttggaaggtgaattaaggttcgataaatcggaacatgtcagtgaagaatgcatcagtttgataaaaagaattttgacaagagaagttgataaaagacctactattgatgaaatatatgaagataaatggcttaaaatctagttttccgtactctccaagataaagggaaagaataatttaatccattttcataaccatttaccttcataaatgttctattctttttttggctatatattaattacatttttaatatcatatcattgctctatatccttcttgtccagcctctatgcagtattttctttcattctattttggggcaaacttctgcgctgagcggcttatcgccgtcggagtgacatcaagtaccatagaaaagtcatcgtagacttacatatttaggcaagagaaatagttaggtaaacagaaagaggcactagcagaacgtactacggtgtggtttatacaagagggttctgtgaataatggctgcaagtgagataatgaacaatctgcctatgcattccctcgattcttctctaagggatttacttaacgatgacttattcattgaaagtgatgaatcgaccaagtcggtaaatgatcagaggagtgaagtatttcaagaatgtgtgaaccttttcataaaaagagatatcaaggattgcctagaaaaaatgtctgaggttggatttattgatattaccgttttcaagtccaaccctatgatattagatttatttgtcagcgcctgtgatattatgcccagctttaccaaattaggtttaacactgcagagtgagattttgaatattttcacgttagatacccctcaatgtattgagacaagaaaaattattctcggtgacctcagtaaacttttggtcatcaataaattctttcgatgctgtatcaaggttattcagtttaacttaactgatcacaccgaacaagaagaaaaaactctggagcttgaatccataatgagtgatttcattttcgtatacataacgaaaatgaggacaactatagatgtagttggcttacaagaattaatcgagatattcatctttcaggtgaaggtaaaactgcatcataaaaaaccctcaccgaatatgtattgggcgctttgcaaaacattacctaagttatctccaaccctaaagggcctttacttatctaaagatgtttccatagaggatgctattctgaactcaatagataataaaatacaaaaagataaggcgaagtctaaaggtaaacaaagaggagtgaaacagaaaatacaccattttcacgagcctatgttacacaatagtagtgaagaacaggttaaggttgaggatgcgtttaatcaacgcacctctactgatagtagactccagagtactggaacggcgccccgtaaaaaaaacaatgatattactgttctggctggttcattttgggctgtcctgaagcatcatttcacaagaagtgtgctgaacaaaaacggacttctgctcacaggtctgctgctactcttatgtttgaaaaaatataagtcattgatggcaattttcaaacatgttccagcggcctttcacactgtatacccccagattgtagggttgctaaaacttctagcgagtatatgagaaatatttgaatagtttataaaaccctacctacttattttaatgacatacataatggtttttcatctttttccacaatgaatggtggttctattttttcttgtgtctttctgttgtaattccatttgtaaccgtgtccaaccaatgcgaatatactttctcgatgtcttctttgtcctccaattgatgaaatttggaagattcgattagcttctcattgcgagcattgcagacatcgtttgctagacataaatcacacctcttacccctggccatgcagatcaattgaccaaatccaaccaaaacggtgtttatttcgtaccacagtgagtgaggtagccaaacctgtaactcctttctagtatgctcggcagtcttacacttaatagggtctacccaattccacattttacacagcctatggacatgaacatcgacgcatatgccggcaatcagcccccaacctttttgcagtgttaaatatcccattttaggtccaactccaggtaacgagagaattccctctatatcatacggtatatctgaatcgaaattgtctaccaataattgtgcggttcttttgatgaaattggcttttctggtatagaagctaacgcatcgaattagatttgctaatacaggttcatcaattttaagcagtccatctagcgtaataccctctgctatttttaatgtgtttaagcagtattcggtgatattcaaagccgcttgcgccatcctttcgtccctcgtttgagcagaaagcatagtgccaataagaaattgaagcctgaaattctttggatcgactttttcactaggtatcccacatttattagaaactaaaacaggaatcatgctacatcccatagcatctaccggggttttaaccttggacctcattaatctcacccgattatatatgggtaagaaactctcaggaactttcgccccagaatcgttaatcatttcttctttagttattggccgtccccaagttctcggatcatcacaagtccttgattcgatccattcaaaatactctattggcttcagtgccttgatccagtcaatatttactccgccgtaattttgcaaatctttattgattttattttcttttactaactcaacagttctctcattctttttgaaatacttagatcgaacttctacctcttcaatatcaacaggaatatgctttctcttcctagacctactttcctctctcattatatactgtgaaagacgttgtgcttatacattttttgtgtgctcccaataagcaacagattcaaaatgctaaagaggtccttgccttccttcctttctactacatgtatattcccaagttaggataactgcttcaccagctgattttgatttctcggcaacaaaactaacaaattaaccatgagttgtttaattgttcctgttagagaagaaaggagatctacacaaactaagctggataacggcaaaaaagaacattggagagagatttactgctcatacaagtaacaatgtttactcgaaggtttattccagttgttcagtcaactaagcaaaacatcggtaaatatgtgcgaaaagatgctaggttcactttattaacatacaacatgctctcaccgtcatatatgtggccacaggtatacacatacgttgcagagccatacaaaaactggagttataggcacagactgctggagaaagaacttttgaatactttcaaggctgatattatgtgtctccaagaaatgaccgcaagagattatgaagattattggcacgattccataggggtagatgtcaattatgggtccaaattcatttccaagacacccccaaagtattggaaaaaaccggttaaagatatggacggtgtatctattttctataatcttgcaaaatttgactttatatcgtcatcagggatctacttaaaccagctactgaatgttttcaatcaaagggaactgaaatacttatacaataagaaggtaacattaaccgatggtgcttccaatgttattggtgaagacagcttattggatgttttaaaaggcaagaatcaggtatgcttattcgtatctctaagacataaggagacgggtactatttttgtcgttttaaatactcatttgtattggaaatatgacgaagttaagctaacacaatgcatgattataatgagagagttatcaaagatcattaagcagctcctaccgggagatgtaaaaggccaagaaagggtgaagattttattcactggtgatctaaattctacaagagattcgctagttgttaattttctgcaaggtcagatagttagccatggagaccttaatcttattaacccaatgaggccgtatttggatcgttgtgtctatgacgatataccaaaggattattttgtacatacgtgctattcaggaaaattgaagggcatctttgattacgtatggtaccatgattcagattttttactaactaagatcctaaccggtaatgaagtatcagacgaattgctagcgtctaatcagttgggtttacccaatgaaaaccatcctagtgatcatatacctctactaacagaattcaaaatactgtgaggcattactatcttgccttttttgtgctttttttcttcattccttgttttattttatttgtacctctcttataaccttgttatcatactttttattcatttcaaatattctttccattattgcagtattctttaagtaatattccgaacgtgttccataatttgggtatgaatgtatttatagaaatatataaaacgcatgatttttcttttttatatgtatattatactattagaactatgtaaaaaaatgccagcatgtatagaggaagctacaagagataagaaataactagtaataatatacagtgtatctctaacaaaattgatattgtgtgaaaactaatgaaactatttcttgctcttttcagcttgagctttcttgaatgctatcgatcttttggtaaccctacctgtagcggatctttgtttcttcttttttagatgggtggaaccttcgcctttctttgctcttaaaccttcgatagttatctcttggcccaaagtggctctatcagccttacctaaaatctttttagctctacctgctctggttctttgtgaatctgtcaacccatttctatccaagccggtcccaatagtagtacccttcttcatgttcttacatctggaaacacgcaattttcttgcctttttagttggtttctttgtattttcgtcttcttgtttttgtgacttcataggcttttcgttcaataaaagtgctttgtttacactttgtaaatctttaaattgaacataagcaaatcccttacccatatttgtctttgaatctctgataatacggacatattcaatatcgccacatggttcaaaatgtttccaaagactttcttctatttcttcaaaatccaagttacctacaaagattgaacgcttcttatcatgcggagctggatgagcaactgaatcaactcttaagtgatgatcttggaaaacgacagcattcaaattcgagcagatttttcttacagcagacttattcttatagacgatgtaagcgtttattgtatcccttgacttatgaaatttttgttggacaaacgcaacttttctaggaagagcttcatcaaaggaaatagatctgaatcttatgctttcaatggcaaattcgttattgtcacttttcttagaactttcctcttctttttcattaccagattcctcagtttctgctatcggatttgtaccaaaaagttttttgaattctttataaacctttttagatgtgatgacagtacttaagatgttaccaatgaaaacagttctttctgccttttctaactcgtcttctttgaaatcaactttcttagctgctgatgtcagtggtactgaagtttcatcagttttcgttactgttggtttatcatcctcagcctcagcttcttcatttagtagtttcgcataatagcgggcttctaagtcttcatcctcgtcattccttttactttttttggccttctttacttttggaagggcaacttcttcagtttgctcatctgaaacatcaggtttgcttgcttctttttcttcttgatcagcttcggcagctctttcccttttcttcgaatcaggaaggacagtacgtgttttgcttttgacttccaatttattaataggtccacaggatgaactaaatagcttatctactgaagattctatttttttctcatcaatgttaccaaagagattgtcaattgcagaggacatttttcactttaaaatttatagcgtgataatctggtggatgatatgtcgactgttttcttaataaagtgcctcaagctatctaccttcaatataacagtttaaaatttagacaagcaaaaaaaaattgcgatgagcttgaaaaaatttcgaagttcgttttaagtgatcaatatatcaaagaaaatagaaagttgatgaaagtagtccgtgacagtaaatgaagcacttgagttgaggtttcacgtccgcttacaatatatatcatatatgaggacgaacatttacagtaatgatggaaggcaatttaaaagctgtctgcggaaacaagtgctattgttgctttccgtgtacaacccccattcacttcataaaagaaattaaacaaatataatataatagattataataataataccaataaacaaaaattttattttcctaatacctagacattatatataaaaaagatacaaggatgactgcgattctgttattagggagcttatttcaatgggatgaaacgggaagtagtagcaccggctctaccatgtctgactggggtgtaagtaatggagaattcacccaaatagtgacccaacatttctggtctgatttcaacttggttgaaagccttaccgttgtagataccgacgacggaaccgatcatttctggaacaatgatcatgtttctcatgtgggttctgactggagctggcttttcattttctggggcagccaacttggcagctctcaacttcttcatgaaaccggctggcttggaagtcataccacgggcaaatcttcttctaactctagctggggccaacttgacgaaatcttcagtggacatttccaacaatttttccaaatcgacacctctgtaagagtgggtcttaaaaactctcttcttggcattaacagcttgagacatgatcggtcgtgattatcttgttgtgtacttctagttcgtcttattctacaatgtaaggataagcactaacaaataagaaaaaaatgaaatccaagaacaaataaaagaagagaccataccataatgtgaaactctgcacaaaagattaaaaaggaataaattgattgcggataggaagggccaagcagacgattacggtgttgtctcgcagcttcccagcaaggagtttctcagagaacctactccgagtgaaacggacggaagagaccttccaaagagaaacgaaaatcggttctaggaggacgctccctctaagtgtctaggcccgtgttgggcggaactgccgcccaacacggtttccgggactatacgcccagacataacattgatttatacgcgcggtgtacggattaaaaaagttttgtacctgttttgaggctgtaactcatggcagccgaggggaataccaggggagagactataccggacgatatgcggaagacgcgcgaaacgtgaaacattttgcatggaactccaaagcgttgatacccgcttgaagtttagttaacctagtagcggagagccgttattattcgaggtttttcaattgttacttctggtaatttctacttccgtttattcaaaagctttttctattattttagtgatttttttctcattggaaattcatacacaacaacagaaccaatcatacaaaaatgaagtacttagctgcttacctattattgaacgctgctggtaacaccccagatgccaccaagattaaggctattttggaatccgtcggtatcgaaatcgaagacgaaaaggtttcctccgttttgtccgctttggaaggtaagtctgttgacgaattaattactgaaggtaacgaaaagttggctgctgttccagctgctggtccagcttctgctggcggtgctgctgctgcctctggtgatgctgctgctgaagaagaaaaggaagaagaagccgctgaagaatctgacgacgacatgggtttcggtttattcgactaaggttgagtaaatttgtgcaatctcgttatatcatatcttggaagttatagagggaagggcgcaaaaataaaccctttcctcttttttacggcgaccatactctttttttcctaatccttttcaagtttaaatccatgatttaatatctatttatacatataaataatataagtaatggtttaatgcattgtttcaaaaaaaaaataaaaaaaaaagggaagaaattatatataaatatacttcttcatcttcaaaattcaaaccgattgttttactggttagaatattatgtgtgctctttctttgctctatgacatggctctgttttgtaccttccttttttttatgctattgaataaatttgttgtagccgctttcctcaggaaggaccccatgtatttcatcaaatcatataagttgaatatcccatcaattgcgtacctagtacttaaataaaatactcacgtcgctttctttgaatatttggaaatgaattgagacctagtgtgctgtgtgcccttgttcattgacgattaaagctttaaggaccattactatgggtaagaatatcatccgggcaacggtatttcttaatcttttcgaagattcttttgccaccggaagggaaagaaaagacatcatatataggtggtagcaaaaccttcaagttagtgctcagcagttcatcaggatcagttgcataaacacaattacacaaaatgagtggttacgatagagctttgtccattttctccccagatggacacattttccaagtggagtacgccctggaggcggtaaagaggggtacctgtgctgtaggtgtcaagggtaagaattgtgtagtattgggctgcgaaagaaggtctactttgaagctgcaagacactagaattacgccttccaaagtttccaaaattgactcgcatgtggtgttgtcattttctggtttaaatgcagattccagaattcttatcgagaaggctagagtggaggcccaaagtcacagactaacgttggaggatcccgtgacggtggagtatctcacacgttatgtcgctggtgtgcaacaaaggtacacgcagtcaggaggtgttagaccatttggtgtgtcgacgctgattgccggcttcgacccgagagatgatgaacccaagctttaccagaccgagccaagtggtatatactcttcgtggtccgctcagaccattgggagaaactccaagacggtacgtgagtttttggagaagaattacgatcgcaaagaaccaccagccacagtggaagaatgtgtcaaacttactgtaagatctctgttggaggtagttcaaacaggtgcaaaaaatattgaaatcactgttgttaagccggactcagatattgttgcgttgagcagtgaggaaattaaccagtacgtcacccaaatcgaacaagaaaagcaagagcagcaagagcaggacaaaaagaaaaaatctaaccattaaaaacggcgatatatattgggcataaaacctatataaaataacagcaataataaaaatgcaaaatataacatagcacggtatagttagctcatatatgttttaacgagccttacattatatcatttaatacgatctcatgtttttcggatttcggatctcgccaagaaaacttgctgatatagaatggaatggaatgacttcaaaaactgcccactcataaagtttgcttctttaaattgaatatatattcacagtccgatttgaaaagcttaccatctgccacacgcattctactccctaatttccacacacagtgtttttgtttctataaagaaaaagaaaaccaaaatactgtactttttcccataattttctttccatacgcctatatgcccatactttgcccggtttatcgaacaacgctgtgaattttgcgagtcataaaagacttatcgtaccattataccccattcattatcaaaacattatcttatttatatatccaatttaaaatcctgttttttaagaaataatttccaatacattattataacttattgatacctatttagaatcgatatttggtcttttctttgagaagaaaaaagaaaagaaataaaaaaaaagttcacaaaagtttgtcatggaacaccaagatagttcgccacctagattcaggaactctggctctaatagagtcactgtgtataacggtactaccctgcctacgatgcccaagagcgccacaccaacatcgagctcaacaacagttactacgcatttgcaaaatattaaggaggaggaaacaaacgatgacgaactcacccaagtggatcgttcatctcctcgtgttttggggaggatctcctctacgtcctcatcttcatccaatattgatttgcgcgataacttggacatgttacacgaaatagaaaaatcaaatactaatatttctttatcagctcctaatttgcatgaggaactgggcgttctcagcgataaaggtaacagtaaagaagaattggctttgttaccacctttacctcacacaggagaaatggaaatcactccacaatttgatatcaacgaggctatttttgaacgagatgacatcagccactcttcaaggctagaaccagatgacgtgttaacaaagttagcgaactctactcgagatgctacgggtgaagatcaggggtttgttgtcatgactcatggccacgatgcgtcgacaaacgacgattcgcaattaagcgctactattcttgacaatcagacgtcatttgatctttctaaagctctagagatgactagccattcaaatatttctaatattattaatagttccggttctgagggaagacgttcaaggacaccggtaagcaattccactctgaaaccaaatttatcatctcctgaaagcgcagaacgtgaagcaaacacgacttcgtcctcctctacgtcggatcacggggcaacaatgcaatatgatcccaagaaaataataactccaattcctgttttaccttcctctgtccgtgaacagcaacagaacaatgcacctttgagagaaagaagcagatctaattctagtgcactggcatctacactgagagatacgatcatttcaggactgcctcaaaatattaattctgtagaaagaaagttatcaaggaagagtaacaggagtaggaagaatacggtgacttttgaagatcgtcttcagaaattgccacccttaagcacccaaatttcgaaccagtacgccaaggtagcaccagctgagaacaatatcgccttacactttcataacttacctacaccagtatcaaacactcaaacgcctgttacgtttcagtctgaatccggactgacagggggagaaaagaaaatgccttttttgagaagagcatctagtgccctattaagaaagacatctgccaaaaattgctccaatttaaccagaacaaatacacctactttatcgacatcctcaacatttgagtcagatctaaatgctcggcagcccatgctaattcgacgatcttccactattgataataaactacctaggaggcagctttcgtgctcgaagctttattcgcgcctcaattcggacagcaagtttgcgaatagcagtcgagcttcggaggaggtcttagtgtccactccaaatgacacagaacacgtctacagaaagacatctctaggttctaagataaagagaggttttactagaatattgagcgacagtaataatagtaaggaaattctcactttatcacccaaatctatggtgactacggggcctacagaattgtcgttttcctctttatcaaccgtgggaggacatccgacaacgccagtctcaaaagaaaatgatcgagtttcaatagatggcgtgagtacatttaatcgagcatcaacatctcttccagaatcatcaacagacgacatctctccactacgcgaagaaggtaagattaatgttcctaaaagaacgtcaagtagaaagatactgtctaaaaattcaagcaaaaaaaatgtactgcctgaacagcaaacaaagccaagtgaaatatatctggataaagaagccttacaaagttttgttcccgtactctctgtcacagagggtactcatcgcatcaatcgctcgtcgttacaaacgcaatctaccatcggattatgcattaccaatttaagaaacaaagaaggcatgaagctcaatgccaaggaatacgtggaaatcctggctcagcagcaacgcaaggaagatgaaaggtatgctgttttggaaagaaaatttgcatcttgtagatggtgcagtgataaggacctgcagtatttgaaaaagaaacgaatttccatgaataagatatggtctgattatgtccgattttaccgtggaaagttgaacaacccatgaaggaaaaaggtcttggctatatataacggcagacaaaatataagtatacacgtatatatggtggtaaacacgcatatactgtatgccatgtatttaccattacatagttatttacgcactctataaaaagttaacattgcattttaataaattccttaaattactctaattaggatggtagccctacctttttttttttttggcaacacatggtcaacttttcttctcatgctttaaaaggcgagaaaaaatgaaaattagcaaaatgacctttccctccttcccacattgaatatatacactggaagatataagcaaccagtactgtagataaaaaagatcactacgatattcgtcggactccagtcggagtgcagtgcccgattactcttaattgcacgcatcgtgccaagtttaattggtattgctcgaacatctaggaataagagaaggacttactttagaatgatgaaagaggtagcaatttgcagcagatttttcgtgattgaatcaaacaaagattaacctttacagaaccgctacactgatactaatgtaagaaacatttcctttattttttttctagcccgtagtgtactcttatagttttgatatttcctttctatctttgtaaatgtaaataatcacatttgtctgacaacacacttgttgccactaattatttcaacaagctggcatagctgatcttattaatcttgtagaccgttcaggatgactgggctatattatggcgttaactttcgcgttggattacctttttatgcgatgacaagatgccgataataggtatttactttcacaagtacgtgtacgcaattctaaaggaagtatatcaaataaaagggcgtggtacataaaagctatatccctagcatgaccagtctaatagatttgggcagatatgttgaaagaacgcatcatggagaagatacagagccaagatcgaaaagggtaaaaatcgcaaaacctgacttgtcttccttccaaccaggcagcattattaagatccgtttacaggattttgttacttacactttaaccgaattcaatctttcaccgtctttaaatatgatcattgggccaaacggatctggaaaatctactttcgtatgcgcagtgtgtttaggattggctggtaaacccgagtatattggtaggagtaaaaaagtggaagatttcatcaaaaatggtcaagatgtttcaaaaattgaaatcaccttgaaaaattcaccaaatgttactgatattgaatacatagacgcacgtgatgaaacaataaagattaccaggattattacgagatccaagaggagatcggattatctaataaatgactaccaggtatctgagagtgtagttaaaactttagttgctcagctgaacattcagttggataatctttgtcaatttttatctcaagagcgtgttgaggagtttgctcgcttgaagtcagttaaattattagtagagactataaggtcaatcgatgcaagcttattggatgtgttggatgaactaagggaattacaaggaaatgagcaaagcttgcaaaaagatctcgattttaaaaaagctaaaattgttcatttgagacaagaaagtgataaactacgtaaatcagttgaatctttacgagattttcaaaataagaagggtgaaatcgagttacactcccaactattaccttatgtgaaagtaaaggaccataaagaaaagctaaacatatataaagaagaatacgaacgagcgaaagcgaacttaagggctatactgaaggataaaaaaccatttgcaaatactaagaagactttggaaaatcaggtggaagagttaacagagaagtgttccctaaaaactgatgagttcctgaaagcaaaagaaaagatcaacgaaatcttcgaaaaattaaatactattagggatgaggtcatcaaaaagaaaaaccagaacgaatattatagaggaagaaccaaaaaactacaggccaccattattagtacaaaggaagattttctaaggagtcaggaaatattagcacaaacacatcttcctgagaaaagcgtatttgaagatatagacattaaaagaaaggaaattattaataaagaaggcgaaattagggatcttatttccgaaattgatgcgaaggcgaacgctattaatcatgagatgagaagcatacagagacaagctgaaagcaagaccaaatcccttacaacaactgataaaatcggtatcttaaatcaggaccaggatttaaaggaggtccgtgatgctgtgttgatggttagagagcatccagaaatgaaagataaaattctagaaccgccaataatgaccgtgtctgccattaacgctcaatttgctgcatatttagcacaatgtgtggattataatacgagtaaagccttgactgttgttgattctgattcttacaagctatttgcaaatccaattcttgacaaattcaaggttaatttgagagaactctccagtgcagacaccacccctcctgtaccagcggaaacggtgagggacctgggatttgagggttatctatccgattttattaccggtgataagagggttatgaaaatgctttgtcaaactagcaaaattcatactataccggtatcaagaagggaattgacgcctgctcagataaagaagttgattacaccaagaccgaatgggaaaattctttttaaaaggattattcatgggaataggttagtcgatatcaagcaatcagcatatggtagtaagcaggtctttcctactgacgttagtattaaacaaactaatttttatcagggatcaatcatgtcaaatgagcagaaaattagaattgaaaatgaaattatcaacttaaagaatgaatacaacgatcgaaaatctacgttagatgcattgtcaaaccagaaaagtggttataggcacgaattatctgagttggcgtcaaaaaacgacgatattaatagggaagctcatcaattaaatgagattcgcaagaagtacactatgagaaaaagtacaatagagactttaagagagaaattagatcaactgaaacgtgaagctagaaaggacgtatctcaaaagattaaagatattgatgatcagatccaacaactattactcaagcaaagacatttgctgtctaaaatggcctcttcaatgaagagtttaaagaattgtcagaaggagttaataagtactcaaatccttcaatttgaagcccaaaatatggatgtttctatgaatgacgtaattggttttttcaatgagagggaagctgatttgaagagccaatatgaagacaagaaaaagttcgtaaaagaaatgagagacactcctgaatttcaatcatggatgagagaaatcaggtcttatgaccaagacactaaggaaaaattgaataaagtggcagaaaaatacgaggaggaagggaatttcaatctgtcattcgttcaggatgttctcgataaattagaatcggagatagctatggtaaaccacgacgagtcagccgtaacaattttggatcaagtcacagccgaactgagagagttggagcacacggttcctcagcagtcgaaagacttggagaccattaaagctaaattaaaagaagatcacgcagttttggagcccaaattagatgatattgtatcaaaaatctctgcaagatttgcgcgcttattcaacaatgttgggagtgctggtgcggttcgtctagaaaagccgaaggactatgctgaatggaagatagaaatcatggtaaaattcagagataatgcacctttaaaaaagttagattcccacacgcaatcaggtggtgaaagagctgtttctacagttctttacatgattgctttgcaagagtttacctctgcaccatttagagtggttgatgaaatcaatcaaggtatggactctagaaatgaaaggatcgttcataaagctatggtggagaacgcgtgtgccgaaaacacttctcaatattttttaatcactccaaaattattgactggcttgcattatcatgaaaagatgagaatacactgtgtcatggctggttcttggattccaaacccttctgaggatccgaagatgatacatttcggtgaaacttctaactactcattcgattaatctttcactattgcataattaattatacacatatagatgtaaacatgtttataaccaagacgtttggtctcatctagcaaaaatgtcttctagtgtcagctgtcttacctcacaaatgtaaggcttcaccaaataaagaactaattaaatagaacgcgcttaagaaaagctgcaataattaatttcttatattaaattcgaggcaccaaagcaagcaaccgctacatgacaaaaatctaatctggtacagaagaactataaaataacaatatgatcatgttgagaataccgacacggtcttattgttcaccttcgaagctaataaagggcgtaggtctctcaccattgaagaaatctctgttatccaagaaaataaaggaagatatccatccttctttacctgttagaactaggtttgcgccttctccaactgggtttttacacttggggtcactgagaacagccctttacaattacctattagcaagaaacaccaatgggcagtttttgcttcgtttagaagatacagaccagaagaggctaatagagggagcagaagaaaacatctacgagattctgaaatggtgtaacataaactacgatgaaacccctataaagcaaagtgaaaggaaactaatatatgacaaatatgtaaaaatattactatcttctgggaaggcgtatagatgtttttgttcaaaggagcgattgaacgatttgagacactctgcaatggaattgaaacctccttcgatggcaagctatgatcgatgttgtgcacacttaggggaggaagaaataaaatctaagctagcgcaaggtatacctttcactgtgcggtttaaatcgccagaacgatatccaacgtttactgatcttttacatggacaaataaatcttcaaccgcaagtaaactttaacgataaacggtacgatgaccttatccttgttaagtcggataagttgccaacctatcatctggcaaatgttgtggatgaccatttgatgggaataacccatgttataagaggtgaggaatggctgccctctactcctaaacatatcgccctatataatgcatttgggtgggcttgcccaaagttcatccacattcccttattgacgacggttggtgataagaaattgagtaaaagaaaaggtgatatgtctatctcggatttaaaaagacagggagttttgccagaagctttgattaacttttgtgcgctatttggctggtctcctccaagagatctggcttcgaaaaagcatgagtgtttttcaatggaggaattggaaaccatttttaatttgaatggtttgacgaagggaaatgccaaagtcgatgataaaaaattgtggttcttcaataagcattttttgcaaaaaagaatacttaatccttctacattgagggagcttgtcgacgacattatgccttctttagagtccatatataacacatctaccataagccgtgagaaagtagctaaaattttactgaactgtggtggttctctatcaaggattaacgattttcatgatgaattttattatttttttgaaaagcccaaatataatgataatgatgctgtcacgaaatttctaagcaagaacgaaagccgccacattgctcacttattgaagaagcttggacagtttcaagagggcaccgatgctcaagaagtcgaatctatggtcgaaacgatgtattatgagaacggtttttctaggaaagtcacgtatcaggcaatgagatttgctcttgcgggatgtcacccaggtgccaaaatagcagccatgatagatattttgggcatcaaggaaagtaacaaaagattatccgaaggtttacagttcttgcaaagagagaaaaagtaataataatattaataaaaggtttcgatacaatagggtcatgtaaatacgtcatatacataatgtaattagccactactgtatacgtttattttgttattatgattaagcttgattaagtttaattaagtttaattgaattttcttaatgaagccgaccgaacgttctggaagagttatataggaatcgggtactaaaagcgaaatttggggataaaaggagagatctacattttatttaaaatacgtcaattcgactcaccctttaaatacgaaaataagtggtctaataaatttgcaaattcggagattgataagaaatatttgagtgagagaaaataaagaaatgtttgctgcaattgcctcaggaaatccattgcaactatcggtagaagtccccaattcaaatgggttacagcatacaattgtcctttctcgaacgaaaccgaaactatactcgcatataacactgtttatattacctaatgttacctttcctcaggattatatagctacagtctatttcaaacttagccctcaggaagaatttaaactatttgggtacctaagcagtgagaaacccagtgccatattcaaagtgcaaataccgagctcgaagaaagacgctggagatacaagtgatggattaggtgagatagacatggatgtagatgatggttcgggggccgctgatccgtttactgacaccaatggaagtagcagtaataacatatcagaattgattattggtatttccattgagcctcgagaacaaggaatgatgaaattagaagagtggaaggccagcatgaatgccgaagcacaaaagaacaactcattgatcttgtcaagacctaacttaggaataattcgaaatattaccacggcagggcagttggcacaagtttacccttcattgacacaagaattggccgccaaaatcgttcagcatgcatataactatttatcagggttcctagatgctcagggaaacgtgcccatcaagaggtttgatacatggtgggacaaatttagaaatagactggccaacgacgggacgtttttggatgaagtaactaaaaattagacacggatatataatatatctctaataagattcacgaaatattaattgaaaaaaatattattaatattaaactatatatgcaatgacagtgaaatcagagttcatctctgaaattttttattctatgagccatggggttgccaaagatcaagtgtctgctgtcgataagtttcttatcaaatgagtcttgttcagtatctctctcttggagcccattgtccaagttagattgcctggctttacattgttgcgctaaccaattcaaaaaccctttgttgatcgtgatgtcacttttgaaaattttcttcaagttgtaaagggtgtcaaaaaacgttcttgtatgtagttcatctatacttttgttctggaccatctcttggaactcgtttgcccactcttgcagatttgacgaccaattctcagcatttcttttgaacaaaattagatttgtatcgtcattttcgtacatgtcggccttcaaaattttgctgatcaactccaggacttttatttgtaactgtttgtccttgttgtttctttcatatacattttgtaaaacaaccgtagagtatataggaagatcttcggatgtgacaggtaattcgtttaaaatggacaagtatctttttattaggatattagaggatctgtggttagaatcattcaaatttgacagagcggccatgattttgcttttaaaatttggaaaactttcattaatgaactcgactacaggaggattgtttctcaagcagctggtaatgactctagtactgagctctctcaatgttaacggcaaattttcattgagactaaggttggccaagagggcgaattcatgggtaataattttgtagccgtgcttgtaatcatgcgcaaattccattattctatcaaaactatcctccaatctggcaatgtcctgtgaagataaagtcgggttagaatctatgatgtttctcatttctttgaaatcactggaaaattcatagtcaccaggcgatgctttcatgtcttctgaagatacaattaactcatggctaccattatcaccgacattcttctcatcatttagttttgcctcttttaaacctgtgtccatgtttattctaatgtccaaaccaccggggagttcttgacctggcagtatgggctgccaatcgtgtcttggttcaaatatcttaggatagcaacgattatcaacgcagatcgaattccctgaaatttcaagttctttaagatcttctgcagatatgatttcgcctccagatggcactgagtgtatggatgaatgcaatattgtactcgccactaatttcgaagatagggcgctcaaaattatgggaagaatccggaccattctaagtttgcgttcttggaagtgatattcaatatcgagaacttccagcgatgcgaaaactagtctattatagttgctaatgtgtgctctatcatttacgtggccttttcacatagtctggtctttcttaattatcacaattccgttacccgaaatctaatctcgtgtttagcttcgatctgcggacgttacttctaacgtccagaacacttcacccgctatttacgttttgatctagttgcggcctccaaacctgcagatgaatcgttcattacattcttgctgccactagttggccgctgcgtatacaacaagaaatatactatgcatttatgtaacgcgctttagtcagtagcctcagtaatgccttttctaaggtcagtatgtcaatatctctcgggtgaaccccaacattgttgttctttcttcgttgtttctctctcttatcatcttctgtgtctttgctttcttttgttcacaatttctcgagaaaaaaaactccgcaggaaatttttcacttttattttgcttatactataaataggaaggtccctgaactgatttgttgacagtgttgcatttcgtatataaaagtaaacagtgggctgtaacaaacatattatatatcactcgctacacacacagctctaaatagctatgttactacgttctcttacaagtgccttcgttttaagtgctggtttggctcaggctgctagcagcagtaacagttccacaccatccattgaaattaaaggcaatgcattttttaattcggaatcaggtgaaaggttttatatccgtggtgttgattaccagcctggtggttcttctaacttgactgatcccttagcagacgcatctgtctgtgacagagacgtccccgttctgaaagatctagggataaatactgtcagagtttatactgtggataactcgcaagatcattcccattgtatgaaactattgcaggagaacggtatatacttgatcctggatgtcaatacccccacgagtgctatttctcgttacgatccagcctgctcctataacgctgactacttacaaaatgtctttgccaccattgatacctttgctgattacgacaatgttctaggttttttcgctggtaacgaggtcatcaatagtgttaatactaccaacactgctacttatgtcaaggcagtggtcagggacatgaagaaatacatcaaggctagaaaatacagacaaattccggtaggttactcggctgctgatatcgtcgctaacagacaattggctgctgaatactttaactgtggtgatgaagctgacgctagaatcgacatgtttggtgttaatgactattcttggtgtggtgaatcttcatttgtggtatcgggttattccaccaagatgaagctatatcaagattactccgttcctgtcttcttaagtgaatttggttgtaaccaagtcaagagctctcgtccattcacagaaattgaagctatctattccactcaaatgtcttctgtattctccggtgggctagtctacgaatattccaatgaaactaacaattacgggctcgttcaaattgatggtgacaaggtcactaaattgacagattttgaaaacttgaaaaatgaatacagcaaagtatccaacccagaaggcaatggtggttacagtacttccaacaactattctacatgtcctgattatgaaaagggtgtctgggaagctaataacactttgcctgctatgccaagtgctgcttctgcttacttcacatctggagcaggttctcctatgggaaccggaatcgccacccaacaaagttgtgatgctaaggacgatgacgacgaagaagacgacgacacctcctcttcatcctcttcttcctcttcatcttcatcttccgcttcttcatcttctgaatcatcatcctcgacttcaaaggcatcttcctcctccccttctgctagcgaaacgagcttgctaaaatctgccgcatctgctacttcgtccagccaatcgtcctcgaaatcaaagggtgctgccggaattattgagattcctttgatattccgtgctttggcagaactttataacttggttttatgagttttcacccccgttctttaccacattgtttctaattattccgttagcgccgcttacttttaatgttcttaagataaaaaaacatcattaatattattattaaaaaattcatatatatacctatatctatatgcactatttatgcttccacttttcttttctttctaaatacatcattccaagacgtttttgtccatcttatgtaatgcatccttgatgctttgcaattctactttctgtccacgaacgtgcaatccagatgcaatgttctctaacgctgatgagatcgaagttgaatcctcaggatttagttgttcttggatacttttatttttttgcatatgttgacggattttttgatatgtgtaactgatcggcagatacctctttgcatcggaagccgcattcatttgtgcattcttgcaggaacatatttcgggtagcttgattgaattgtaatttacgtcagtttgttgttcatttagatccggtgacaacgcactgttggaagagaaagagcttgaactacatttattcgaaagtgattgacaaaaattcctactatgggggtctgatctacattgcttgcagcttccaggtatccatgacccatcctctttagtgatcggtctattctcgctatcgtagatttctttgtctccacagcatttcgatattgatttcttagcatcggattctattttcttttctgaacagcaaacggggactaaggatggcattatgttattcttttggttgcaacatgttactggtttcatggcatctttattcctacaacattttatttttttgttgccactgcctgcacatgcattgatactgctgctgcatgaagacagaggtgaattaatatggccatcaagcgatgaattcgttgaactaaactgtctgccgctcagatattgataatcgttggctatatcaatctcagacaaagactggtctgttaataccgcgggcacatgagatgttaacaatgggccttcagctttcctttttttaaactgacagcgccgattggtttaaagttttctaccatttctaatatcgaaataggattgtctggcgggttttctggctgctgttgaaatggagtattaacaatcaaaggcaaggctttttgcaattcgttgtttaatgctattgatttttgcaagttttcctttgtatcggaaaactcagattccagcagtttatatttcctttgccaatcatcgaccaaattgtgtagcatctcaaccttctcttccagaacctggattcttgttgttctgcgttccctatatgctctttgcgcatctctattttgcctccttcgcttttccacgctatcgacaccgttttcatcaccacttccgttgccttcatcatcagatttcccctcatgaccttttgcgccttcgttctcatgatcttttgtggtcatttggtctttctggttggaagtttgaaccttctttatcttggacgatccatcattattagctgatgcatccccgcgcttggatttcggtttgcggcccggttttaggcgctgtggtaactcccaattcttggataacttaatagctgacggtcctgatgtactcacatttccatctggtgaggatggaggtggagacgtcgtagacatggaaccctgtttatgccccaatttgaagcctttgggctttacgctaactgctactacagaccttcgttgtctcatgatccattgaaagtgtgcgtaaatgacaaaattttgtgcctttctatattctttaattgatgatttacttccttgataacggctcaacaaacgaagagcaattttcaaatttcaaaagaaaaaaccgttgaaactgttcttgagcaactttcaagcctcttatgatgatgtgctacagattgaagtacaggtgaaaagaggaataaccaatagccttgtttgctttctacggtggggcagcggattttctcttttatgcttatgcttcttcttccatatattactaatttttctcgagcgagcagctttactgcgtgcattaccgatgaaaaaaatcgccgatatatgaaaatccagctcataagatgctgattaaggagtcatgagtgaaaggaccctcgtggccatcacaaaaaagacactttgctcctgtataaaaaaaaaaataaggcggtagtttagatagggtgtctattatatacatgcataataatttagttttgaagggtcgctggttttgccgtgacgtacgcttctctttgatcttttgccattgttgtcagagaaaagagaaccgattgactttttttttttagttttttttagtttttttcttaggctttgatctaatatcaatctttcttaatgacaaaagtcttcgcagcttgatcggccggaatgggaggtacagattttgcttcttcctcttcatctaggttgatatcatctggcacatgctctctcgaagctctttgcttagcttcctcttcctccttctttattagttcttcttgctccttcaaaacgttcaatttgaactcgttatcgtcggatgtcttcttttcttcagcttccgtggcttccgcagagtcggtaggctctgcgttctctttttcctgagatatttcctctgtcttcgctgtttctgccttttcattaactacgactagtttaggagtaaccgcagaagcggtggtagctataacagactcttttgcggtggcttcttccttcggtatagcagtttcctcgggtttttcttccgtctttatcttcttttcagcaacttgcttttcagcttcagtttcagcagcggatgatttcgattcagatacatctagttttgcgacgttgtaaacgggatctggaatggaacttagcacttgtaatataccgtcgtagtacagatccaaaaggtcgtcatatttgctttttgtttcttttttttcagctagtggcgagaatgcctttgaatagttctcctttggaagtcctccaaacgtgaacgtggaactcaaaaccatcaagacggatgggattttttgtctcagtctcaattctagccaaacttttagattatcgaccaagtcctccttggatacaccgtacgctttcataccacgagacacacaagcttgatacagctcttcttgcgataaactttcaacgccttcgtagtcaatagttttatcgtcgttcattatatcctttagtttggaacgaatttggtaacgaagcatgttatcgttaccaaatggccttagtgacataaacttcgacattgctgccaattgtggtcttgacaagttatccaaaacgctatcgtttttgaacatttgcgcaatggcgcttatttcatcgtgttggaaagtcataatcttaccttccttggcagaataaagcttccggaaaaaattcaaaaatttttgcttcttctctgcattttcaatggtgttgtaagtgatcaaattggattcttccaaagtctcatgcaagaattcggatgtcttttttctgatctcgatgagcttatttctcttggcttgcttatccttgccggattcgtaagtggagggtagtaagttggggaagagtttcaaagcgaaaggcaaaaatagttcggcgaatggaataataaggaacgctgaaaaagggatcaacctaaacacatcgcccattgtcctcctcaattggttcctctctcttctagacaactcgtaaccctgagcaaatttaatcaaaagcttagtagaaactttgatttcgtaacccaaaagtttcgtcccattagcataatgtttcaaggcgtgcttcactttgaccataagcgtctccttgggcttggcaggagcatcggtggatgttggagctacgggcttcgtaacacttttcgacttatcagtagaataaaatctcaaagataaaggatagttgggctgtactccttgcgctctcaaaggccaatgacacgagggaatagtggaagctattaatctagggccttgatttttaacaaaatacaagcttgcttgacgtcttgtcacacatgacgctcttgatgcgaaattcaacatcttagtatattatctgtagtgatagagatagcgtatattatgcgctgcctgaaatgcactgcgctgttcatattcatcaccgtggcaatgactgatccatttatttggagatgattcaacgaataatttttcaccgcgggattatcgcccaagacggggtcgtttgagggtaataccgtggctagctttatggcttgtgaaactattgccagttatgtggttacgtataatctaccgtatgtgtgtgtgtatttatttatgtaggttgctaatgctttggtgatcgtttaaaggaacttggacgcaaccctcccacgggtgccagggcttgaaatctctttcaatgctgctattttgcgcgactctgggtacaccttataccccttgtttctatggttaaaccaattgaatctccagcagagctcgtgagcaaatagctcgccgaagccgagcatcatgccgttgaggaagggcaaaagtaggttgatggagcacgagcctacaaaggatacaaggctctgcacaagtgggctctcgtcggcactcactgtgttctgcacctccatacagtctttgtcttctgattcgtcatctgacacgctctcccagaatcccacaacctctgtcatatttctgtcttgtggcagtttcgtaagaaggggggtgatgtttctaatattacagtgatgttctattgttcaagtaaagtgtatggctgtttcttatggcgcggaatataccacttcgttataagtgattacatctcgtaacgcattcctcttgttcagtggtaggggaggccgatggtagtggaataatacgcttttatgggccattggtattactatttatcttcgttataataaatagtacacgttgcagacatatttggaggagagtttttaaagtactgttggggtgctcttgctgtgcattgtaagtaatcgtgtcccagtggccgagtggttaaggcgatgccctgctatttcctcagaaaagcaattaggcattgggttttacctgcgcaggttcgaatcctgtctgtgacgcatttcttttttgtgaattcttgcttcttatccttctacaatcctttcgtgacatttattgaatcatctctacaaaatttttacacatagctaaggttagcttgttctacattacacaagtggtagcaaaatcgtttacattgcactcagctatatcaacatcacgttctaccgcaactagtaatgagcttgcacattagtaaactgattgagcaatatcgttccactaaggacaatgaccttaaatatatgcttttaaggcaaaactttaaaattaacgacatagaggatgagctggctcctcttgttaacgaattgctgctcccggtattggtcgaagaacaagacatggaaattctcaacctagtatcgtttcaagtgctccccgatttagttctttctatgatcagcgaccctgcagctgctcagttgggatgggtaataagcttgatatgcgaccctttattaaaccaaagcatgatacatgcaaatcgttcttttgttctgattgagacactaagaaatgtgttacaaaaaattgaaaactcccctcatttagattaccaccaaccagtaaacagttcattagagtttatctccaaatttattgttgaaatgaaaaggcatatgtgtgatgtggatgctgcgcagctttcacattcactttctgaaagcaatatgctaatttacatagaatcccttaatctattgctaaaatttagcttcttttcagacgcggcaagtccttcagtaatggtcacactgccctttgatattttgaatgacgtttttacaattgcgcaggactattctgctacgaatacaaatgaaagcattgataggatcacagaaaaattacttttgacttctacgcaattaactcatccggtggacctggaaaatttatgccccaaaatgaagtacaatactttagcagcagtttctcgaatatggtacaaatttggccccatagtcgataaattatttactaaccggctattaccggttctattccccccgcaaatgggagaagaatgtaacgtcgaagatgttctcgaaatagttcataacttccatccatatttttctattcgtaggctaaaggataataggcctctattgtcagattcgactattagccagctaagagagggtttgtttggtatgctcagcatattaaacgactcgctgacaaggacgcaaaatgaaaacgaccatggtagcgacaatctgatcgacagtgacgacggatttggctcagacaacgatcctgaacaacaagcgtacctcgatgaactcgtatcagaaggttatgacgaaaacatgtatgacggtgatacggatgacgaagacgcagatgatataaacgttgaaaaaaatgatgaagccaccaaagacattacagaaacgaacaaaatccttttaatcttttctgagttacattatcctcaggaggagcgcttctctgaactgttggttgagttgcagactaagatcgctataaacacatccttaattgataaaattctttcaaaagagacaacagaattacccactcacaatggggaaatcgcagatttgaacgaaattctaaatgaagtgaaaggcaataaaccaattagaaaaaacgttattttttgtacgttagcgcatactttgtcgttgcaatccggttccgaattgtctgttctacagctatcaatagaggttattgatcatctgctggttaaaaatcattcaaataacatcactcgtggcgagcaatttcaattgattaagttgatattaccccatctaaaaacaaataaatcttttattgatacattaaaagcagggaattttacccaaaaaattgatgaaggagtgaccttaagaacaatgattctttctctactactacaactattcccactggattactctatgctaggtgagattttacccactattgcgcgatattctgtaagggataaggatcttggggtgagagatctgtccttccaattgctggaccaaattctacgcacatactataattacctaattggtatcgattgggaatggtataaagatgacttctatcaagttttgcaagaaacttgtattaaaaaagacataaataccaacctcttgctacaatttcctccttatctccctcatgactagatagttttataccaaatacatcatgcatcttttttttttccttatagtttgtgtcatcaacatgtttttgcccgtattaatacacaataatctatcctctcaggcagggagaagaaaactaaatatacatagcaccctcacacaggatgtcaaaactatcgtcttatcctcatgccgccgattttataaatatggaagaaccgccaaaatctaaagagtttttcgatgatctttgtgccgtccctaatttactcaaaagacgttttccaaactctcgaagatcgacgcattattgtgaggctttaaattattctaggaaaaagcttcctgttgtgttgtctaaaatgacactgcaagagttgaggcacaatatgtcaacattttttttgcaggaaaaggatcaaataaatatttatgacacctgtaaggtgatagacatgggggaccgtgtcttgctcgaaactatgcctccacagccaagagatttatttgaaaaattgcatgcaagtaaaacaaatttagtagttcagacagcagctttggatgaacccctacttacagtaaaagcagagctacagtcatcttcctttccacaaaaatcaagcctatttctgtatgaggattataaaaaatttatttatcaacaactagatatgtttagttaattacttacgaaaagagaggctattgtttattgttggccattttatttattattatttttttccaccttagcataaggaaacacgatttggatttcaaaagtagagctttaataacaaaagataaacaaccacagtgtcaagaacggttacaacgagaaggataggctgatgatttatcaaacatcttcttattggttcctagtaatttccctatttttgagcaacaaaatgtcgggataatattctcataatactcaaacactcttaatatcatatatatatatatacagtcattttttgttattcgttacccgaacttctttattattataaccagggaacatcaataacgagctacaataatcatgttcatctccctcattgtctcttatttgatgttacacacgcttttctagcataggaggaacttccatatgcatactaatagatcatgctcagaagacacggattattctggttaaagacatgtccccgtctaaatgttcttctaaatcaatccataccgatacctcatttgcttcatagccgtgatatttgccagcaaagatggtatgcaaaagggaaaagaaggaaccagatttccaagaaagagttaaagcctctcaatttttctattccgaattatatttctgtgaataaattggccaatttgttaaattgtcgtgtggaaagattaatcaaagatttgacagcattaggtttcgaaaatattacaaccacgtatatattatcaaaagaatacgtcgaattgattttacaagaatacaactttgcccttccgaatctgtcaacgtctacaaatttagataatgtttatgatgagctaaaatctcctgtaaacccaaaattattaaccaaaagagcccccgtggtaactataatgggccatgttgatcatggtaagaccactatcatagactatctaaggaaatcttctgttgtggctcaagaacatggtggaatcacgcaacacattggtgcctttcaaataacagctccgaagtctgggaaaaagatcacatttttagacacccctggccatgctgcctttttgaaaatgagagaaagaggtgcaaatattactgatattattgttttggtggtatctgtagaagattctctgatgccccagacattagaagccataaaacatgccaaaaattcaggaaatgaaatgataattgcaataacgaaaatagatagaattccacagccaaaagaacgtgaaaaaaaaattgaaaaagttataaatgatttgattgttcaaggaataccagtagagaaaattggcggagacgttcaagtgatcccgataagtgccaaaactggtgagaacatggaccttttagaggaatcaatagtcctattaagtgaagtaatggatataagagctgaaaactcccctaaaactatcgcagagggttggattatcgaaagtcaagttaaaaaacaggtcggaaatgtggcgaccgtcttggttaagaagggcactttacaaaaagggaaaattctaatttgtggtaatacattctgcaagatcaaaaatttaattgatgataagggcataccgattcttaaggcaacaccatcatatgctacagaggttcttggttggaaagatgtaccccatgttggagatgaggtcattcaggtaaagagcgaagcgatcgctaaaaagttcatcagtaaaaggcaagatcttatcgaagttcaaaaaaactctagtatcgttgaaaaattaaatgaagaaagggcccttgccaaagagcaacacctaaataaggaactggaacatgagaatactgtccaggaacacgaacaaaatactggtcctaaacttattaattacatcatcaaatgtgatgtctctggctcagcagaagcggtttcagaaagcatttcctctctaggaaatgacgaagtgagatgtaatgttatctcttcttctgttggtatacctacggaaagtgacttaaagatggcgcaaataacggagagtacaattctatgcttcaatttggggaatttgccgagtgaggtgatcaacaatcgtgctggcatcaaaataaaacagtacaatgttatctataagctaattgaagacgtcactgaaacactaactgaaaatctaaagcccatctttgaaaaaaagatcgtttcaactgttgacgttcgtgaaacttttgactttaggttaaagaaaaaaattattaggattgcaggttgcaaagtaaacaacggtgtcatcaaaaagaattcattggtgcaggtagttagaggtcctaacgaagatgtaatttttgatgggaaaatctctactttgaagcacaataaagatgacgtagcagaagtttcaaaagggcatgaatgtggaatcacttttgagagtggattcgagggtttcaaaccaggtgataagatcctagtttatgaaaacgtgcgagttcctcgttacttgtaaataagtacatccagtcgaatccttttagattgattgatctacagacgatgcacaaggaacgcatcgacacgtaaagaagataagcacacaaaaactgtacatatgtaaaaatacgtatataatctatgtaaatactgtaaactatttaattatcaaaaattcatgaaagacaaattacccactattcacgttctcgattcccactgaactttgacacattcttctacataaccgacaccatgttcatcaaattcaggcatgtaattttcaacatcagtgaaaacaagaatggtaccccattccataccgttatcgacagacactacttcttccagatcaaaaatcatctttggcattaactgcatttcaaagattctttggctcgatgggttgtagcccggtcttggcacagtgcttaaaatatcgacttttgtttcggcatatagcaaaggttttccgcctaagtcataacgtaatacttgaagcgggttgtaaccaaccacttcttggaatttttggaatgtgtcgtcatcaagaaacttggataatttttctgtcctcgggtccaatttgatcggatctttttcgagatcctcatctcctgttaaatctagtgcctccttatcaatttttaaattttttggcagctgcagatgagctggctttttatttttgaaggtttcctcttcaacgtacaacaaacaacttttaaagcatttattgccatcgtattctttgtccttttgtaaatcatgtagttttctcgccgtctttgcagaaacggtagcagattccttctttttgccttcgtccttgctttgtgatatattggaattaatgctatcagctccaaaagggttagcatttgcaccgccaaatgggttgcttgaaaaagcattacatttagaatctgaattattcgacaagtcaaagggattgatttggaagtctttttccaatgaagttgaagccattttttcggaaaggctatcaacgtttttattcttctttactcctctgatacagcgaacagaattgcccttcctttgacattcggtacacaggaagacatataatactctgtcatcctggggattaatatagctcatattattgataccaagacgttgttgtatggcactcatctgctcatcatctaagggcgaaaaagcttgtagtaacagcttcatattatccgctgatttacaagcaccacatttcaatagttcagcaggtggttcggaatccggatgtagccacttaggttcaccgccaataaagctatcttcaactaatatgtcatcagtctctttaacaggtgcgtccacaaatgctaaaaatacatctcccggtttactagaatacgaatggtcatcagtatctgatggtggtagctcttctattttggacatgagatagtggataattgactcttggcttctacttttcctcttccatgctggcagtatatttaccgattaaaaacgatgagatgaggccattttggtataacatgaattttccgaacaatcaaaaaatttttttccatcaaatatcaccacattcaagtctaccgaacaaaaccactttaccccagtcaagtctgattgacataatagtcagtttaatgcagcattagagtaacttcttcaccataacacggtacaagaagaataaagcttcctttttatgaacttgcaggtgaaataagcacatagatgtactgaaatatagtatccacgaaataaagaaaatgaagttactacgcccatacgtatttcactacttaagtctgctaaatggcggctattgtattcaagaatggaatcttttcattttctataagtcaatatttgagaatagtttaagtgtcggttaagttgattttaatctggaaaatactactaaagatacgattaagaaagaatatacatttaaatgttttaaatacaccctggttgaattttgaaactctaccaccgacctaaaaagcagaagaaatgttttggtaagaaaactgctactattttatatatcgcttaaatagaggagtggatgctcaggataacatgaaagcgcgcaagtggtttagtggtaaaatccaacgttgccatcgttgggcccccggttcgattccgggcttgcgcatttcttttttgtccaccaccaaaatgtcaatttttttgccattttctaaatagttttcttcactctacaagagatatcacgattgtttgctttcgatattatacattgactactttacgatgtgttttatatatgagttatgaattccttttcgtttttatatcctgatactgaagcatcttccatctattttaacaataattctgccttacgcttgctagtaattggatccatcaccgacctaacttgaacttcgaccttatcgaaaacgtaaacatccctcggtttatctgaatttgtaggcacaaaggttaatttgtattccacctcatcaaaagcggctgagttaggatcctcagtcaaattatccagtcttatcaagccttccacgccaaacttgggaaccagtacgactataccattattaaataccttaataacatatccagtttctgtggactcgttattcctcattacttgcccgacatagtattctatgcttgccctaccggcgaattgggcgtttctgtgctttctgttgatatttctgcaaatcatgtccattttattcttatcacgatgagtcaaacttaggggttcatacccaatggcacctgctaattgtctatgggccacaacatcacagtaacgtctaataggtgatgtgaaatgtgtgtagatatcaacggctaaaccatagtgtctaaagtcaggataagaataagctccagaataaaagtattgggctgccatcatacagcgagtcgacatgatacgaaccaatgtattaaaatatggatcttcgggatccacacacctgtctaaagaatcggccaaggccttggacgattccaacgaaattgacatattctttcttgtgtttaacatttcatttaagatttcaaaattggtagatggcggagctgcgtgtcttcttagcatcgccgtttgagggaaggcatcgtatatcttccttgccactgatatattagccaacaacataaattcttcaactaaagaatttgtcgccagtaattttttgatttccacttcatttggatctgaagtctcactatccatatggaccttaacctcaggagaagctaagttcaaggcacctgcctctagtctcttttgcttcagttttacagacaatttcaagagagccctcatacccatcgttaattcatcattttgggttttgtcatcaattctcagttgtgcttgttcgtatgagaaagcttctctagatctgatgacggatttcataaaattaacatttacaatattagcactatcatccaattcccaaatgacagagaatgcgaatctatcaacgtatggttttagagaacacaggtcggtacctagaagcatgggcagcatgtcaatacgtttgtctaccaaatatacagaagtacctcttgcagcaccttccgcatccagggcagtgcccggtttaacgaagtgagtaacatcagcaatatgaacaccaacttcccaattaccgtttggaagctttttcgcatgtagggcatcgtcaatatcaacacatcctggaggatcgatactacatataagtttatctctgagatcctttctttttgtcaataatggatcctttgaaacagcctcaggatcgtccagttttgttggggccttccaatcgtggccttctgcgggcaaacattctagaactttcttggaaaaaggcctatattcaacatcatgctccaacaataaggcctctgtttcagcttgagcagattcaattgtaccgaggtctctcacaaagtgacctaatgggtatttatgagtggtgggccacgaatcaatggaaatgacaatcctcttatccaataattcagcagcacgccttgttctgattctgacttttggaagacatttgtccatcaaaataacgaagacattctgtgtactactgctttgtggatcaacagaacttggtgctagttgaccgacgtactgtctccaggatcttctttgtatatatacaacttttgccgtgggctgaatttttttcgatctttgagctatcatagcatctttagcaagcagcctgcgctgcttgtcggaaatcacggtggtattggaagaggactcattattgtcatcgtcatcgccagcctcaatatcggggttatcgttaacgtcgaaatgttcagaatccaagacaatggatgagggtgccttccattctgattgaggtagcagttccacgataacctggtcaccgttgaatgctctatttaggtttttctgcccaacaattaacactggtttggaaaatcttggtaaactcactgaaccttctagaaagttgtactctgatatttgaatattgccctggtacaaaacgccatttttcaaaccacccattactcttgctgtagaatagtactccgggaacgtgaaatctgaaaatgtgtccctttcaagatctttatcaaaagaatccatttgaggaatagagtctctgatgtcgtctgcatttggtagtaactcgatatactgtaccaagctcttggttattatattggactccacttccttagtggcagcttctctattcaaacgatcgttggtaacaagaacgacgtttatgtcataaggtttcaagtgctcactataccattgacaggttttccttatagccctgtcgtttctgtcattaatcgtttcatttggaagcctttccacaaaagtatgttcactaaattcgttatgaaacacgatgaatctcttatgatcgtcactatctctgcatagagttcttaatctcgtgtacaccggatatgacttgtttctcacttcatctaggacaatctgggggacaatgacgtcgaaaaaacaattcggattctctaaaaggtcaattgcctgtaacaccacgttggtatccaagacgacgtaatgcttaccaatgggtgcgcttaattctaagggagaatctgacaagatgaacttcggcaactcattttgagcatcggggacgacaatttgcggacacttggtacaacttctcgaaagacatgggatgtccgatcttaaatagtgttctcttacgatcttggtagcgcctccattacgagaccttacaaacaccttctgagtgacgcttaaaccatctgcaagtctcttccgtctgggggcgatagcgggaactgacatgttgttttggcctgtatgatgcaagtatgataaataaaactcgtttgatcaatgggtccctcacaatgtatctctaagaagtactgcagtagcacacacattaaaatttttctgagatgagagaaaatgcctaaaagaaaagaaggcaaacaattacccggaaatagggcttaaatcaagaataaacccctaattaaaagttattttaggtttattatgacctaataaaaataaatactaacctaaacaaataccctaaagaagctacggcgctaaaaatatttctttttacggttttgccgcatggtaaaatcttttctttttttccttttccgccatgtgtcactgaatagaaacggcattaaatgacaaaatgacagtgaaaattcgaacgctcttttgctgccatgatattgcatctacctctcctatacttagctgtagtagtctaaccttgttcgggtgggggtgtatcgttaaatggtacgtaggcagtttttcacaaatttttctcttactttcaatatcttgtgtgggtcctatttcagaaaatatttgagatttcccaccattcactccagttcaaaaggatatattcatatttgtttgtatatacatctgagcattgcggatctaaatagtgtgaagtttttgaggtgactgactttctcaacacgtcgagcacgacatttcccaaaaatagctgaagaacataagctaagcaaattacgcaacacactctcatatgaccgaagactttatttcttctgtcaagcgttcaaatgaggagctgaaggagcgaaaatctaactttggatttgtagaatacaaatccaagcaattaacatcatcctcatcacacaattcaaactcatcgcatcacgatgatgacaaccaacacggcaagaggaatattttccagcgatgtgttgattctttcaagtctcctctggacggctcgttcgacacaagtaatttgaagaggactctgaaaccaaggcacttaatcatgattgccattgggggcagtataggtactggtttgtttgtcggtagtggtaaggcaatcgccgaaggtggtcctcttggtgtcgtcattggttgggctattgcaggctctcaaatcatcgggacgattcatgggctaggtgaaatcacggtgcggttccccgttgtcggggcctttgccaattacggcacaaggtttttggatccaagtataagttttgttgtttcgaccatatacgtgctacagtggttttttgtattacccttagaaatcattgcggcggcaatgaccgtacagtactggaactcgtctattgaccccgtaatttgggtagccatcttttatgctgttattgtttccataaatttgtttggtgtacgaggttttggggaagcggaatttgcattttccaccataaaagcaataacagtttgcggattcattatattgtgcgttgtcctcatttgcggtggaggtcccgaccacgagttcattggcgccaaatactggcacgaccctggttgtttggccaatgggttcccgggcgttctatctgttcttgttgttgcttcgtattctctcggtggtatagaaatgacgtgcctggcatcaggtgaaacggaccccaaaggcttaccaagtgctatcaagcaagtgttttggaggatcttatttttctttttgatatcactgaccctggtaggattcctggttccatatacaaaccaaaacttactgggtggttcatctgtggacaactcaccttttgtcattgccataaaattgcatcacattaaagccttgccctccatcgtcaatgcggtcatccttatcagtgttttgagtgtaggtaactcctgcatcttcgcttcaagtagaacgttgtgttcgatggcccaccaaggccttattccatggtggtttggttatatcgaccgtgctggtaggccactggttggcattatggcaaattcactatttggattactagcatttctggtcaaatctggctcgatgtctgaagttttcaattggttaatggccattgccggcctggccacgtgcattgtctggttgagcatcaacctgtcacatatcagatttagactggcgatgaaggctcaagggaagtctctggatgaattagaatttgttagtgctgtcgggatttggggatcagcgtattccgctttaatcaactgtctaatcttgatagctcaattctattgttcactatggcccattggtggctggaccagcggcaaagaaagggctaaaatattttttcaaaattatctgtgtgccttaatcatgttatttatattcatcgtccacaaaatttattacaagtgtcaaacaggcaaatggtggggggttaaggcgttaaaggacatagatttggaaaccgatcgtaaagatatcgacatcgaaatagtcaagcaagaaattgccgaaaagaaaatgtacctagattcccgtccatggtacgtgagacagttccatttctggtgttaataccgaagaaacaagttcaatttatttttgtagaatatttttttttctcttctctagtactcatccttcataattaattattccagatcatttaatgcataacgacatgacaataaaaaaaaaacctgacattttgaaaaattatcatttgaatacgtggatgaagacttcttcgagccaggccgcaataaaattaataatatatatagacatcaattcttgacctacacaaaaatagcttctctcggtagccaagttggtttaaggcgcaagactgtaatttatcactacgaaatcttgagatcgggcgttcgactcgcccccgggagatatttttttacttttgcacatcgctggtcttagcttttttacttgattcgcattgcaatctatctgccaagaatgaacaagtatttttttcctctgcatctttccctgccgtaggaatcaaatttgcaacaagtctgcaatgtctaacacctttgttgcagtcgaattctcgtggctgtacgcaatttctcttatcctaccgtgtgaaacaattcgcgtcgcgtgggcgccgaaaagggcttatcacggcacatctgaagaaaagagacggctggctccagctgatatttagatatttttagttgaataaagaggcaggcgtcagcgatattgcattgtcgctgtggtgggcagaaagccacggtaatgcatgtcctgttgtctcttatccttgttgataagaaaccctcttgatcagctagtcataattttgtctcttcttgcattctctttccgatatataacttatatcttcaggtgtcaggcaatagaaacaacaaggcacagcgttaaaagaccatcatttcattttagcttgtccaagcacataccatttttcactcaagctatagcagagaagttagtaaacattaatagattataatataagaaaggctatgaagaaaaattcttcggtagttttcttccttgtgggtctatcacaattcgtcactatggcgtttctcattatcggatccattacggctccaattttcaaacaaataggctattctaaatatgatgagatcacatacggtacattcggctactgtaaagagggctcctgctcaaaagcaagttataattatcaccccgatgagctatcagacagtgatagcaactggaaactcaatagcaacgctaggtctatattggggaaaatcatctttatcacacccattgctgctggtcttaattttttgggatttctttgtaccatcatgagcgttttattaattaacgtgctatccagtgatagagttggtagtgcgtctgccatcatgttttttgttaatttgacattttccactctaggctttctttctgcttctttgatatgtatcgtggtatttttactgttttacccacatgtaacctggtgttcatgggtcctgataccaggagctgctttatctctactagtaattcctttgatattctcagcttattcaagaagctcaggctcaagggatgatgacgaaaccgaggaactggaagaaaagggcatgctgctgaatgacccatatctaagttcgaagtccgggagattcgatatcgacgctgatagtgaggccaacctccgtggtgattcaagaacgaatttattgggtgacaattttaagaacggtactaatatcactgttgtcccagatattatttcacacaatcaagatccgaaattatcaaacataaccacttctaccacgtctgatatttctactttcgataaagaagcaaaggacatggaaaattcaaatggttccggacttaatgaagaagaggacgatggcatggcctatgacaaaaggaggtcaacttcaacgtattctgtcattgaaagtgaaagtggcttgaaaaatgggagtgtttctaataattatgtgagaaacaatggtagtaacaccagcaacaatataaactataaagttccgctaggaaaaacggaaatatcatccagtgcatcattagcgtcctcagactactctcaaagagaggtcataccgcacagaaatccttcgagactactaaacgacatcatggagacctccttcaatgaaccaaacgatagccacatcaacagcatgtcctcctacaacgataaagattcaacgttgacttcaatatcacagagaggtgtcaatccggaagtatacaatcaaatgcctcgagaaacagccgctggtcctgcaaatataaggccgtacgctggtcagccacacccggcgccattagtgtatccccaacaacgactacaaccacaacaacagcaaccacagcagcaatatcatcaatacaatttatatcaaagaactactcctgctggtccagatccttctaatgttattttacaaagcaatccttatttcaacgttgccccaaaccaagtgccacagcacagaaatccggtaccaggcgtcggttttgctccgaatcctttaccaaaccaaagcccgataacacaaggatataagcctgcctataagaggagaatgcaaaacaaaaacttgccccgagctactacttcactgaacaatccttacggatttaggtaaaaaaagaaaaatgaaggttctttttttttttttatattctacaaatcacaataaccaccaacttgtattaaaccatattttatcatcttcaggaactacttatgcacaatattcgttcgccagtctttacttgcggttcaattttatcccatataaatttgtattttattatcatactacatactttattgaaatcatatattaaccttttcacttttctcaaatagaacgagcaacaggtcatatgaacgctgactaaatctctcaattttcttcaaagcatattatagttcaaaatcgcgatgcggtaccgtgaaagttttgtcatcaaagtaggtcatccaaagcatcattctcagattctgttacttcaacgatactcggcaagttgctctcttcgtcattaatatgggtattactgccgtcatcatgactgttattaactgttttattatcatcattgttgtacttgttgctaccattattacgaccaccactgccaccgccatgtggtttcaacataacaaagaaaaagagcgctattacgcacaatgttagtaataaaatgactttacatttttgagttctcttctggtagtgtgttgctttattcaactctttatctgcactttttagctctaccactgtattttccagattataatcaatcctgtccacaatagtcccctggtcaacaaccaaatcttgcatttccctgaaaatagtgctcacttctaatacaccccttgccaactgagtaatttcttcgtcacgttctctcaaatatgcttctgcagaagtgtcatgaagctgttgctgtctctgcaacgtcctttttgaatagtcttcaatatcgaggccctctctcttctctcttgctgcctcctcttcctcatcatctaataatagcgtgttctctgcactggccttattgcggataggtttcaaatcatccttgttcaagaatttcaagtaattattttgtaatactctgaacttattactttcagtttgtatcttttctgcatagatcttctgtagattatctagtataatcagctcttctcgacttaattgcttaccatccacaaattgagagttgtatatggtctttaatcgtttcataacagcgtaacatttctgcagcatctgaattactttgaaacttagatcttcaatcagcgcctcatcatgactcttgtcttcaaagccaggtaacgaattcttcctataaaccttcgccaactgctcacttaaccgtctcacctccagaagataatcatcaacatcctgcgctatatcaataaatatgggtggtaacgcatcactgtgattctcatgcttgttttttcgttcatctgtcaatctggccgatatatcgtgagacatattcatcatcgggtatgtacccatttcaatatcttgatcatcgcccaagggtgctttcccagatgagaaagttatgttatgagggaaagtcctacggtatgataaaaataaattagttctatctctaaacatgtttgtaacgactgcctagatcacaaagcgataaaatgtacatcaattggagactttcctgtcttgccgtacttatagtctattctgctataatctatacgcactcactttacaccttaaaagcccaatacaaaccggtccaacaattataattcatctatagggcatatacaaaaaaaaaaggtaggtgtaaaagataataaaatacaaccctattagctttgataaaaaattagtagggttagaatgtcatatggtagggtgatataaacgcgtgaactttacgcgtttatatgtactaagttattttcggtattagagaataccatatcaacgactaactcttaagctttcgattgtatgagctgaagaaacggcctgctcattaccaggatatctcttttttttagacatcaaacaagaaaataaggaacaagaaatttgaggtacaataatgacagaaattattgatttagacttggtcgatgactttatcaagaaacctatggtcaaacaacagaaaaaccagtcttcaaagcctagggtaaaaagaaggggtcagttgacctttgatgatttcagaaacatcaaaattgtagaagaacctgttgtactttctcacaatagttcaattgacgaatcactggatgctgctacccaaaatactaaaaagcgggagaaatatgaaggtacctgtgatgaagaaatgaaaactaaagaaatggaggcaaatatggcaagcaaatattctaatatcaaaacacattcgaacgacactaacaaggtagagtcgatcagtgaacacactacttctaataatagaccattgaatacattaaactggtcaccaaatattcctttacgatattctgactttgcaaagtttatgagtgatgagacggtaacggaaagcaattgggcgcctcccctttgcacccctctcccatatgcaggcgatgttatgaagatcctttcttttatcgtcaaatttaaatgggtgttcagcgacgatctactgaacctgtcatttcaagatgtggagataggactagaattaaaggtggctggccattctgcgaagaatattcgaatttgtcaggataaaatgaatctactattttgcagtcttttgaggttattattctgctccgagaaaagagcagacaaccaaactcatagaaatttcacgctaaaaagatttcttagtttgaaaaatccatatggaaaactggttggcaaactcagaagcttaatccaggagtggggcttaccaaaagaatggcgtggtaatagtgatattttatctactctaaattttaatggaggtggtttgttgacgatggaaccattagatagaataatattattgagatgcatgatcgattggaattgtagctactccgcacttttccataatgaaattcaaaggctcactcacttgaaaggcgatacagggttcaaccatcaaacttttcacgccagcaggtttgctatgtgcggggccaataacatattagatagttgtgaagttttatgctctttgatgagtcaaaagttggaaaatcgaaagaaaaggaagcccagcgacaaaggaaaactgagtaagatcaatagtcagatgaaatttctaaagggtgttcggaaatcattgagcgaaaaagtaactacagacagattacgagctgcagttaaaataaatgaagaatggggtgaatattttgcaaacgaatttacacacacaccaattgatgatcccaccgtagacgaaatttacaagttaaggacatcagagtttatgatagcgagaattccacgagttggagatttctacttaccaccattctggattggcaacgaatgcagttcagtaaacactagttacagtttcaatgacatgtcaacttatcttaattacttcgtaaaattcaaagaggagggtacaaaaatactgcctgcaaaaaccgcacaaaatgaaaacaagtgtcaacttaaacttatatataggaacactcctgcatgtatccgtaatttacagttcaatgatgttcactttgccgaggtgccgcattggtttgaagttgcaggagactcgaattctttgagcaacttcattgagtatttggaaagtttatcatcacttactgaaaatgacaccgatgatacaaaaaagggtatagacaatctaattgagtttttgaaaattttcagtatattcataaatgagactattcagcgcataactgctgcccctacaggcagtactgaaggacgtcatttgcgaacaagctctcagagaagaaccacggtgcattactcgagtgatgtaaatggtgacgtttccgaggaaagtgaaaatgaagttgacattgacgttagcgatgactatgattcagaatatctgagtgaggagaatacattgacaagaaaaggtgaagataggacagataaatcttttgggaaaagagaattacacaatggcgctaaagattgtgataggaattgtgatgatatagagatcttctcagaacccgttaggcaactacaagataattctcgggaaaaaagaagcttgaggcgtaatgccagaaaaggtctatagtttgaatgccatgaagtgtagctgctggttacataaaatcgtcactagctttacacattaaatattatatacgaatttatgtacacgaattcaagtccgtaatttagtcttctgacttcgactcccgatcatcatgcagtgttttcttgctatcgtcttcctcttcaccagccaaaactttatgtttattctttgttgcagctttgacaatttgaacaaaggcatcctttgttaatgcagacttcaatttcatttgctcttctgttagttctccccctttcttctgagattgcagacgtaaatcatccaacgaatgtgtgacgccgtccagaagactttcattgagggaattctcttctatatcgttatcgccatcgtcccctaatgaatacatatttcttaacctcttaattctattattaagcttcacaatttcaatagcgtcacgtaatttcttacgcaaagaaaaccctttcttaacgtctggtaaaatattactagtttcaactctctttgaagtaatccatggatcgtccagcaattccgtagcagttggtctgtcagctggattcaatctcaatgccttcaagatgaaacgcttaacatcaatagatatgttatcccaatatggcatatggaaggttaccgggtatctcgaagctgtacattcctccatgaatccttcaacgctttcggcaataaaaggagaataaccgcacagtaaagtatatgtgatcacaccaatggaccatatatcacaaggcttaccatgtccatcttgtgtgaggacttctggtgccacataacccaacgatccggctgctttgtatatcaaatcctcctcccccttcaattgtttagctataccgaagtccgcaattaccagaggcgaattttctgacttatcaacatacaaaacgttctcaggtttcaaatccctatgaacaacattcttggaatgcatatactccacggcaccaagaatctgaactatgatttcaacagcatccacttctgtgaacttccctctagacagaattctatcaaataattcacctcctgttgccagctgagtgacaatatagaacttatccttcgattcaaaccaatccttgaatgacacaatgttcggatgactcaatttttgaagaatggacagctcttcgtacagcatctgtaattgcacattgtttccctgcaatgccttcttcaataagatctttatagcaacatcttcatttgtggacaactttctggcttgtctcacaacaccgaaggaaccggcacccagtgttcgaccgaaaatataattagtcctgttgacgtaagattcaggttgaccgcttaatttattgataaattttgctacagggtggccgtttagacgctctggatcttggacatctacatgaaattcagaatttatgacctctgactccttgggcatttttggtgtctatatttatattggcgatgtgatagaagaaaaggtgacgaaaagattgatcaacgaattgaagttctgctgatcttgaacaatatcgtattgttttatattattaggattaccaagagaaacagcaatgggtggcttcaaagggggcagggttctaagataagcctcaattattctcttcgcgctgcgttaaagcgggcgcttctccgaaagtacagcacgttctgaaaagcctcatcaacatagaatccatatgatgctcaacgactggaagtaaaaacatgaaaattgaaaaagaatatgcctgcaggagcattgggaagtacatagtggcttatagactgccaaaaaaaatcagtacggaagcaaatgaaccttatgttatccagggagcggtgagtaactgagtaaaaacattaggcaaatttcttccaaaaaatcattgacattgcctgtcaattgagtaaatgaataaataaataaatgcaaaaaagccaacctaactctcctgcaatgatacaatgagtactgtatcaacgaccattagtaagtatcatgaagtgttttgtatatttggaaaaaaccaggctgcattgccccagtggtgtatttatatctactgcagtatgttctattctgtgaagttcctaaaagacaccgaggtttctatggcctaaccatattgttgttctaacgccttttctatgtaagggtccttattgttcaaagccccaccgctccttcgcgcgttgtgcctatcattgtgtcagtaaatgttaggatacgggaagtgtatatattaattgagtggacacagaaaacgctctagaaaggaatatctcacaaagaactgtaatataagcctacattattgatttttttagttctcttgcccttatattaccgtaagtctgcggtataatcacctggcctagtgctttttcaatcatgttcattgaatactctagattaccaggcttcgaaagcatcaatatatcattttctagaggcatgctaagattggctaaatttactaatttcgctacatacaaacaaaaattagagtacttcaggctgttggcaggttcaaacaaatacatccaacgaatcagcgttgctgactttgagagacatccagatgaaatcaattatatttacattatactaatatccattctccaaatggaagagtgtatgccagtcctagttctatgtccaactgtttattgggtacgattccactggcctggaaaatgttccgtgaacagtttgaactttacgaatgaaacgttaaaaagcgctttccatgctgtcttcactccctattttgcactaatgaaaaaagttcttggaaggattaaaaacaacatgttgctatttgcagaacctcatgcaaatttaaataatttgtttgtcaagcatttccacgatctcatatataagagcgtaaaggatgaaaaaaccggcgaggcaattctgtatttgagaactaacgttaatgttccaaatgtttttattgacgataaaagagcagtttttcatggtgacggtatgaaaattggaaaatttaccggcaaatttttatgcttttccttcaaacgaacaataagatggtcaaaattagattcagtggattcttttgcggttacgacagtaaattatagagtatctgtaaattgggaaaagacaccaagaaagactttcctttctctagacagtgacaccaaaaatttacactatatatcgaaaaagatattgaataaaaagggaaagaacgccactacatcaaaaacaacaaaaagttcatgcacaagtgagaacgtttgcgatgataaaacattctccgtcgaattcccacttacaacgtcagcaaaaactgaatatttgttgagaagtaatttttctttagaaaaaattaatgaaagcaacaatcctacccttcaagaacttactttaaaccgtacacatcgcttataccgatcaaattttcgcaatgaacaaagcaccacacagaggaagtttgaaaaaatcggtagaactgtctctactgattcaggcaataaactgcttacgtttccggaacaaaaggccacaagagatagtaaccccttctcaatcgaattgacacatgcaacagtaatttccagcgacgaaagtgccttaaaagacactactaatcaagcgatagccgaaatgcaacgtataactcctgctattgcaaagacaatctcgagaagaacagcaaattgggtctgctcaaacccagctcctgatccgtatggggaaccttcaacgtggtccagaattttgacccctaatttgaaaataatatcggaatcatcaccatattatccagtccatctagcttcaccaaattctacctttagtagagatcaaagtgtaagaagtgttgtcatgaggagaagttctgtatgtgttgaaaaacaaaatagtttcttcagaaattacgaacatttcaaaaatatattgtcgagaagaactattaaggttaagacatcatgtcctaggctgagcgttgacgtaagtgacaacaaaagagaaaatttatcacaagaacacctcattttaccgaacaaatctagagaaaaagtcaaccgatttaaaaattgcctacatagagttgcagaagcgctcagagctgccaaagaaaactgggatcagcacaatcccaggaactctattcattaagtactgttagtttttattttgggacacccttgacatatagtttagaactttacctactttacccttgtaaagtttctttccttacttagcgaaactgtactgaataagttgtgtaagacagaatctttgattttttccaggaataatcatcactgcctactgctacaacagactagtttactctcccttttttccgtttttattccgacaaggggcatgaacattcaatactaaattcttttgtgctttttttgggaagccttttctaataagtaccagaagacacatttttatgtgacactactttaagcctcgaatgtttttttgtgccctattatttctaagcaaaatattaaacaatctaggccgtaattaaaacgcctatcttggtacagtgttacagcggcttatacagtttatgttaaacttaaaattacataaagtttcgagaacttccccttaagaagggtccgggcgcaggcaactgagcctactcggaataaacatcgatgaccgtttttggaaaaagggtttgtcgcggcatataatggatactgaagaggtcgcctgaaaacctgaaaattttttagccaccataaataataaatagttatatatattaaaacatcatttgctattttatcaaaattccgttgtagcgtggtcaattgttcaactatttcaattgttcagaaaagtgaagctacttaaaagtagaacaaaaaagagttactcgaacgttgaactctttgattatttaaagatttcagtttaacaaaaaaagtaaagtaacgtgagaatgtctgattcaacaacttcccccacaaccacattttctacttcattatcaccaaatgcgaccacatcattttttttgtggtaacatgggagtgatgtatacggccatgtctggatacgaaacagaagacgcacaagcctactgggcatgcggtagagcatatgaatcagcttttgcaacgttgactaaaaaggttccaggaaccacattctcagctgatatgccaacatctacttggcatggtgtcctggattgcggctattcctcttcaattaacgtggcagaaaataaaagttcgcccatcgattattggaattgtggtagaacatatgccaggaattatgctctgtccgatgcgctttcactgaagccaacgaatatgttacagtactttctattagtattattttttatctgcattatactatgagaaaagctcattaatatttgagcacttagataaagttgcatatgtgtatgaatacattctgaagcagccattaattattaatttattcaagggcataatcagtccaaaatttatgtttttacaattattttttttctcgttgttggtttctaaatgacctaggagaattatgtatagagattagaagcttttcgacaatatagacttcataataacgaaatgattttacttatgtctgcaattatttcctcatgccttcctgtattatcgcttgttagtcctagtacgttatttgcacgcctgttccgactgaattcgatgagagttggaatctatgtcacatttagcaccgtataggctaatattctaataagcgtgacaaaaaattggagtgttttacttgtaattgatgaatatcaattcaatgcccccatagcttttttttacgggtgattctttttttattgtatttttccaccacgaaccgtagatggcttattgcatttctacatgaaagaatagtaaatgtgtagcctttgttacgtgaataacttacttatccaagtattaaaagaattttggaccagatttcttcttctattactatccctctaattgaaatatgagtgattttgagataattgttggaatttcatcgttgttacaggttataatattaaatatacaaaatatgctggaagttcttcttgagtatataggaattcacaaaaggagagtcgatatatctacatattatgataatgtttacttcttcttccattttatatgttatcatttattatcctattgcattatcaaccttaggatttctgcttcctttatatgtgatagctgttccttaatcattatgtcaccttcctatgccgtatgtgataatatactagtaacatgaataccaataataagtggatggtactagaattacatttcaacataggctgagttgctttggaaggccatgatgtgtattataaattctgagtcttttcatggttctcagaaaagatcgggcgtgtggtctagtggtatgattctcgctttgggcgacttcctgattaacagggggacaaagcatgcgagaggccctgggttcaattcccagctcgcccccttttttactattgaaaagtattcggtcagacgtagctgatcgatgtagcatgtgtacgcatttctagatatcgagtaatttccgctgatgtataatatatatatatgtgtgtgtgtgtgtgtttttcatccagtagtttttttctttaaaaaaaactatgtataatataaaacatgcaatctagatatgctggataaatttatctggtatgacaattttcttggcaatttgctcgcccccgtctccatgcagagaatttacttcgtgattttctattgttaatttgacaggaataccattttctttctcatctgaatttgtgatcaaaaattcgtaggctgatcggcttgacccaacagaattatcaccagttttatgtaatgggaacgtataccacgtaggagatggtgtagaggttgaccttgttctcattgctaatgtgtctatattttgagtaggcactatccttatatcaggggaagttgttcttgtgggaagtagatctacttcgtttgcgaaaccttgttgatctgtcgctatcccagtgctatctgttacggtggtctgtgtcgtgatatcactattggaagtgaaagtcgtttgcacaacattacctttttcatcaaagacaggcaatctacaaataggacaagtctgagaacgttccatccaattctttaaacacgacaaatgaagtatgtggccacaaggtaaccttttgggtttcttgtttttattcttccacgtctgctggtttggagaatgtattaactcatccatacaaatgatacaaatattgtcatcatttgcagaattttgtagctgttctacggtgacagtgacaagagtgtcgtcgagctgtttgttatttctccagattttccacaaacttgtgccactttgatatagtgccaagatatcccacaccacatctttcaaaagcatcataggcatcctaaatggtattagcatagacaaatgaagtgccgtttttaagaatcttgtgaatacgtcaattgctttttcatacatgaatttaccctccaggccggtaaattgtctatcatcatcgtcgtcatcgtcgtcgtcattcagcactggctgagattgatcagactcaaccgtgttttcatctgtaggatcgccatggacaatatggttgttctcattagacagactttgttgtgagcgataaaattcccagaaattcaaacaagtctgtaggaataaatttagcaaatcaatcaaaagcatggtaaactccattacttgtatcaggtaaagggatgtggattcaatatcactcttttggtttgtatatatggaggagatgcatcgtgttattatctggtagtctacaaccgccaatagtacgaggttaaatgagaatctactaaagataagggttttcattgtggtggaatcatttattgactgtaataaggcctccagcctatcctttaaaatccaatggaaaactttcagatagagtagtaatagtccaaaaaatgccactgtgaaaaaataccgttcgtggaacagtgaggacataaacaaggtgtttataatggtaaatggtaacctttcaaaaatgtgctcatgctcaataagcctcagttcaccaaataatagtttcgttaggagttgccatagtaaggtagaatttaataagatgaatatcgacaaaaccattagattgaagccttcatttagcttcagtgttacttgcaaaaaggaaacgcttgtcttggtggctgaatacacgcaataaaatgtgagcaaatatgtgacaactacaaaaattgccaactgtttccttctattttctggcaccatattattattttgtctttctccccttctcttacaaattgcaattgatagatgattttctggttataaaaaggaaccaacaaatcggtagaaagtcgacagtataactagtggtgaagctgttattagaaatggtaggggggttttttttttgtcctgtcggcacgtatggaaatttatcgtctattaaaccttttctttgatttgatttctacagtgtacttttgtaggtgtccttaatttccatttttccgggtatgcaaagttcaacaaaaagaaagccctgaccaaatttctgcgtacataacggctactgcgctatcgttgggaatattgtgtgagagtatattttcatgctatatattatagtaaaaacataagagattagacgtgaaaggagagatagattacatatatgtatgtatataactcgggtacggagagacaaatttcaacttataataatgatacagacgttaatatggatagaatgaggatacaggagcagggagaattacgggaaatgggaaagaaaaactattcttcttatttcttacttccctttttttccactttcaataataatgctttatttatatgaggcaaaacaccacctgaagcaattgtagccctgatcaaagaatctaactcatcgtcacctctaatggccaattgcagatgtcttggggtaatcctcttgactttaagatccttggctgcattaccagccaactccagcacttcagcagtcaaatattccaacacagcagtcaaataaatggcagctttggatcctactcttgttcggccggtagcgtgccttttcaggtaacgcttaatcctaccgacaggaaactgcaagccagcccttgctgaagaagattgagatctcaatgaaccactgtctttagcgccggatttacctttacctccatgagcttttcctgacattatgttaagttatttttacgtgcggctatagtgcgaaattgaatttaacgatattttttccgactgaagtataatagagtccgcagtgttttttagttgggggttgtgactctattacactggataatagttcagctgttaaatagagctgtatgctttatttgttgttttttttgttttgttgttttcgtgcacggagcgagcgcggcgggttacggaacaccagcggccagttctacgagtagtaagttacgggcgtaaagttactgtgtgctaatctagcatggatgcattcagtaaaccttttcaattgagtctaacgttctctaaagaaagaagaatactgctattttaggtatgtgcttactaccgcttgtgcggacctgccctgattccaaggtaagagacagtgattcttgtcctaagctcttttctccggggcgggcgggcggctggcagacatattgattgcgggtaacacctccgaggttaattaatcaagcaacgtgcggagttttatcacatggatgtttcttatcaccgggtgcgcgccacgcaatatataaaacggtaaacatacgctgttgcaaggcaagacacaacagcggcaaacacttcagagaatacagacgatagtcatcagcactcctaataatcgtataatgaatactatacgaagctttgtgcgttgcaaaaagagcataccaggcgaagagagcgcagttagtaggtgatcgggaaattgctgagtacagttgtttgcctcctgtgataccgcgtcacatgaccatttaaaagtgtccataatgtcatcggtaacgtcacactcacatgagttttcctgacttcagcctccttcatctcgcgttaatacgccagcatcgcgcaccatattactgcccgcgtaatccaattcctcctttcgttctcaatgactaaaacgcaaatcatttttcctttttttttgaaaccggtggacgccccatagaacttccaaatcaggaaataccgcaacttcatccgttttcgtttcgctttagtcctccacgaaaatatcttgccggttccgcgaatgttgtactggttcttctgtgcaatgagcctttttctcttctttctttttccctgcttttaagatggcttggctatggaattactcaatttggcacttcttttgcaagatccagacttgcagggattctatcaccattattaccacactactatgttattgttacgcttttcatccacttttatataagttatacgtggttttacgagttctaatatttcacttttcagcttggaatacgccgttttaagaggactaaaagcaaggaaattacacacataataatataagtaatgatacgtccattatgttcaaaaattattatcagttacatattcgcaatttctcagtttctactggccgctaatgcgtggtcgcccacagatagttatgttcctggcaccgtgtcgtgtcccgatgacataaatctggtaagagaggctacgtctatatctcagaatgagagcgcatggttggaaaagaggaataaagtcactagtgtagctttaaaagatttcttgactagggctactgcaaatttttcagatagctcagaagttttgtcgaagctatttaatgatggcaacagcgaaaacctgccgaaaattgctgtcgccgtttcaggtgggggctatcggtccatgctaacaggtgcgggtgttctagcagcaatggataacagaactgaaggtgcttatgagcatgggctgggtggacttttacaaagcacaacatatttatctggtgcctcgggcggcaactggctagttggtacattagccttgaacaattggacatccgtgcaagacattcttaataatatgcagaacgacgattctatttgggatttgtcagattctattgttacccccggcggcattaatatattcaaaacagccaaaaggtgggatcatatctctaatgctgtcgaatctaagcagaacgccgattacaatacttctttggccgatatttggggcagagccttggcgtataattttttcccttctctaaatagagggggtataggcctgacttggtcttccattagggatttcccagtgtttcaaaatgctgaaatgccttttccaatttctgttgcggacggtaggtatcctggaacaaaagtcatcaatttgaacgcaacggtttttgaatttaatccctttgaaatgggatcctgggatccctctttgaactcttttgccaacgttaagtaccttggaacgaatgtctccaatggtgtaccattggaaaggggaaaatgtaccgcaggctttgataatgcaggttttatcatgggtacttcctccaccttatttaaccagtttcttttgagaataaactccactcacttacctagtttcatcacaagattagcaagacattttctaaaggatttatctcaagattttaatgatatcgctgtttacagtcctaatccatttaaagacacgaagtttttggatagtgactatacgacaagtattgttgattcagacagcctattcttagttgacggcggtgaagacgacgaaaatgttcctgtgttaccgcttatacaaaaggaacgtgatgtggacattatttttgcggtagataattctgccgatatgagattggcttggcctgacggttcttctttagtccatacctatgagcgtcaattcgttaagcaaggtcaaggtatgtccttcccatatgttccagatacgaatacattcgttaatttgggtttgaacaagaaaccaaccttcttcggttgcgatgctaataatttgaccgatcttcaatatattccacctctagttgtttatctgccaaatgcagaatactctttcaatagtaatcagagcgcgttcaagctatcatattccgaatcccaaagaagaagtatgattcaaaacgggtttgaaattgcaactaggaacaacttcactgatgatcctgaattcatgggctgcgtcggctgcgccatcattagacgtaagcaacaagctttgaatattactttgcctccggaatgtgaaacctgttttaaaaattattgctggaatggtaccctggatactaccccattaccagatgttgaaaaggatgttcaccactcctttatcaacgtcaatagcttcaacagctccataggacaagaagaaagtctttacgccggatcttcagcttcccagtcatcgtcttcatcatcgtcttcatcttcgtcttcggaaattccttcggctactgcaacccttgagaaaaaggcagctactaattctggatcacatttatctggcataagtgtaaagttctctgctatgattatgcttactttattgatgtttaccggagcagtataatatctcttgcgtaataacggtatacaaaatgaggcaataaaaatcaaagaactacactataaaataacgaaacataaagctgaaagactagcaaaatcactaaaaaactaaaataaaaaaagaaaatgagcatttcccctttgcattgaagtatcatccctttcgggcaagaccatgtttaaggaacttcactaatgacatcggaggtctatatatagcagacctcttctttaaaagatataactttataattataaccccgcgcaaagcgtattaatactttaaatgggtagtcaagttgcttttattacttgcacttactttgaaggaggatgtcagaattaccctcgccatattggtaatgtaatttttcacggactcgagattgaaaaaatttcagaaaaatttgcaaaaaagtgccgatgagatgagccttcataagctacgtatgttgtaagggtataacatctgtcaagcttcaccattgtcaacacttttccactaggataatcctccaaaagtatagcaatgtcatcttccgcccccaaatacaccactttccaagggtcacaaaattttaggttacggatcgtcttggcaacattatcagggaaaccaataaaaattgaaaaaatccgttcaggcgacttaaatcccggtctgaaagattatgaagtgtcttttctaaggctgatcgagtcggtcaccaacgggagtgtaattgaaatttcttataccggtactactgtgatttataggcccggtatcatagttggtggtgcatcaactcatatctgccctagttccaaaccggtaggttatttcgtcgaaccaatgctatatttggctccattttcaaaaaagaaattttctatattattcaaaggcataactgcatctcacaacgatgccggtattgaagctatcaaatggggactcatgcccgttatggaaaaatttggcgttagagagtgcgccctacatactttgaaaagaggttcaccaccactaggaggtggcgaagtgcatttggttgttgattctttgattgcgcaacctataactatgcatgaaatagataggcccataatttcatcgattaccggtgtagcatactctaccagagtaagtccgtcgcttgtgaatagaatgatcgatggtgctaagaaggtattgaaaaatctgcaatgcgaagttaacataacggcagatgtctggagaggtgaaaattcagggaagagtccaggctggggtattactttggttgctcagtccaagcagaaaggttggagttattttgcagaagatatcggtgatgcaggttctatacctgaagaacttggtgaaaaagttgcctgtcaattattagaagaaatatcaaagagtgcagcagttggtagaaaccagcttccattagcaattgtttacatggtcatcgggaaagaagatatcggcagattgagaattaataaggaacagatagacgaaagattcataatcctcttgagagatattaagaagatctttaatactgaagtctttttaaaaccagttgacgaggcggataatgaagacatgatagctactatcaagggtattggtttcacaaacacaagcaaaaagattgcatagcatgttctaatattattcaatagatattagaccactgtatataagttatatatatatatatgattatttaggtgtaacttcacggacaactgtctagagtataagattactggaggatcattgatgatttcctttaactcttttgggtcatctaaaatatcatcaaagagcgtatgcgaaaagcgcgttaagaatagattacttcatgacaaaatataattttccagctcaaaaatgtttgtttttttatgtagacactattttcaaactatctttgttaaattactcatcaccatcgttgaaatccagattaatccaacttggccatgctaactcctttcttaaaaaatctttgaatatcgtaaacaaaaactgttctagttctccaacacttcttaatactgagccctgtccctgatattgttcccctatttcggtttcaatcttcatacttctcacaatggatattcgctccaatggcttagtagctgccagaattggccccttaggatctaaaacagtttggttgtcatccagtgcaggatcactaacatcacacagaaagctaagaaatagttgctttgataaacatgcaacaatgcaaagggaatggagaccgatatcactgatagaaagttttactggcaaagtcataaatttttctacgggataattcagcacaaggtcggcaccaatcgtaacgagtaagtcacccttgtactcgacctctagtaaaaattgtatatcgttgggggatggcatcaccacaggcgcctcaaaatcatctttaggtccttcatgattagctatagtacgatcaggacaaatatgttcgctgtcctccttgttgtcattattttcctccgtctcttgatcagcctcctctctaattgaatcataaaactcatctaggggatctgttatttctttcagtgttatagcaggaccaacttttcccagatcaaaatctagtaccctaagattacttacgtagcttggtagttgcgtattttgtaaatatgaatttaaatgttttcttataagatcattcagtctattgtcagattccaatgtactccaattaatatcaaaagacatttggattagttgaagccagcttatgatctgtttcaaccgttacataggatggcatgctttttctcatgttagagaaaaatttaaagatcgagttgtctgaaaaacctgaactatttaaaacgaataataggataaggagccaaacaataaacggctaaagataccgtggagaatggttttgataataaggccctcacagacattgatattattcaggaaagcgatgctcaagccaattgggagatatcctcttaaaagaaatttttttggtttgagcggtaccaatcacactattagggaacagcgatatgttttgcgcaaggccataaacgcccctccaagcacagtctacgctgcagtgtcagaagttgcccaatataaggaatttattccttattgtgttgattcgtttgtagataaacgaaatcctgtggataacaagcctctcattgcggggcttcgagttggtttcaaacaatacgatgaggaatttatatgcaatgttacctgtaaagatactgatcatacgtataccgttgttgcagaaacaatatctcataatttgtttcaccttttgatttcgaaatggaccataatgcctcacccaaatagaccaaatgcggccatggtagaacttctattaagatttaaattcaaatctcggatatataacagtgtctctctaatatttgcgaaaactgtgactgaattggtgatgaacgcatttgccaaaagagcataccatttagtaagattagcaatgctaaaaccttcttctaaagaaggctctccgtgatatcttccgtataatttcagataacaaagatcatgccatccaggataagcgtatgcatggttaaatttttagactatagaacaagatttttctgtatagttatgtttatagtatttaagctttctaacaagctccagtaggggcggaggatacaaacaaatatattttgctgcaaaatttcctggtcttccgtcgcaatcaacaagttgatacgcagatgcaccattttattcattggcaaagtacgatcagtttagtgcttgtatctgtatgcgaaaaaagaatggtgtactaaaaacagcgcatggtgatggcgaggaatttacacgtatcctctcattaattgaagtattaggttttcgagtcgcacttagtgtaaatgaggtgtagaaaggtggggacgcaattattccttaccgtcgagcagttgatccagatgaacactgggaggacggtacttctttactttaccctgactaacatttgattttggagtagagcggtcttcagagtcgggacttaaattgtatgatgtataattgaatggattagtgctgtctgtaaactttcccagtatttgggtagcaccaggttcccttggagtactggacaaggaatcatatatagcactctcattgctttgagaccatgtattagagttgttggcatcagattgcagaatttcggtgggtgaaataaacatagatgatctgaagttatcgttggcatctgttttattgttcaaaagattcaaaacagaagtggatcctagagtatacaaactcatacgagatgagttatttttcagaactttttctgatatgtcactgtcgtcagaatgggaagatgtttcactttcgtcgtcattaatgtttgtttggaagtagaaaggatcgtgttggtattgattttctagatttctcagcttattttcctttctagcacttcgccatgactttatattcaatgcaatccatgcacccgtcagtgatagtagaattgcacctaaacagccagcaaatgcaatgaacacagtaccgttaggatgatgagcctgatataagaatttatttccgtccgtaaccgggatataaacgctggaaggtgtaatagatgaagttgatattacactgttgttgctccataaactagagttggtgtataagcttgtactagcgctcgtggtgattttgggcattttagtgcttgaagtgacattatgacttgacgaaacatccttactggttactgagcttttgcctaaggacgtggttgtcttggctgaagagctgcctttactagaactatctgctgcctttgtactacttgataaagagggcaaatttgcagcggagacaagttgaaattcttgtagagcaaacaaatgaagtagtagtatcactttccaaatggagatttctggcagtctcattgtgtcgttactagtttatgttgacaatcttttccctattaatagttaaagactttcctgtttcaccgtaaagcgtccttctgctgatgtgttatttgtaaaataaagcaagctaagatgtactacgtatctcacatccttatattggaggaagcatggatgcaaatctttttctttttcagcagacacttttaatagaacggaaggccccatctagaacaggaaattatgatctgaatttgtttgattcagcttagcatttcgtggcttctatttcaatagagcggttcttccttacagacggcgctgtgttgacgacttttcgtgtaattcttgtctacgctaattacttttttttcgcgatcctgccacacttacacgcagaaaacgcgaaaaccgccaaaatttcgaagggcatacatgcgacaagggacggattcaagccgtgtcactgagcatgcattcttgcaaaggttccaagtatttttgcttccaaaacatcaagagatacggacaatacgtttcttatatgcaggtaactaagaaataataggaggggtaaagtaactgtggcatgattacactgcagtatactctttaaaagttttaaattatttctatatatgtgtataagatatcttcctagtaaccctaatgcgaacttgatgcgtgaatgtatttgcttctcccctatgctgcgtttctttgcgttaaaacctccaattttcatctaccgattctatggcccatttgaatttttctcttagggtttttgtaaaaatcttttcaatcggaacatcatactttttgcaaaataccacagaaagtctagggtctatataattgattttggaagtgcccagtgaaacctgggagttttcctctttatctttcaactgaatggaactagtttggatacgctgttctaatttctctacttgtgcttttattttttcgactgaattccaacttgatttcagttccacttcaccggttttcaattccttttcgaattcttgtttcttttcgtcgactttctccaaccattccttcaattgactttccggcaataattcttccttttcaaatttcctcttatcgttctccctaacaaattttcgctgatatttttcaatttctctatcaataattctcttgtgaatggtggcttcatcttctttcgtcaaatcgtcgatttcttcgaaatattttggctctttctttaaaagatccttatccaattgtaaaatggccctcttgcaacgaatcttttgccattccaactcttgtattctattattggccttttccactgtttgtgcatgccccttcgtgacagtcctttgatggttacataggatggctacagttctatttgctgcgttgtacttcaatattttctctgcgacagatcctttatttggaattagatccagttgatcttgcattgttttggaagcattatatgtacggaaaactttagcagtcaatcccggcatgtagttttgtagatatttgttcagtatagatggatctagacgatcaaacagttgatgtcctggctgtttgggcggccttttaaaaattgtcaaatttttgaaaacttgtttgtcaacttctacctcttgataaaatctaatagaatccttacctaagaaatcaaagataacagtattcggaggtttcaaagtaacatgctcatatcgcaatgaacaacaacccacagtatcggcttcatcttcggatttttcaccaccggctcttaaagcgaatacatcgatcaaataaatggctacggccttttggcgctctagcataactttgcttttcaaatttctcgtgtaatcccttctgatggcatcgatataggatttcaattgtctcgccttttcaaacttcttgtagtcactttgacccttcaatgaagagttcgctgccaatctgacgtatttgaatgagttgaaaatattctctctccacatggctaaccattgaacggtattgtcgtgtctgatttcaccccacttgtgcccttctggggctggcggaacgggtgcgtctttacttagatttaaaacgatatcctcaggattcactcttctcttcaatttgcctgtttttgggtgagcgccacgacctctaaatagatcaggaggttcaaccttgaaattccctacttgttcccttctgccatctaattcacagaatttataatcttcctcgaatttttctctttccaaacgaatctgtttcttttcttgggaagtcagttgctttttctgttctttttgtaactggaagtaatcaaacattttggtgaaatcgcaacgagaaaattcctttatctcaattccattgaggggaccaccactttctttcagtacttgcaagaaatcattgaagaagttcttttggaaaacaggatttttggcatgatcactctctaatagggcagcaaagaacccggctacttcttcagcttgcggaggtaaatctactggcttcccatcgtaatataatttgatgtgagatggtaagggctggtatggtggagggaatataacaccgttatgcttcagtgtgacccattttatggtgtcatcttcgttttctttttcccaccatttatattcttcctcctcctccttcgctttcttgtcctcctcttcttcttcttctcgtttctttttttcgttctcctgttcttcctttttagttgtttttacctttacatcaccatcttctttcttgatttttttaggctttgatgtcgcgcttttctttgctggaggcgatggtaatgacgacgattgcactggttcggtctttattttcttagtctttttcttggaaatcttagagattgcctcatcactatcataaggttccgcttcgtcttgaagagaggcagagttcatggacgccacctttcttttttttaaagtttgagataatggcacatcgtcatcgtcatcagaagacaactcatgattaactttggaagcatcagcaatagtcatttttacgcgtttcaagtttcgagctctgccctccctttagattttttttatttgctgttttaatactataagaataggactcaggtaattagagtaacagagaaaacaaaaaagaatattgcgctcgtgttagtgttgaaacaaaaaaatacagttgttctttacgtgcatcgatcatataagaaaagggaaaaaagccgtaaagtaaaaaaataaagagctttccatggctggttttttttcttttttttttttttttttgaagactacagcaggtattacccggagtgaaaaaggtttctcacactaaaatttacgtgttcaagacattgaagttatgtataaatatatatgagcgtatattatgtgtatgtccgtttccattctgtttagattttatggctatagtattaaactcctatatatcaaaatgcgtcgtcggcggctagagtttgcaggttccactcggtttcgaaatttgtcttcagggcgccaagcttgttaatgatgctgttacaggcgtttttcaaggcatccttcgggtcgtagccctcggtggtctgtattctcagcttgaaacgagcgaagaagggatgctcaaccttgtaagcggcaaacagcacttttctgtcgttcagaagttctgcacgaatcaggtttcccaacgtgtggtcctccttctcaaacgttatcactactgcgttgggggctttggtgtcggggtcaatctttagcttggattccccttcacccagaaggaacagttcgaatctgtctggagcattcatgatgcagttgtgtccaaatgtatctggtttggtggctacgtagctatctatttaggctgcacggctcagttctctcgctcttcttttaacggacctcttgtgtgtgccaaagcagtgaacctagaattttcgcggacacttccactttattaagtccgggtaatgataatattgagcttgcaagttttttgaactcggatagcagcattatccatgacatgacacggatctaccgacgaggcttaccgacgaggcttaccgacgaggcttaccgtgatccctctccagtagtctgtaaattctgtttataatttaaaaaatctatcttctactccagtcttgtaactactgttgttacgcgctgcccagagtgtggcacacactgcggggttacccgtgtaacgtagaataaaccagtacgggtaatgatatcggattttctagtgatttttttccattcgcaaaaaagtcgccttcattttgcagttcttcagcaaacgtgatttgcaaaacaacggttactccccttccctattacatttgtcttccctttttcgcaccagcattgctaatattcgaggcaccgtacctaactaatcagctcattcacgtaccacatattctttgttacttccctccctccacaacaggctacgctattgaccgctttcagtatagtctctttacccttttgttgtgttcgtttgaggttatttggaaaaggacaaaatatctaagaaacaagttatacattgtacaaaaatgtcacaggtttggcataattcgaattcgcaatcaaacgatgtggctacttcaaatgacgctacgggttccaacgaaagaaacgaaaaagaaccgtccctccagggaaataagcccggttttgttcaacagcagcaacggattactttaccctcgctatctgccttgagtactaaggaggaagatagaagagattccaatggccaacaggctctaacttctcatgctgctcacatattaggttatcctcccccacattcaaatgctatgccctcaattgcaactgattcagcattgaaacagccccacgagtatcaccctcgccctaaatcttcgtcctcttctccctctataaacgcttcgcttatgaatgctggtccagctcccctccccacagtgggagccgccagtttttctttgtcgagatttgacaatccattaccgataaaagctcctgttcatacagaggaaccaaaaagttataatggtcttcaggaagaagaaaaggcgacgcaacggcctcaagattgcaaggaagttcccgctggtgtgcagcctgctgatgcccctgaccctagcagcaaccatgcagatgctaacgatgacaataataacaacgaaaattctcacgatgaagatgctgactacagacctctaaacgtgaaggatgccctatcttacctcgaacaggtcaaatttcaatttagttcgcgtccggatatctataatttatttttagatattatgaaggactttaaatctcaggcaatagacacaccgggcgttattgaaagagtatccactttgttcagaggttatccaattttgattcaagggttcaatacttttctaccccaaggctatagaatcgaatgctcctctaatccggacgaccccattagagttactacaccaatgggtactacgacagtaaacaataacatcagtccatctggtagaggtacaacggatgcacaggaacttggttcttttccagaaagcgatggaaatggtgttcaacagccctccaatgtgccaatggtgccttcgagtgtgtatcaatcggaacaaaaccaagaccaacaacaatctttgcctcttttagctacttcttctggtttaccttcaattcaacaacctgaaatgcctgcacatcgccaaatcccacaaagtcaatctttagtgcctcaagaagatgctaagaaaaacgttgatgtcgaatttagtcaagccataagctacgttaataaaattaaaactagatttgccgaccaacctgatatttacaagcattttctggaaatactacaaacttatcagcgagagcaaaagccaataaacgaagtctacgcacaagtgacgcatcttttccaaaatgctcctgatttactagaagatttcaagaaattcttgccggactcttcagcttctgccaatcagcaggtgcaacatgctcagcaacatgctcaacaacaacatgaggcccaaatgcatgcacaggcacaagctcaggctcaggcacaggcacaggtggaacaacagaagcagcaacagcaattcttgtatccagcttcgggctattacggccatccttctaaccgaggtattccacagcaaaacttgcctcctataggaagcttctcgcctccaacaaacggttcgaccgtacatgaagcctatcaggatcaacagcacatgcaaccaccccacttcatgcccttaccatcgatcgttcaacacgggccaaatatggtacatcaagggatagcgaatgaaaatccacctctatcagatctaagaacgtctctcactgaacagtacgctccttctagtatacaacatcagcagcagcacccgcaaagtattagtcctatagcaaatacgcagtatggtgatatccctgttagaccggaaattgatttagatcctagcattgtgcctgtggtccctgaacccactgagcccatcgaaaacaatatatcgcttaatgaggaagtcactttcttcgaaaaggccaagaggtatatcggcaataaacatttatacactgagtttttgaaaattttaaatttgtactctcaagatatacttgatcttgacgatttagtggaaaaggtagatttctacttgggttccaataaagaactatttacgtggttcaaaaactttgttggctaccaagaaaaaaccaaatgtatcgagaatattgttcatgaaaaacatagattggatttagatttatgtgaggcatttggcccaagttacaagaggctaccaaaaagtgacactttcatgccatgctcaggtagggatgatatgtgttgggaagtcttgaacgatgaatgggttggacatcctgtatgggcttccgaagattcgggatttattgctcatcgtaaaaaccagtatgaggaaacactattcaagatcgaagaggaaagacatgagtatgatttttacattgaatcaaatttaagaactattcaatgtttggaaacaattgtaaataagatcgagaacatgactgagaatgaaaaagccaattttaaactgcctccaggtcttggccatacttcaatgactatttataaaaaagtgataaggaaagtttatgataaggaaagggggttcgagattattgatgctttgcatgagcaccctgcagtgacagccccagtcgttctgaaaaggttaaagcaaaaagacgaagaatggagaagagctcaacgtgaatggaataaagtttggagggagttagaacagaaggtttttttcaagtcattagatcatttaggcttaacatttaaacaggctgacaagaaattattaactacaaagcagttgatatcagagattagcagcatcaaagttgatcaaacaaacaaaaaaattcactggttaactcctaaaccaaagagccagttagattttgatttccctgataaaaacattttctatgatatcttgtgtttggctgacacttttataacccataccacagcctattctaatcccgataaagaaagattgaaagatttactaaaatacttcatctctttgtttttttctatttctttcgaaaaaatcgaagaatcgttgtactcccataagcaaaacgtgtcagaatctagcggatctgacgatggcagttctattgcatcaaggaagaggccctatcaacaagaaatgagtttacttgatattttacacaggagcagatatcaaaagctaaagcgttctaatgatgaagatggcaaagttccccagctctctgaaccacccgaagaagaacctaataccattgaggaggaagagctcatcgatgaagaagctaaaaatccgtggctaactgggaatttagtggaggaagcaaactctcagggtattatccaaaatcgcagtatttttaatctattcgctaatacgaatatttacatatttttccgtcattggacaacgatttatgagcggcttttggaaattaagcaaatgaatgaaagggtcacaaaggaaatcaacacaaggtcgacagttacttttgccaaagatctagatttattatcgagtcaactttccgaaatgggactagattttgttggtgaagacgcgtacaaacaggttttaagactgagtagaaggttgattaatggggatcttgaacatcagtggtttgaagagagtttgcggcaagcttacaataacaaagcgtttaaactctatacaattgataaagtcacccaatcgttggtaaagcatgctcataccttgatgactgacgctaaaactgcggaaataatggctttgttcgttaaagatagaaatgcctccaccacgagtgcgaaggaccaaattatctatcgcttgcaggtgcgctcacatatgtccaacacagaaaatatgtttagaatagagtttgataaaagaactctgcatgtttccattcaatatattgcacttgatgatttgacactaaaggaaccaaaggcagacgaagataaatggaaatattatgtaacatcgtatgctctgccacatccaacagaaggcattccgcacgagaaactgaagataccatttttggaaaggctcatcgaatttggacaagatattgatggaacagaggtagatgaggagttttcccccgaaggcatctctgtatcgacattgaaaattaagatccagcctataacctaccaactgcatattgaaaacgggtcttacgatgtttttacccgtaaggctactaacaaatatcctactattgctaatgataatactcaaaaaggaatggtttctcagaagaaggagttgatatcaaaatttctagactgtgcagttggtttgagaaataatttagatgaggctcaaaaattaagtatgcaaaaaaaatgggagaacctaaaagacagcatagcaaagacgagtgctggaaaccagggaatagagagtgaaaccgaaaaaggtaaaattacgaaacaggagcagtcggataatttggacagctctactgcaagtgtactgcctgcatccattactactgtaccacaagatgataatatagaaacgactgggaatactgaatcttcagacaagggggctaagattcaataagtagttttaactagatttagaacaaaaatctttagtacgacagggtctttcttctgatgtgtacctttaattaatgtcaacgatataacattgtaattttaaaattctaagtgtttttgaagctttttaagacacatcgatctttccataaaggaagaagtgataacatgcagtggttatatttgtgtactcatacactggtgcatgaatctttttacacgtcattagcatagtatgtaatcgaaaggacactatttataagggacagtttatacatacatatacttgatattcccatgaatgagtattctattccatatcaacatccactccaaaatcgtctagtgattcaccccagtcgttgtaccacttctcacgagaagcatgtctgccattttgaggaagtctggtccttattagctgttcgccactttcattacgcatctctattgttgagctgccatgattgaagacggtgtttgttttacctccatctggtggccagggaagtgaaaggatgtggtcttccaatgaggagttagcctcatattttgaaataccgttttttggaaaattgttcccatctcccgtaggaacaccatatggccataaccataaatgaatgggaccaaggtacagtaatgcattagtgtacaaatcaaaatcgtaagggaaatttacaagttcatcaaaacgtggccttttttttgtcaagtgttcctcagcatcctttttattttgaaacgacctcgactctggatatattctccaagtattatcaattaatttctgagttaatcttccggagttgaacaaagattctagccgatccatatcccacgactcaatttgagatcttccattcaagatttgattgaataaacatcgtaggaaaagaattgttatcgttagtaggacaaaagaatttaaaggactcgatattgttaagaaaatcagttctgattttttgaagaagtagccaggcaagtgcctttgttgccaaataaaatatatccgcttagcttgtatgcaaaataaaacactagtcgtcactatgatccaaaataagaatctaaggaaatgcggatagtttgcaaagccgacgcaattcatcgtccacggacaatgatgatccatcattaggacgcattgattgcaggttttacaatgatgtgaacgttctggcttataactttggcacttcttacagaaattccgccagatatcagggggtggtttgtagttgggcaaaggccttcctggatttgtgcagatggccaagtaataggagagccatatcattgacaaacagaactcaaatgttatttgtttcggaactgacaagaaattggataaaataaagtagtgtgcaccatagcctataaatgaaatcagaaacgttggtatagcaattcctaaccaaggccaccttaactttactggcatggtttaacgatcaactcagtttttaaaattcatgttatacaccatcaccacaatgtagggacgataattatcgtatctcagatccgctatttttcataagcgcgtagtaagagaggtaggtttaacaggataataaaaatatacatgagacagccaataaatagtggaaataagccgtattttaaattgagagctcttagtaagaaaaatgttcctctgagacgctaaagtcgtgtatatttcatatgagaaagtgcacaaatcctgcttcccttctatctgggaatttcttttctatatttgaacatattattgtaagggcctttttctttattctcttctcacatataagaaccattttattattttaactttaaaactactttctatataaatcctacgttttttccaaatatctaggagacaatcccgttctccatctttatatggactaactcataactatttaataaacctctcaagtggcacaatgccgcaataacaactagaaaatggaaaagttggtgagaatgaccccaaatatcaaatttaccggggcaaatcttttcaggaaaccgcattccataaagaacagcgccaattatatataggacacccccaagtaatacccaaaagagctgaatttgggtccaaatttctgaaaaactatagcagtaaaggccgctgaatattggaataattgaggataaaccaaaacaaacaaatagcccagctctgtaaggtctccactctcttttccgaaacttatcttttagtgacacaatactacacgcgatcccaaagctaacggtaataagcgcaaataggcaaaatagggaaaatttctcaaaatagccgtagtacaaaatactgaccattgacgtaacaatcaatatacaaataccaaggtagtccaacttatttcctaaggtagcaattcttaaggagtgactctttagacaatgaaaggagctactcaatattaaacatgcaaacgcccccgaataaaagaggtcgattaccatatgatctagccatgtagttgttgcaaacactttgatagtagatttatctagcaacagtacagtgaagaacccgagagcaggaattaaatgtgaataaatattgacactttcattatgcaaataaaacaaacttttaaaagtttcaatgaagctactagtttctttcacgtatccatgtaaaataaaatcattgtctctttgccattccggaatttcatcccaactatatagccttcttagtacttttttagctttagcgacctctgcgggatttgcggatgttttccctgcagctctcttcttcagctcttgcacactcttagtcctttctaataaagttgacatttggaatgattcttctccaacatgcagcataattaaaacgacgggaaatttagtacatttggctcaaggaacgctgacataaatactatttctaatctactattcgaagagatgttggatttctaaaaaaaaaagagctcaacaacggaagaccgcctattaaccccgagtgtctgttttttagtatactcgaagcaaacaagaaaagtttgttacttaatttctggcctaaacaaggtagtgctaccctagaggaagtacgatatcagtacacttttgtatttttaacgaattatggtattctttaaaatatttaacatgctatcgagtttttctttctaaaatgcggtttcaaaatttgagtccgctttctatggaaaatatgaatgaggcgaacgtgcttgtaccatagtcagattttaacccgtaggtgagagcctgaggcttctgtaaaccaccttggaaacacatacgggttataagattttaacaaacaatcagtctccatactcatcctaggatctcttcttcatttgatgaataaaggattcaaacttcagaaagttattcagcgtatattggctttcctttaatctaatgccccaagccatcataaatagccatattactttgaaagtgctcatccgtatacactgcaacttttcttcttttctctttagccgattatagctcctacctgttttttttttcttcttaagattatttatattccaattttatcatccgtattgtttccaatagcgttccagtgatcagttatatacttcgagaggcagataacctttctttttataagtgtttatcaaatttaagtctgcaagctatcataagacgaggatatcctttggagactcatagaaatcatggaaagcacatcaggagaacgttccgaaaatatacatgaggatcaagggataccaaaagtaattctgcccgctgattttaataaatgctctagaactgacctagtggtgctcatatcacgaatgttagtatcgctgatagcaatcaatgaaaattcagcaacaaagaaatctgatgaccaaattactttaacacgataccattctaagattcctccaaacatatcaatcttcaactatttcatacgactgacaaagttttcctctttagaacattgtgtgcttatgacatcactctattatatcgatttattgcaaactgtgtatcctgattttacgcttaattcgttgactgcccataggtttttattaacagccaccacagtcgcaacaaaaggcttatgtgattcgttctcaacaaacgcccattatgcaaaagttggaggagtacgatgtcacgaattgaatatactggagaacgattttttaaagagagtaaactacagaatcattccgcgggatcataacattacgttatgtagtatagagcaaaaacagaaaaagtttgtcatagataaaaacgcattagggtctctcgatttggattcttattcttacgttaatcgtccaaaaagtggatataatgttctagataaatactatcgaagaatagttcagctggtgggttcctttaacgcttcacctgataagagtagaaaggttgattatgttctcccgccaaatattgatatagtgagtgaaagtggctcccaaactactcaactaaaggggtcgtcatcacccaattctcactcttcacaaaagcgatattctgaggcaaaggacgcacatatctataacaagcgatcaaagccagattaatgatttttcgtggggtattatgaaagcaatcatgattgagcaaaattaaaactttccatttgtacatatatatatatatatatatatatatctgtgtgtgtataataagcaattggccatcatttggctaaaaagttcaagatttcaggtagtatataagagaataacttccctcttttgctaaagaaggatatgttctatttcagcctttttgcatcataagagcataagcgacagaaaacacttcgagatgagcttgagaactccatttcaattaacttgataaatacatgtagattcatatcatcactgttcttttcagatactagtttcaaaacttccttgacagaaccatttcatgttcaataatgaaaattactttcacatgttttagtggaaaaatactgaacaatgaaatttcaatatcgcatataataatttttgttatcaaatatatatttttcggaagtcatatacattaaataattaaaacattatttttaaaaattaaaaaaatatattttagcaaatagtttttacttttttttaaatgcaaaataagttcacgtgatattattaataatattttacccaaaaatatgagggcatcggaaaatttttcagtaatgaatattaatgttcatctgaagatagacgaaataggaacaacaaacagcttataagcacccaataagtgcgttatgacttctgaaaatccggatgtacttttatctagggtgataaatgtggtgagagcagcatcatcgttagccagtcaagatgtagacttttacaagaatttagacaggggatttagtaaagatctgaaatcaaaagcagacaaacttgcggatatggcgaatgaaataatcctctctattgatgagcatcatgaatcatttgaacttaaagaagaggacatttctgacttgtggaacaactttggaaacatcatggataatttgttagaaatgtcagaccattcgctggataagctgaattgtgcaataaactcaaagtcaagaggttccgatcttcagtatttaggcgaattttcaggaaagaatttttctcccaccaaaagagtcgaaaaacctcagttgaaatttaaaagtccaattgataacagcgaaagtcatccgttcatacctttattgaaggaaaaaccaaatgctttgaagccactctctgagagtttgaggttggttgatgatgatgaaaataaccccagtcactacccccatccttatgaatatgagattgatcatcaagagtatagtccagaaattctccaaattagagaggagattccctcaaaatcctgggatgattcggtaccaatttgggtagatacaagtacagaactcgaatcaatgttggaggacttgaaaaatacgaaagagattgccgttgatcttgagcatcacgattataggtcatactatggtattgtttgcctcatgcaaattagtacaagggaaagggattatttagttgatactctaaaacttcgcgaaaatttacatattctgaacgaagtgtttacgaacccttcaattgtgaaagtttttcacggtgcattcatggatattatttggcttcagcgagatttaggtttgtatgtcgttggtctcttcgatacttaccatgcgtctaaagcaatcggtcttcctagacatagtttggcctatcttttggagaattttgccaattttaaaacttcaaagaaatatcagttggctgactggcgtataagaccgctttcaaaacccatgacggcatatgctagagcagatactcactttttactaaatatatatgaccagttgagaaacaaacttatcgagtctaataagttagcaggtgttctttatgaatcaagaaatgtcgcaaaaagaaggtttgaatattcaaagtacagaccactgacaccttcttcagaagtttattctccaatcgaaaaagagagtccttggaaaatattgatgtatcagtacaacataccacctgagagggaagtattagtaagagagctataccaatggagagatcttattgcaagaagagacgatgaatcgccacgatttgttatgccaaaccagttattggctgcacttgtcgcatatacacctactgatgtcataggtgttgtttctttgaccaatggcgtaactgaacatgtccgccagaatgcaaaactattagctaatttgataagagatgcattacgaaacatcaagaacaccaatgaggaagctactcccattccatcttccgagaccaaagcagacggaatattgttggagactataagtgttcctcaaatccgtgatgttatggaaaggttttcggtgttgtgcaacagcaatatttccaagagccgagccaagcctgtcactaattcttctattctgttgggtaagattttaccacgtgaggagcatgatattgcatatagcaaagacggcttgccaaataaagtgaagacggaagatatcaggatccgagcacaaaatttcaagtctgccttagcaaacttggaggatatcatattcgaaatagagaaacctctcgttgttcctgtcaagctagaggagattaagacagtagaccctgcgagcgcacctaatcactcgcctgagattgataatcttgatgatcttgttgttttaaagaagaaaaacattcaaaagaaacaaccagcaaaggaaaaaggtgtaacggaaaaagatgctgtggattattcaaaaattccgaatatcttatctaataagcctggccaaaataatagacaacaaaagaaaaggagattcgacccatcatctagcgatagtaatggaccaagggcagctaaaaagaggaggcctgccgccaaaggtaagaatctgtcatttaaaaggtgattatgtaaaacaagcgtatttttttatttataaattatggtaattttcatttaagacctctaaattcatctaatcgaatatctgtgtcatggagttatggctcccccatgcacaccattttctctttttttgtttctgtgtttcccttcatctcctttattatgaaaagtacaagttttatataatttcaacgtcggaggttatccggaaatctatagttgaatttttgcaggattatacttcgctcgaatattgtgcgtgttaaatactcagcgagaacaatacttccaagttagaaaagggatttgctcatgttaaagcaatggcactccgaatggacggtgtcaggaattcttttcttcacatcaggcttcgcatagaaaatggccattggcaaaaggttactggtgaacaaaccagcagaagaatcattttatgcttctccaatgtatgattttttgtatccgtttaggccagtggggaaccaatggctgccagaatatattatctttgtatgtgctgtaatactgaggtgcacaattggacttggtccatattctgggaaaggcagtccaccgctgtacggcgattttgaggctcagagacattggatggaaattacgcaacatttaccgctttctaagtggtactggtatgatttgcaatactggggattggactatccaccattaacagcatttcattcgtaccttctgggcctaattggatcttttttcaatccatcttggtttgcactagaaaagtcacgtggctttgaatcccccgataatggcctgaaaacatatatgcgttctactgtcatcattagcgacatattgttttactttcctgcagtaatatactttactaagtggcttggtagatatcgaaaccagtcgcccataggacaatctattgcggcatcagcgattttgttccaaccttcattaatgctcattgaccatgggcactttcaatataattcagtcatgcttggccttactgcttatgccataaataacttattagatgagtattatgctatggcggccgtttgttttgtcctatccatttgttttaaacaaatggcattgtattatgcaccgattttttttgcttatctattaagtcgatcattgctgttccccaaatttaacatagctagattgacggttattgcgtttgcaacactcgcaacttttgctataatatttgcgccattatatttcttgggaggaggattaaagaatattcaccaatgtattcacaggatattcccttttgccaggggcatcttcgaagacaaggttgctaacttctggtgcgttacgaacgtgtttgtaaaatacaaggaaagattcactatacaacaactccagctatattcattgattgccaccgtgattggtttcttaccagccatgataatgacattacttcatcccaaaaagcatcttctcccatacgtgttaatcgcatgttcgatgtccttttttctttttagctttcaagtacatgagaaaactatcctcatcccacttttgcctattacactactctactcctctactgattggaatgttctatctcttgtaagttggataaacaatgtggctttgtttacgctatggcctttgttgaaaaaggacggtcttcatttacagtatgccgtatctttcttactaagcaattggctgattggaaatttcagttttattacaccaaggttcttgccaaaatctttaactcctggcccttctatcagcagcatcaatagcgactatagaagaagaagcttactgccatataatgtggtttggaaaagttttatcataggaacgtatattgctatgggcttttatcatttcttagatcaatttgtagcacctccatcgaaatatccagacttgtgggtgttgttgaactgtgctgttgggttcatttgctttagcatattttggctatggtcttattacaagatattcacttccggtagcaaatccatgaaggacttgtagttacattttaacttatataactgtacaatgtcagtcagacgcaactgatataaaagatgtgctctacaagtaaagattatttcaactcttaaaaatatttgaaaaatgcactataatttgatctaaataaggtacagataatggtaaggcaaaactactacatttggcagtgagtattgttagcttttccgcttattttctctcctggagtagccaccgttcgcgtcttccgagcaatggcgaatctcgaatctcggaagggcggctactgataacaggcactcatatatatattattagataagagttttttttgactgagtccttataacacgtaacttatcaagttgctatattgtaagttcaggtttccaatctgttcaaccactttatatctttaaacatgaaattctctaccatcttacctatactttgggcaaattgctgtctttgtatgatcatccctgatttcgacgggatagttcgttttattgagaatattgatggtactcgcagtgtaagagcaggagaaggtttgggacagcatgatcctggaaattttcacactgaacatcaacatgtcgctcataaaacagagtttcttccttatcggtatgtcatagtctttaatgaagatatttccctccagcagattcaatcgcatatgcaagtggtacagaaggatcatagtacctcagtaggtaagcttacagaaaatgacgctttttggagggtaatttcttcttcagtatcatctaaatctcaatttggaggtattgataatttttttgacataaatggtctatttcgaggttatactggctatttcactgatgaaatcattaaaataatctcccaggacccaatcataaagttcgtagagcaagaaactacagtaaaaatatctaattcgtcattgcaggaagaagcgccttggggtttacatagagtttcgcacagggagaaaccaaaatatggacaagatttggaatatttatatgaagatgccgccggaaaaggtgtcacatcatatgtactcgacacaggaattgataccgagcacgaggactttgaagggcgtgctgagtggggagccgttataccagcaaacgatgaagcttctgatttgaatggtcatggaactcactgtgcggggattatcggatcgaagcactttggtgtagccaaaaatacaaaaatagtagctgtcaaagttcttcgttctaatggggaagggacggtttcagatgttattaaaggtatagagtatgttactaaggagcatatagaatcgtcgaagaaaaagaataaagaattcaaaggatcgactgccaatctttctttgggaagtagcaaatcgctagctatggaaatggctgtaaatgcagctgtagatagcggtgtccattttgctattgcggcaggaaatgaggatgaagatgcttgtctcagttcaccagcaggagctgaaaaaagtattacggtcggtgcttcgacatttagtgatgatagagcattcttttcgaactggggcacatgtgttgatgtgtttgctcccggtataaatattatgtccacctatattggttcaaggaatgcaactttaagtttatcaggtacttccatggcgtccccgcacgttgctggtattttaagttactttttatcattacagcctgcaccagacagtgaatttttcaacgacgctccctcacctcaagaattgaaagaaaaagtcctaaaatttagtacacagggagtactgggtgatatcggtgatgatactcctaacaaattaatatataatgggggaggtaagaaattggatggtttttggtagctttgattttgaatttaggagcacccaggagattttattttattcttttcatacaggtcagcataagcctaagaaagacgtttgaaatcgctaatcggctttttgttcctacgagtaggttaaattctttcaataatatacataataaattagtagtaaagataaacttttgttcgcgatgcagttcttttggttgtgaatagtttttttacgaatttatactagtcactgctagataagggttaaggaggtaaataaaatacgacaaccactttaaataggtttcaaaactatccttcaacagataaaagggtttaccgtcagaatcattgaaatcttttaaagggtgtgaaactatttttatcttcctctgtcaccgtccaaagcaaccgagcaatgcagtgtttttccttttaaaaactacctcagatcataggtacaagttacaactgaatgtctacaattgtgatctcggctcgataatgtattctatgtatgagaggcatcttcttgttttgattatttctatcatttactaaggaaaaaaaaaaaaatatacatgcggtgcgatgcgatgatcttcgggaagaaaaattttcaagatgtcaattaaacaatagtataattatcgtgatgagcaagaagggaagcaatccaataataaaaaccaactattgtaagcgctcccgatatacctaacatgcgtcaaaagagggctaagtcatataggaaacaacttcttgtttacagtcacacatttaagttccgtgagccatatcaagttttggttgataatcagcttgttttagaatgtaataattctaattttaatctaccgagtgggttgaaaagaacgttgcaagcagacgtaaaggtcatgatcacacagtgttgcatacaagcgttatatgaaactagaaatgatggtgcaattaatttagcgaaacaatttgagagacgtcgttgtaaccactcttttaaagatccaaagtcacctgcggagtgcatcgaaagcgtcgttaatattagcggtgcaaataaacacaggtatgtggttgcttctcaggacatagatttgaggaggaagctgaggacggttccgggtgttccattaatccatttaaccaggtctgttatggttatggaacctctcagtacggcgagtgccaaggcaagcaagattactgaagaacaaaaattgtataagggtctcaatgatcctaatattgaaaaacttcaagaaagtggtgatggatcaggaaaggaatctatcactaagaaaagaaagcttggtccaaaggctcctaatcctttgagcgtaaagaagaagaagaaagtcaactcgcccagcgatgaggtgaaagacaaagaagatacttctaaagaaaagaaaaaaagaagaagaaggaaacacaaaagcaacactaacgtccccgtttcaaatgggaccacagccgcgcagtaaattttttccttaagttaattgactggccaatcttttgaatataattgcgcatcttccactcttattgataaacgttacggaagtatttaatgtacatatgtaggatagtattaaataaacttcaaaaaattaagcctccgcaaaacgcaccatcagtagttgactacggggaagtcttcttcaggcacttgacagttttcattaatagaatgatccacccattcaggggcaacgaccctggctattttcggtatagtatcagaagcctttatttgttcttttattttttcgtgtacctcattcatgcagtctttcctcaaaataggatcagtatatggtataattattaagttacaaagtgactgttgatctgttatttttccaccaaacaacttaattttcatttctataatgtcatcttctgtgctaattttgcgacgtggtacgtatgcaatcctgttggagaataaaaataatggaaaccgccgaacctcagaatctatctcgagttcccccatcggtggtagacttagttgtgatttatacaatgatgacagtttggtttccgaaatgtcattttcaaaactatcacccaaacaatctacccttttttcagcgacggctctcattttttgagagacgttaaagcaataattgggctcgatcaggatgagcctcttatatgctatacaatcgagtacccaatttgggtgcaatatatcatatcctcgatctattaaagccttgcattccgtggtagttttacagctgattaaccgaacgtccccaattgaatgacgttttaaaattacattatatatcagtttaccaccatgttccacaatagttttttcaagttctgcccgtgtaatccgtattccagtgtcctccgtgacatagtcagagagaacataaaaaagtaatccggcaaagatgtttgaaattggcagttgtttcctgttttggtgaaagctgtctgaaataagtactctctttctctttttccgtatcaatccaagctgtgacctttccgcttgatagctggggttagatttaaccgtcctactttcgtataagtcgttaagtgtgtaacaatctgtccattctttatcgtaccgtattcttttacaatagccaccgtacaaagtacaattggtagcgtacttctgcatattcgtttctgtgttatccaaagaccgtgattttatttctagaacaattgattcactggggtcaatccattcggcaggtatttttgagccaaattctaaaattgaagcagggggagcaacttcggaggttcttttccaatgtcctctcgttttgcggtcgatttctttgaattcttcttgagatataccgtttgcgatagaacagaatgaaagtatttttttcacccttcttcttgaattttgtatgtgtttttcttggcttgagtggtctacaatttcagaggagtctccttggtgctttttatactcttcttcatctagcacaagtaaccctagcataaaagaatcttttttcccagaatctctgcctattactattaagtctaaattctctccaaattcctccaaatattcaggttttaccttgatccagttgttgtttcgactggcgacattataacttgaattataatatttcaaaacaactccttctgaacccagtgagattgcaacttctaaagactttttgattgactccacaccataacatctagaagatcgtactatttctacaatatttttcaagggacttaaaatgctgttcagatattgcttcctttgatgaaggggtaatggtgtcaacgaagtcccattcaggtataacagatcaaacaccatatataaggggtgaaagtcaacattatttatactattaaaagatagcgcttcctttgcacttcctttaacaagaccgaatggaagaatcacccgtctttttgcatcaaacgtcaccatttctccatctaaaacacattctttaacactatctgtaaacctcaaatgttgagatatagttcctgatgataagctcgctccgtacaaataggtatagtcgatgccccgtctactaaaaaattttatggattcaccataattcatataatgaacttgaattcgttctccatccattttttcttctaccaaaaaatcatcatgtagtgtacggcatattttctcataagaaagattcacttttttggctaattggggggcgaatgcaaagccaacttttatactcaaatcatcatcctttagacgaacttttggatcataaagttttgaagttaccacctttaaatcagatatcacgctaagataatcctgagcatcaggatgccagcagtttagcaatttgtgctcttgacctcctattactctatttttaagcacgatatcaaagaagtattttaattcgacgaaactcatattctccacacagtgcaggaaaggtttggacttgacaagactcttaaatcctcgtccggaagcgaacctgtctccactcaaactatccagatagtgattgacgttatcaattgtaatcgcttttgagctaggttcagcccttcttttagcaatttcttccacaagaagagaagaaagattcccacctttaccgacacgctgtttccaatcttttaaccgctgctctgttgcagaattttttggcaacttcaagtaagagcatatagttcttattaatacataatccttaatattatagattcgtctatcgcggtagggaagagcaagaaccagtgcaggatatatattatttcccacggtttttctccacatttcgacgaaattcgatattatttcatagtacttgaaagaccttgatttgccagtgccggccgttccattaatttgaacttcatgtatcttcacaaatagctcttcacaaagccatttgaaatctggactaggcgcaaagttttggggctcgggtatagaatctagtgctgatatcatacctaaataatccgttactatttccttcagttctagatttttattttagtatttattttccacatattaacatatgtttaaaggattttttcatagttagatttgtttaaagatttaatatggtgacaaaaggtaaaaagagaaaaataacaaaaaaaaggaaaaaagaagaaaataagggatcgaaaacgatcttaactctagtactgcacaaacaacgtaagtgatgaaaccgatattattgatctatactcggcgaatcttacgatttatatcacaatgttacatgtacaacgtacgtagttactaaacactgatttcagcctatttaatcacctatcgaattaaattgcctaaggggtcataacttaaaggctctccattttcttttgaaccactttcctcgtcttctgattcctcagattgcgcttccctgcttttcatgttatctatacgaatagcattacctaaagagtcatattcaatacattgattattgccttccaaatcagattgttctgagttttcctcactctctgatgtgtcagattgcgaaccattaccccttctatttatgttacccatcatccatatatcttcttctttagctcgggattttcgttcttgagtttccttttctaatttttgcaaccattcctcttcagccctctttacagagtcgcagtcagtgcactgctgatagatttcaagcaattctttgtttaattctaaaaatcccattccccacgagaagtgtgataacaattcactggcccaatccattctcccgacgatagcaaaacaagccgctaatgcctcaacgcaattgagcctccatggtctcccgtaatttacttgattagcggccactaaatacggcagcagcctttcgtgcttaccgcctattttattgaagggtacctcttctaaacgtgcccaagaacactcgaccaccgaagcgccgtgttgttcgacaatttctagatcatcagggcaaacaacacctttgccgtttggcgaaacgacaataccttgaaatttctgtccaactctcaatgatttaattaagcccaacctttcaagttttttaccactgcatctctttggatcgcaatgatcaaaatcccacatagccagtttaacaggaaacttcattttttctgaattatcgtacttcatttccatgcgcctatggttttgcctggaactgtgcccattagcgcctctctgtggtcttccatttttgggttcgtgcatcttatttttaccttttcccattgttactgcttactcaactgtcttacgcgagaagttctatacagatttacataaaaagcttttcgataaagtatttcaaatagacatttactagtaaaaatttttttatgtagtttctcatcacattatattttctagtcttctccgaaaatcgacgaatttacctgaaaaaaagaaaaagtaaactacagtccctatttaagtatttcgcaagtgatctcaaagtaaaaataaaattcctggtaacactcatcctagatagagctatatttgtatctacataacatgtattgcattaaaggcttatttcagtccactattgcttgttctcattgtctggtgtttcatctgtagattgggcacctgctccaccaaaaagattgcctgccatgtttctgagtgctgggttattcatcaagtcagacaaatttggagttcctccgcctgaagcaaagccttcagccatctgtctgatacttggatcttgcatcattttttgaatattctgcattgcacctggattgctcatcattttttgcgcagcctgcatcaattgtgggttgttcattaaacctccaagaccacctcctaataaagaaccaagatctggcaatccacccgcactagcaccctgacttgcatcgacatcagcatcccttgactgttctggaacggttttctccagattcaaagattgctcaaccttcttcttggcactttcataatcccttttcatagcttctgttgcattatcgccctctatatcaagaacctttttgtatgcttcaagggcttcttcgggtttaccttgcgcatatttagcaaaacccaatctagagtagcctctgaaataagatgggtcaatagaaattgcagattcagcgtctttgaccgcttgatcatattctttcagggatgaatgagcagccgctctattggcgtaataaatagcattcgttggtaaaactttaatggcttcagtatatttattgattgccagttcgtaatccttgttggccattgctttattaccttgcattttcaagtcctcagctttggctttagtttccgcatcatcttctggaatattaatctcgacattctcagcatcgtctttcttattcgattctggaactcttgacgcagaatttaatatatcagcaagatgttgacccttgaattcagacttgcctaaaatgcctgaaacagcttctctttcaaagccaaaggcttcagagatacagtccatagcaacatttaaagaatcggcgccatcttctgaaatttctttcttttccacaatggaagaaaagtagtttacaataagggcagcaatttcttcttttgatgctgacatcgtacagtagatttgtattaataagatatcacttggtcagaagcttctattcagttgtccgattatatcgctcgtactcattttatatggtggcaaaatttgggattaagcgtagggcaataaaaccttctcggatcttccatttttttcgattgggaaaattttaagacttgaaaaagtttggaaaaatacaaaagaagggctaagtgttgtgattagaatgtcatgacaataaggttaaaagcaaatattatgccgcctatagccctttaaaatagcataaaagacctttgtaatttctattcaatgttaaaaaaaatcttccccgccaggacttgaacctggaatcttctggttcgtagccagacgccgtgaccattgggccacgaggaacagatcttgagaaaattagagatatttatcgatacacgtactaaaagcaaatttcatagttttatttcccaataatgcccatcatccattattattatattcaaattattatgccagtgtgaaaaaaatggaatgatcattcccatacatattgatgattttcgacataattatatgcaatggtatacgcaattgtgcaaacatgacaattttgttttgattctttcattccattttttgtaaaggaataatatccctatataatatgccagaggtctttcctcgaggatacaggaatccgcaaaatggaatcaaaattttacatcatatattataatcacgtcttcctcctttttcatgcattactactcacgcatcctatcacataatcaatccttgcgcttcaatttcattagattgaagaaaatatgaatataaatttattaatctcctactttatatcgtctttcaacgcggtatttttttaataatttctagtaaagtggttattgtcactagaagataattagctattagtttcataacaatttgttattttgaaaatgtatagttttattaggtggtattcatttcaaagaattaacatgtttaatgtttgttaaatctatgtaactaagttaaggttggtattcaaatatatcataaaaaaattaatgagtagaaaaaaaaataactaatctaattttgttgttcctatttaatgttcctcgttacttccagctctccagctctcaaattcgaaatgtatgaatttttagaggatcatcataatgtgaaaatggagatgatttggcaaaatgaaatcggaaaaagaaaaaattaatgggaaggaacaagacttgcttggcaatagtttaagaatataataattttttttgggtttcttcaatcagcttcgtctggattgaccactgttaaaacgttgtttttccctcctggtccgccatttatgaatgttccgttacttattctccttgagtcgtcgaaagggttaatatcagtttgccctttggtgtgctcctcctcgaagctacctgaagagggcccgtgattagatgaaaatgaagaggcgtatagtttatcagggtactcaactggttttatcgcctcttggtattccttttccatcctgtcttgttcccgcttcatattaatgtgtctgacaatcaacaagatacaaagagcaatggctacggctcccactacaccacctacaacgccgcctacaattgcccctacattggctttctttttatgagttttacttccactcgtagagtcagatccagctgtacctgtggccgatcctgaattctgtgcacttgccgtgatggtgttcgtgacaaaaattgtggaaccgccctcagtgtgaaaagtagtggaatagattatcgaagtggcgtcctgtgattgagagctagtactgctcgttgccaaagtatccgaagttagcgagctttctgacgttacagtgctcgaactctgtgacgttgaaatagaggcagctgcttgagttgactcgggggaattctgtactgtagaggaagacgccattgatgatgtagttgatgatgtagtcgatgatgtagttgatgttgtggaggacgttgttgaagaagttgtggaagacgacgcagaagtagactccgtacttgaatctgagctgcttatgctattgctatttgtgtcagagtcaagttggtacacagaataggcatcttcaccaccacacatctcactgctgtaaccaaagcaatacgtattacatgaagaggaagtagattccgaaccagatggattagtatcaccacaataacattctgaatgattataaagggcaaagtagcttgcaccttttgcgctacactcactgttacagtgtgaactcgactgccagttatatgaatcggcctttgaaaagtcagagggtagtgagctaaaacaattcacgtattcataggcgttcgcttgcgataaaatggataataacgccagaagcagacttgttttgttcggtctcattatttaaatagaattttttatcctgagtactaaatcagccaacgtactatcctgaataaatgtgatgcagattcctttttctcctcttggttatctctctttttctctctccttattaaaaaatttacggacaacgaggagcttctttcttgtttaccttgattaccctttaagcaataacaatatcaatacgagattttctgtaatgttagtgcctggtcgagtttactgtatcgtccaagaaaactacactgcgttaaattcttccaaatgaggctatgatacgccaaacacttttatttttcccctccgtttctctcgctttcgcttcgaaaattacattattttcttccccatgcagcgttatttccatcttcagagaggaaaggcggagaaaatttttcttgaggaaggaattctacgaaagtagtcaactatattactaatcgtttgacatagaatgccaaagttgcagcttttccactaacgtcaaatttgcgtaacaagcgctgctgtgtaaactgtcttgctttttaataggactgacaaaaattataagcggagagataatatttaatactgccattgaccttagtaccggtacaggacaatatgtttgtatccttggtgtcataaagaagagaaaaacaagataagatctccacattattttgcagaaggcgactttgggggccgatgatatctgcttccagaagtatgtaaaaaattacacaccattaagttcttatgtaaaccgaagtctggaagagaggtggtggaatttccagtctgctactaggcaaaaaacttgaaacactttcatatatgatgttgttttgccgagctattacaagacgatttatcataaactacttgcttgagcaggaacgatttcacaatctgtttagcaggttgttatgaagtagacacgataaagttcttgaagaaagattgtggatgggtttgctgaagcttagaactaagaaaagaaacaagcacgcgcaagaaaaccgctacggctaacttctaaggtgaggatattgtgattgtttatgcctcatattttgcgtttttatatgttcttccttcatacggcgtgcaaattatccgccggcgaacagggtgctattctaaaaggaactttgaaactgtaaacgcggtgtactgaaggggtcatctgaacgaacaatattttatgcttttgttagccaaacggtactgataagggactgtgaaaaaaaaaagacaatgtatggggttcacggtttcccagattcgtgtgtgtgtaataattcgtttacggcgcacgacagacacttcaggaaatttaaagatcagaataggcatacactccgcgcaaggaaaacaaaagttgctaccgtaaccggctcgtacggggaaagcaaggtcatctagtgctcacttacgaactggcataatcgagttgtgacttccaaacttaaccgtactctcacagctgatgtgatccgaagaaaaccctgaagatacaacaatggcaaccaaaggcaacttaaaaaggcaaacgaagtacttttcaacaatagcttacactgaaactcgcggagaggcgacgctgcgcgcgaattatcagtaaaaatctcgtaacaacccatctgccacttttagaaggaatggaaattctcaaaaaatgacggaaaataatagaacagggttcctaaacgatgcatttctaacaagtaggatagtccaaaagggaggatgcaaattctttgttttccacgcagtaagatatgatcccaagctttcgaatataaaaagggaaggatcgctaggacagatcagtttttagcccgtttacttatctcgttccctactcttgttctgatagaaaccagcaacaaaaacctattcactcgcttattaataccataaaaaatatggcttactctaaaatcacattactagccgctcttgctgctattgcttacgctcaaacccaagcacaaatcaacgaattgaacgttgttttagatgatgttaagaccaacattgccgactacatcaccctatcctacactccaaattcaggtttttccttggaccaaatgccagctggtattatggatattgctgcgcaattggttgcaaatccaagtgatgactcctacaccactttgtactctgaagtggacttttctgctgttgagcatatgttgactatggtcccatggtactcttctagactgcttccagaattagaagcaatggatgcttctctaactacctcaagttctgctgccacatcttcaagtgaagttgctagctcttctattgcttcatccactagctcttctgttgcaccatcctcaagtgaagttgtcagctcttccgttgcaccatcctcaagtgaagttgtcagctcttccgttgcaccatcctcaagtgaagttgtcagctcttccgttgcttcatcctcaagtgaagttgccagctcctctgttgcgccatcctcaagtgaagttgtcagctcttccgttgcttcatcctcaagtgaagttgccagctcctctgttgcgccatcctcaagtgaagttgtcagctcttccgttgcaccatcctcaagtgaagttgtcagctcttccgttgcttcatcctcaagtgaagttgccagctcctctgttgcgccatcctcaagtgaagttgtcagctcttccgttgcttcttctacaagcgaagctactagttcttctgctgtcacatcttcctccgctgtttcctcttcgaccgagtctgttagctcttcctctgtcagttcttcctcagccgtttcctcttctgaagctgtcagttcctctccagtttcctcagttgtttcatcttcggccggacctgctagctcaagcgttgctccttacaactcaaccattgctagctcttcttccactgcccagacttctatctcgaccattgctccttacaactccacaaccaccaccaccccagctagttctgcttccagcgttattatctcaaccagaaacggtaccactgttactgaaactgacaacactcttgtcaccaaagaaaccactgtctgtgactactcttcaacatctgccgttccagcttccaccaccggttacaacaattctactaaggtttcaaccgctactatctgcagtacatgcaaagaaggtacctctactgcaactgacttctctacactaaagactacagttaccgtatgtgactccgcctgtcaagctaagaagtctgctaccgttgttagcgttcaatctaaaactaccggtatcgttgaacaaaccgaaaacggtgctgccaaggctgttatcggtatgggtgccggtgctttagctgctgttgccgccatgctactatgattttagtacgtgtcgaaaatgttcgttccgcttatgattatattattatttcaacttaccagttaatgcttaacttttaaactgtcatatgtacttctctgtattatataaaaactgacaactggccttttctattgttgatttctttcatccatcgttaaatattttcagaatgtgggcaggaagacatgcatgtttgaaggtgcctatcctagcatcatcataaaagaaaacggtaaatcatttccgttttcaaaacgtacactacagcctccagttgatgaaatcagttctcacaataattcgaggtttaaaagaaacagtaaaatttaaaaaaaactattcaatagataaattggtatatacgaacattaaaaattccatttaaaaatgagattataataacatggcggcagcggccatgacaccagcacccataccgatgacagccttggcagcaccgttttcagtttgttcggaaacagtgctagtggcttgaacttgaccatcactgatttgagaaatggcggaggctttggtggaagaagcaacagctgaagaaacagcagaggaagaagccttagtggaagaggcagccttggtagaggaagcgacggtggaagaggtagcctcactggaagaagcgacagcagaagaagtagcagcagaagaagaagcttcactggaagaagcgacggcagaagaagtagcttcactggaggaagcgacggcagaagaagtagtttcactggaggaagcaacagcggaagaagtagcagcagaagaagcttcagtagaagaggcagcggtggtagaagttcctaacaaggattccaattctggtagaagcctggaagaataccatggaaccatggtcaacatcttgctaacagcagcaaagtcaacctcagagtacaaagtagtgtaggagtcatcagtggcggaagccaaagctaaaccgatgtctaaaacaccagatggcagactgcttaaggaaaatccagatgaagaatcttcagccaaactaatatattcttgcaagttggacttaacgtcattcaaaataacgttcaattcgtcaatttcttcctgagtttgggcagaagccaaagcagcgatagcagctaataaagcgatcttgatgtaagccatttttttgttatagttgaagcgagtgtacgagtgtgttttgtattattgtgctgataatggctaaactggaaaagaagatgatatgtgagagctctcattgttcgaatttcgttaactacttatatattattttccgtagttacgaaagttgaacattactttgttgttttcttgcttactcgtttactcacatgatgctcagctattaagatagttcagtagaacatcttacactaaactttgcaccacaatgttgatggttgctttgggagatcattacggaaaaaaaactcttggctttcaaggattccctgcgacctaactctgcactccttctgcaaggtactgtttatttttttcgtgtgtcctttacgaggaacgaataaaggcttgaaaggtagttttaaagatgaacttcttcttttctttctttgcctatgattcctccagggttttcttgccttctacttttggacagaaatgtcttttttgggaaatgtgagtctcgtttgggaatcttggccggccaagattttataaagatgtttctgtaggcaacgcgctgctctaagcaccgtggggaggccatgaaatatgattgcgcgtagttccccaacgttacgtttatttttttctgggcataaaaaaagccaagacattccccactgctttcctacaggctctctattgtgtatactttgcgctattgtgtgctttgttgttggtccgaagatcgcataagaggcacgcctcttatcaatttctttataggcggctaccgccagtggagtaaaattcacgccttttttgtccactcctttttccgtaaatattacataattaaatagtcacagctcttacgcacctgtttggccgcacatgagagttaaacgcaaactccgccgaggcgtcgtttttctagctgctgcttcacgttttatggagtcatattctggtctaaaaaaattatactaggcaggtaatggattgttttaagtttcttgttaactcacataggatcttttttgagtaccttgtgaaatggttagatttgataccttatttttttccaacattacattattttagtatcgttcaagttctcctttacttttagagattacgcctacattatgtatgccgaacttagtaggaactatttgtacgcaaaacatgaattgtttgtcgtgtctgcatacattagtgttgacagtcagagaacttgattttaaaaataaaagtttcttgtttacaaaaaagtatggtcacccggtgtctttgctataatgggaacagaaaaccatttgcaagactactaaaatacgattttgtaatttgacgttacaaatatagggatagttgataaatagttacgcgcagttaacttttcctcaccaaaggacagttatttacctactgattgaaaatgttttggcacaggataccagttttcaaatttattaattaattaaggagaagtgagaaatgattagaaagcaattaagcggtgaaggtctgctttttatacttacaagaacgtattattagcagccaacgcactacagttgttgactaagttttgttttaatttgattcgtagttgttggtcgaattttgttttgacttgttttcagtttctttttttttaatgcctgacgttgaagagcacgcaggcctatgaaaaaaaaaaattatacgagttacttggaattcgctcccattgcaccaatttcaggaagcgatcaaaaagaaagcaatgttattcaacataactttattcatactgtagtaacaataacttcatatcaattaggattcactgttcattgacttatcactacaatatggaggaaacgttgcgtaatcgttgtcgctatagatattgtccctcccttcctctgtgatagttcttctttatataactttcacaaaagcttctgccctcatagttgccctcaataaacgaaaggccagatgcatacaggtgcagtagtacatccaaagaaacataggggcaaaaaccgtgttctaatattagactgcatatatccccttgtcattagcttaaatcatatagagtaatatgtacatacaggttattttatttgtagctttcctcctctttatggagcaaagtaagccatacgaacggtttacaatagagagcgtcgtttgcttacgtgattgtcatgtgccttcgtaggcaaaggggattgcacacctttttactaaacaatagaaaagtgagaattctcttataggcactgctgctcctcgtttctttttacgcgctgtcgttccaggtccttttttcgattaactacggtagtttcaaagagagtgcctgaagatcactccatatacaggctagatgaactgtaaacgagctcatcagcagcgtccctttcagtgtcactacagccacagcagcttacctcctgtacgatgtgacagagcaaaacacaaatgtgtgtcctttctactcttattttccaactcgaatataaagacggtgcctttgccttatttctaaggcactgaacagttctaaaagtaaagttttccctagccttagtaccgtttctgtgaagcagttattgaatagttattggacataaaaatccatattgaaaaaaaaaaaaacatacttgagaaggcattagctgaatagtaaagactgctgtaattcatctctcagtccttgcagtctgctttttctggaattaatatgtcaatttcaaagtacttcactcccgttgctgacgggtcactcactttcaatggcgcgaacattcaatttggcgccgatgctcaaggcgagtcaaaaaagagttatgacgctgaggacagcatgccgaatccggcaaatcaactaaatgacataaccttccaagcagaggctggtgaaatggttttggttttgggttatcccacatccactctatttaagactttgtttcatggtaaaactagtttgtcatactctcctccaggctcgattaaatttaaaaataatgagtttaagagcttttccgaaaaatgtccccaccaaatcatttacaataatgaacaagatgtgcatttcccatttctaacggtagaacaaacaattgattttgccttgagttgtaagttcgatattccaaaaggtgagcgcgatcaaataagaaatgaacttctaagagaattcggcctgtctcatgtattgaaaactattgtaggaaatgattttttccgtggtgtttctggtggtgagcgtaaacgtatttctattattgaaacgtttattgctaatggttccgtttatctatgggataattctactaaaggtttagattccgccacagctctcgattttttggaaattcttagaaaaatggcaaaagctactcgttctgtaaacttagtcagaatttcccaggcaagtgataaaattgttgataagtttgacaagattcttatgctatccgattcctaccagcttttctatggtacggtcgatgagtgtttgacttattttcgtgacactttaggtattgagaaagatcctaacgattgtattattgaatatctgacctctatcttaaattttcagttcaaaaataaaaatttggggaatttatcaaattcatcatctgctagcgttctcaaaaccgcaacaggggaagtcactaagtatacttataattctgatttcgatttatatgatcaatggaaacattcttcgtactatagaaatataaagcagcaaatccaggggtcttcaattgatgactccattaaggaagtggatccctctgatgtctcacctatttttaatattccgttgaagaaacaattattattttgcacaaaaagagcttttcaacgaagtttgggtgataaagcttatatgacggcacaatttatttctgtcgttattcaatctttggtcattggttcactgttttacgaaattccgttgactaccattggttcatactcaagaggttctttaacctttttctccattcttttcttcacttttctttctcttgcagatatgcctattgccttccaaagacaacccgtcgttaaaaagcaatcccaacttcacttctatactaactgggttgaaaccctttcaacaacagtgttcgactactgctttaaactttgtttggtaattgtattcagtatcatcctatacttccttgctcacctgcaatacaaggctgcaagatttttcattttcctcctgttcctttccttttacaatttctgtatggtgtccttattcgctttgacgacactagttgctccaaccatttcagttgcaaatttatttgcaggtattctgctactagctatagcaatgtatgcttcttacgtcatctacctgaaaaatatgcatccttggtttgtatggattgcttatctaaatcctgcaatgtacgctatggaggcaatactgtctaatgagctttacaatttgaagctggattgtagtgagacaattgttccaagaggtcctacttacaacgatgttccattttcccataaggcctgtgcttggcaaggtgctactctgggtaatgattacgttagaggccgtgattacttgaagcaaggtttatcctacacgtatcatcatgtgtggagaaactttggtattatcattggtttcctagtattctttattgcctgtactctgtttgcatctcaatatattaagccttatttcaataaggatgaaatagagcgcaacaatagtcgtttgacaagatggctaccatttttgaataaaaagagaggtaccaggtcctctgcaagaaatgacagtaagtatgttggtatcccaaagtcgcactccgtttcgtcttcctcgtctagcctgtcggctgttccatatcagatatcaccctcaaataaggaaatggctctaaacgattataacgagcaacctatcacggaaacagtagagactcaaaagcatatcatctcttggaaaaatatcaactacacagttggtacaaagaaactgattaataatgcatccggtttcatcagttctggtttgaccgccttaatgggtgagtccggtgcaggtaaaactactttgctgaatgtcttatcacaaagagttgagacaggtgttgttagcggcgaaattttgatcgatggccacccattgacagatgaggacgcgtttaagagaagtattggttttgttcaacaacaggatttgcatctagatttgctgtctgtgaaagaatctctggaaatatcatgtcttttgagaggtgatggtgacagggcatacttagacactgtttcaaatttactgaaattgccatctgacattttagtcgctgatttaaacccgactcaaaggaagcttttatctatcggtgttgaacttgttactaagccttcacttttattattcctagacgaaccaacctctgggctggacgctgaggctgcactaacaatcgtcaaatttttaaaacaactttctttacagggtcaggctattttttgtaccattcatcagcctagtaaaagtgtcatcagccattttgacaatattttcttattgaaaaggggtggtgaatgtgtcttctttggaccaatggacgatgcctgcggctatttcatgtctcatgacaacacgctcgtttacgataaagaacatgataaccctgcagatttcgtcattgatgcagtaggtaacagtaactcctcggcagggaaagatacagcggaggaagctcttactttgaacaaagaagccatagattggagtgcattatgggaatcttctgtagaaaagaaactagttaaaaaagaaacagctaggttagaagatgatgctcgtgcgtctggtgttgattacacaacctcattgtggaagcagccttcctacttacagcaattagctcttattacaagaagacaatatatttgtacgaaaagagacatgacttatgtcatggccaagtactgtttgaatggtggcgctggtttgtttatcggtttctcattttggcacattaagcataatattatcggtttgcaggatagtatcttcttctgtttcatggctctttgtgtttcatctccattgatcaatcaaattcaggacaaagccttgaaaacaaaggaagtttatgttgctagggaggcgagatctaacacttatcactggactgttcttcttttgtcacagtcaattattgaactaccactggcacttacaagttccacactatttttcgtctgtgcctttttctcttgtggatttaacaacgctggctggagtgccggtgttttctttttaaactatatgcttttcgctgcttattactcgactcttggtttatggctgatctatactgctcctaatctacaaactgctgctgtttttgttgcgtttatttacagttttacagcatcattctgtggtgttatgcaaccatactctttgtttccaactttttggaaattcatgtacagggtttcgccatacacatattttgtggaaacttttgttagtattctattgcataactgggaaatcaagtgtgacatgtcggagatggttcctggtcaacctctgacggggcaatcttgtggccaatttatggaagctttcatagaagaatacggtggctatctacataataagaacactttcacagtctgcgcttattgtacgtacactgttggcgatgacttcctgaaaaatgagaatatgagttacgaccacgtttggaggaactttggtattgaatgggcttttgttggtttcaatttctttgcgatgtttgctggttactacttaacttacgtggcaagaatatggccaaaggtctttaaaattatcaccaaagtaattccacacagagggaagaagcctgtacagaactaataccatttttaaatatatttctactttctacttaatagcaattttaattaatctaattatttacaagtcaccaatgactgactaaacaattgaaagagtcctttgtacaacaaaaaaaaagatacttgtcgctgacgctcaaaaaatatttatatagcaaaagtgcacgacaaaaaatgcttccaatcggatttgaaccgatgatctccacattactagtgtggcgccttaccaacttggccatagaagcagtaaaccgttattttgttgtttctcagagtggtacacgtcagtatgacaatacatcatcctaaaacgttcatatgaaacaaccttataacaaaacgaacagaatgagcaacatgacatataacttcgcctcccttagcttaaccacccaaacgtatagacgcctgagcaattaatttagatccgaggttcggcgcttccaccaattaatatgatccatattttatataatatataggataagtaacatcccatgaaaagctgataatccgttctgacaactggttacttccattgactgtttatattgggattttcaagacaccccggtattactcgtacccgtaaaacaacatacacttcgtcatgactgagaagaatataggagtaaaaagaatacctgaactaacagatataatcagcatcatgttttttaagcgagaatacagaaatattcaaattaagataggcaacaaggattagtttaaatctgaaaatcttttaagattaggtacctaatttagctatattgctttatgattagttataacgtcattggaggaacaaactattggaataagaatcgactataatctaccggcgagtattcataagctattatattgtggtagacggagtagaaagataaaaaaggattgaaaacagtcatctgatttaatggaagctgaaatgcaagatttaataatgtaataggataatgaatgacaacataaaaaatagaagaaataataatagtaacattatgtggaaatatgggtttccttggcaggttcctatatccttgagaaagagcttctaatatattttgtatatttagtattataactaagctgttagaaaataaaataccgctaaatcaattgaggcggtattaaatacctgtacatttgaatatttggaatgagaaagaaatatagttacataatgtacaaaaaagaagcaagaaaggaatatatatatatatatatatatatatatatatgtatattgttatttagaatatctctctctcttcgagaatctctatatcctcgaaaagaacttttagcatattcacgataggtcgtattatcaattaaatcaattacgaagttcggaagttattgcctacataatatgatgtcctgttcataaaaatagagccctaagaagtgttattaaatttaaccagcctacaaattaaatataaaatgagtgttattgttccaccgacttgaataattgtacaactttagctaacattttaactaatattttaacgcatcttattatcaagtattgtaacaatacgtatcatcttactatctcaatggaagcattctcttatacatactgagtcaaatatcttgaagactcattataatgtgtaataaaaggacaaagcagcgtagaagccttaaataactatgcacttggacacatgtcttctcacgacgtgttcaaatataatgatttttcaatcagctttgaagttcaatacaaacttcttcactaaaggataataagcaatcattattaatggcaaaatcggttttcaatttctttcattttgaaatattggagtatttaaaccgttttgtgtatcattcacaatactttcttccatactactgctctcttgaagttcttgggaagagccgaaaaaattggacatttcaatattggtgcttatacattactactgacaagaagataataaaaaagaaagatttctatcaccgatagtgagctctttagaaaactgaacgcaataaattttatgcctcataacgtcttggggcgcgagaatttactgacgtaaacagatccggctcaaaaagtcgtctttacctttctatcatctcgtcgcataattattaaattaactcacaatttctcacaatttatatcatgccttttttgtcagttcgtggccttgccagtggagatataacaactacttcgtaaagggtcccgaaagaaatgaaagaattactcatttgatataaaaatttgcatggtataacagaagtgaaacgcggggacaaccatgatcttttttgagtaggataattttttatgtcggtttgatatattataaagcaagtcatatataatatcatactgattttaaccaaacgataatcaatcagaaaaagaaaataaataaaaaatctagcacatagtatttcagtacccttatggttctgacctcagaaattattcagccgcttgttatcttatagtacgttttatatcgtaattttcctgacattttgggcagaaatcctttactcctgatataataaacgacgttttttttcctgtgttttttatgttactataagaaatgcaaaaaaagaaacaatagaaaaaggcagtgacaaaaatactaatcagaacgttgaaaacaaatcaatagttttgataatggtagcatcatcgatcaatgaagaatcctctttggcggtaaacttgacaagcgatgtagagaaggcttcgaaaactttgtttaaggcattcgaaaagtcatacgcaaatgactacttgatgaaaaagttcttccatatcccaatcactgaaaaagtttcaagggcaagaataaatgcaatgatacattactacacgacgtgctaccatgacttggatggtgaaattgctgaggcaaatgatttcgatgcagtcgcaatatggagccgccctgggtgccacttgcctgctacactatctgacgacgagtctttcaataagatttttttttcacgacttgactgtgaggaagcacgaagtcatgcctctgggaatggactattactacctttatgccatcggaaaagatcctagccatcccgaaattagaggttcagtcagaaaaatactcgaaaaatataaaaccaaagcagacaaggccaattgcgcccttgctctcgaggctatttcggagcacgcaagatctgtgtacgaatatttcggtttcaaaacctatttggtgtttcagttcggggttggagaagtgaactccaaaggagaacccgatccgcaggggaagggattcacggcctacttgatgctctaccacaaagatgcagacaccatctttcacgcctgattttcttctaaaaattttatagacatttattgtatgtatggagcatatagcaacaataaaacttagaccaacattttttgccgggtcacaaccccctatcccggctgcgagaaaggaaaaaaaaaagtatcagacaattgattatcaaagagtatgtgaaactacgctttgttttccacttcaattggtaggcatgtcaatacgtctcgtttcttcattggaaaactcttcatttcaaggataaaccatcgtcgccgtaagtattttgggtttcatttccttcccccctcgattttgcttttttttcctttttttgttagataaaaatataaacccttctccatatacctgttcacctcaataccgtctttaactggcttttttattttgtataaaagttctacttattaagatcaataggcacgtgctattttcgaacatccactttcaatatgatgcgtggtttcaagcaaagattaataaagaagaccaccgggtcttcttcttcttcaagcagtaaaaagaaggacaaagagaaggaaaaagaaaaaagttccactacctcatccacatcaaagaagcccgcttcggctagtagctcttcccacgggactactcacagttctgccagcagtaccggatcaaagtctacaactgagaagggcaagcaatctggtagtgttccctcgcaagggaagcatcatagtagctctacatcaaaaacaaaaacagcgacgaccccttcttccagcagcagtagcagtagaagttcaagtgtcagtcgctccggttcaagctccacaaagaaaacaagttcaagaaaaggacaagaacagtccaaacaatcgcaacagccatcacaatctcaaaagcaaggatcttcttcatcatctgccgctataatgaaccccactccagtactcactgttactaaggacgacaaaagcacttctggtgaagatcatgcacatcctactttgctgggggcagtatccgctgttccatcatctcccatttcaaatgcttcaggtacagcagtttcttctgatgtagaaaatggtaatagtaataataacaatatgaatattaatactagtaatactcaggatgcaaaccacgcctcctcacaaagtatcgacattccgagatcatcacactcatttgagagactaccaacacccacaaaacttaaccctgacacagatttagagttaattaagactccccaacgtcattcttcatctagattcgagccatctagatatacgccattaacgaaattgccaaattttaatgaagtttctcctgaagaaagaatccctttgttcattgccaaagttgaccagtgtaacactatgtttgactttaatgatccaagttttgacattcaaggtaaagagattaaaagaagcaccttagatgagctaatagaattccttgtaacaaataggttcacttacacgaatgagatgtacgctcatgtggtgaacatgttcaaaatcaatctgtttagacctattccaccaccagtaaatccagttggtgacatttatgacccagatgaagatgaacctgttaacgaactagcctggcctcatatgcaagctgtttacgaattctttttaaggtttgtggaaagtcctgatttcaatcatcagattgctaaacaatatattgatcaggactttattttaaagttactggaattatttgatagcgaagatatcagagaaagagactgtttgaaaacgacactgcatagaatatatgggaagttcttatcattaagaagctttattcgtcggtcgatgaataatatttttttgcaatttatttatgagactgagaagtttaacggtgtggcagaattgttagaaattttgggttccataattaatggatttgcacttccattaaaggaagagcacaaggttttcttggtgaggatattgataccattacacaaggtccgttgtttatcattataccaccctcagttggcttactgtatcgttcaatttctcgaaaaagatcctttattaaccgaagaggtagttatgggcttactgcgttattggccaaaaataaattccacaaaagagataatgtttctaaatgaaatcgaggatatttttgaagtgatcgaaccgctggaatttattaaagtagaagttccgttatttgttcaattagctaagtgtatttcttctccacatttccaagtggcggaaaaggttttaagttattggaataatgaatatttcttaaacttatgtatcgaaaatgccgaagtcatcctacccattatatttcctgcattatatgaattaacttctcagttagagctagatacagcaaatggcgaagatagcatttcagacccttacatgcttgttgagcaagcaatcaattctggttcgtggaatagggcaattcatgctatggcattcaaggcattgaaaatttttctggaaacaaacccagtattgtacgaaaactgtaatgcattgtacttatcaagtgtaaaagaaactcaacagcgtaaggtgcaacgtgaagaaaattggagcaaacttgaagaatatgtaaaaaatctaaggattaacaatgataaggaccaatacacaatcaaaaacccagaattaagaaacagtttcaacacagcaagtgagaataacacattaaatgaagagaacgaaaatgattgtgacagcgagatacagtgaaacagcaattcattacaagctcgaagaagtgaggaagtttagggcatgccacatttcaaaagagcagcagtatatgaagagcaaaaaagaactggtaaatggggtcaacttgttgaagaaaccaaagatagaatccccgaatattcgaacaaaactatagcaaagataagccacttggacaatggttgtttgtggcctgagataaaggtctctttttctcatcatttgagcatacttcaatcgatgtgtcttcattttattatttctatacttttctccaaatatatcttcgtttttcttttcgctttccttcttccttctgcctttcctctatttattttgcactccactcttttccgtaaaccttgcctatctattattggatttttgaaaactaaagtataaaggtatgtcataaataattaaataacaaaaaaaataggatcatgatacaaaaaagtgccttccccttagcacagctgatccaacaattttaagagcttgaaaagcaacctatacgtagtttttttggcgactggtaaaaaagaactgaataattaatgcctgcactatactgataccaaccattacccccataattagtaatgagagccatgttaatcttgactcagtagaactcacagtatacatgtttctccattctctagcccttaaataatccattgttttggtgatcttattcaggttcctatcaatttcctcgatggcgttgtttgcgattatgtcctctttgctttcatgggaagaaacaatttccttttccttttcgagggtgatttcaactttctttggggaagtgccgtagttattactcaaacagaaagtgtacttacctataccaaacgacttcagtagaaaatcagaatgcttcttttgtctttcagtgacgataacagagccatcaggggcggtaatatcgaagtctatctcgaaattcccacctgtcaaaacttggtaactgaccacaaggacatctttatcagaggataaatcatagtaaagacattctttggtaaaagcaggtaatgatatgcctacaggagcataattagaggagaatgcatgtgttaacaaagatgaactaaacaaaatcgcaatcaaagtaaaaacgcgcataattcctagcgatgattgggaatatatatttatgaaaaaacttcactagcgctcgtgaaactacttcaaaggcagctgggaaataaatgtcttcaaagcagagaagagttcccaaatagaattctcagatcgtcaatcgctcatctttgagtatatcacgtcaaaaaacaggaaacagtgaaaaaaaagtagtccataataaagcgcgtttccgtcaatgccgttggttaataaagaaacaaatatgtaaaaatataatataaacagggcacttgagagagcacaaaaaagagccaaacgctacctgatacttttatagttttgataatggggttctacaactgtagattcctgtccagacgtctatctgttgagccttgcagaataggtagcgccgctaaaagctatcaacagcgatcgatttatcactttggcgctgctctcacaaatgcccctagtggaagagaaacaccagacaagctacgttctgacctgcatagtgctttagagatggtcgatgaaatatatgacacaaattcgactgtagaggacattggaaacaaggaaaagggaggtcgacaaaaatatacggaagaaatggacaaggcgattaatctactgaaaacaaatataaagaaggagtatagacatgataagtatttggagcggacaaaggtaggaacgtatcctggtagaagaacatatcctggtaggagaacatatcccgctaggagaacatatcccgctagcagaacatattcagatagcaattcatacacttttcggataaatgtccagaagattaggcacgcattagtacgttacaatcaagatggtgttcaaaaacacaaccaaaagcctcctaggattggtcatggattaacgagagtgttataccaaccgttgtcgctacaaaaattgagagataataggagcagaatgtataattttgaccctgcagtggaaaatattaatccagagtatttggaaaagaaaagtgaaaaagatgtgaacacagactcctctggagaaggacaaagcaagccaatattcatcacaccccacaaagatgaatctctgttaaaggttgccaaagaacatagaaaaaagtacatatcttcatcaagttccatgacatcagtactttctcagttgcactatttattatccaatttcagaagattgaatatcattgattcctcgatatcgaaaaattttcctcaaaaaaactgcaattattcagaaagtgcatattttccgtcagcagtcattctgagaaagaagagaaatggcatttgttctattgattcagatagaagtctggatagggagattgtgctttctgtactaggtcattatcttgaagactttttaacggaaaagtccctgaagaatagttcaaaaagtgaaaattatcactattctagtatagatgaattcattgtgagatctcaattggacgcgtacgacccaaatctacctggaacgggtgtatttgatctgaagacaagagcagtttctgccataagatacgatttatcacatgtagagagtaataacaaccaaactggatatgagatagataaagtttatggggaatttgagtctttggaaagagaatattttgaactaatcaggtctgcccttctaaagtattctttgcaagctagaattggcaaaatggacggtattttcgttgcataccacaatatttctaagatgtttggattccaatatctacctttggacgaattagattatataatccattcttcgtataacagcaaattcgacagtttgttaaaggagaagaatgatatcacaaaagggatatatggtgaggaggactacattctacactatgacagggacgataggaaaattgcttgcttggtggctaatagggaatttaagatgtctatgaatctgttcagtaatattttgaaacacgttgagcagttacttaactcaagtaatacgaaatgggaaaaatgcaaaataatgcttaaaaccgaagttgaagaaaaacgatccaaaagtggccgcttctttaacgaaccggtgctaaatattgtagccctgccgttgtcacctgagtacgaggataaatctttattggtaaaggatacttcgaacgaacaattaacagaggagctactaaacctccgctcatataacgaaaatcttttggaggaacacctgaattccttagttggatttaaagtaaatgtcaagcatttctatcaccatcatcctaatactacacatctacctgattttgctttaaaaaagaacgatattctcgacaccgaatcccgtaaatatatttctgacatgatgaaacgagactggtacaaagatataccatctacacagactccaaactttttccacgcttccgatgtttccacttgggaggtgaactctacttttacagatatcaatgacaaacaaattttacgaaaactatactttaaatatttggatgttaaattaaacgcattgaaaaatcaagtaatcacacgtcaggaacctgatatgtctaaaaaggatgaaattatgaatcgaatcaaatcactacaagcccgcaatgatcaccgcgataatggaagtaacaaaagatattctaattttggccctacccgactgcaaactaaactgcgcgcatatgctaaaaaaggtgcccttcgaagaaaactattagaaaggagtaacaagttccatatctagaagacagtagtcagcgttgggcaatctaatgttataggtgaagttttactactttaatgtattcactcacaactttcgaccttatgtaattattctatgtatttttagatatgtccatacaatgcattattcttgtaattataacacatattaattaaacaatgggtcaaaaagagtcgagtcccttggtacatattatgttacattactgattaagttgaataaaagcatctaactttaaggaatctgctttattttgaagaccgaaaactacgagtaaaaataggagttttaatgcggatgaatgtctaaccccagagatgggttctccgataaaaactgagaagcttcctgttcacagtttttataaattattttgtatggctgggctcttgcaattttcagcgtttttttattaagcgaaaaaaacagaacaggggtcccctattcaaatatagacgtcaaaaagatgcagatctaaaactaattaacaaccatacagaaatcaacgcgatttcatcacaccattcgcttctcttcctccataagtaataatgttttcatcatcatctcgaccttcaaaagagccattactatttgacatcagacttagaaatttggacaatgatgttttactgataaaaggcccccctgatgaggcatcttctgtcctactatctggaactatagtattgtcaattactgagccaattcaaatcaagtctttggctttgagactttttggtaggttgagactaaatattccaacggttttacaaactgttcatgggccgcataagcgatactcaaagtttgagagaaacatatattctcatttttgggatgattttaatataaaaagttatttccaaaacttgtacgataatcataataatggtaaaataacaatttctagtaaatcctcaacaaatttagcagcattgccaaagagaaaaagagccctttctactgcatcattgatatcaagtaatgggcagacaagcgcaagcaaaaactatcacaccttagtaaaaggtaactacgaattccctttcagcgcgattattcctgggtcattagtggaaagtgtagaaggcctaccaaatgctgccgtcacttatgctctggaagctactatcgagagacctaagcagcccgacttgatctgtaaaaaacatctaagagttattcgaacgttagctatagatgcagtcgagttatctgaaacagtatcagtggataactcatggcctgaaaaagtcgattatacgatctccattccaactaaggcaattgccattggctcttccaccatgatcaatattttaattgttcctatattaaaaggattgaagttaggccctgttaggatcagtttggtggaaaattcccagtattgtggtagctatggaggggttatcaaccaagaaagaatggtggctaaattaaaactaaaagatcccctgaagcacgttgcccaaataaagaagaagaggagcctaaatgaagctgccgacgaaggggttgatacggacacaggggaatttcaagataaatgggaagttcgagctttattaaacatacctgcaagcctgactaaatgctcccaagactgtcgcattttatctaatatcaaagtccgtcataagatcaagttcactataagtttactcaatccggacggtcatatttcagaattgcgtgcggcactgcctgtccaattattcatttcaccgtttgttccagtcaatgtaaagacctccgatgttattgaaagaacgctcaaaacgtttggaccctcatatcaagtaacaagtcagcacgataattcattcagcagcaaaaactttgtagacgatagtgaagaagatgtgatttttcaaagatctgcttctgcgttacaattgtcttcaatgccaaccatagtatctggctctactttaaatatcaatagtactgatgcagaggctaccgcagtcgctgacacaactatggtaactagtttgatggtacctcccaactacggcaatcacgtttacgatcgagtgtatggcgaggtaactaatgaagacgaaacttcagcatcagcttcttcaagtgccgtcgaatcacaggcaattcacaatattcaaaacctatatatatcggatagtaacaatagcaataatcctattttggcaccaaatcctcaaatcaagattgaagatgatagcctaaataattgtgactctcgaggggacagcgttaacaatagtaacctgaatctggttaatagtaatctaacaattagtgaaaattggaacaataactctccttctgcaaatagatataataacatcattaatgctggattgaatagtccttcactgacaccaagctttgcacatttatctaggcgtaactcatatagtcgccaaacatcttctacatcgctgaagaacgatttggaactgacagatttaagcagagttccctcgtatgataaagcaatgaaatctgatatgattggtgaggatcttccaccggcttatcccgaggaagaacttggagttcaagaaaataaaaaaattgaactagaaaggccacaaattcttcatcacaagtctacatcctctttgttgccacttccaggctcgagcaagagttccaataatctgaaaagatcgtctagtaggacacatttatcccactctccattaccaaggaataatagcggatcctcagtatcattgcagcagttggcgagaaacaacacagatagttcatttaatctaaatctctctttcacttcagcaaaaagcagcacaggaagcagacattttccgtttaatatgacaacatctttcactagtaattcaagttccaagaacaattcacattttgataaaactgattctacatctgacgctaataagccaagagaagaggaaaactatacgagcgcaacccacaatcgaaggtcacgctcatcgtcagttcggagcaacaatagcaactcaccattaagacaaggaacaggttcatttgctaatttaatggagatgttcacaaaacgggatcgctcatagactgctttattttttgtcttcgaaatttcgacaaaaagatatgagcaatacttcatacacgtttgtacagttaagcatatatactttgatagagtactttcatacctcataccacttgaaaaatgataatataatgttataatactacctcataattgctataaagtaaaacaattcggcgttgtagtttatgcttctataatcacaaaaaaatttcactgaagttgtcagattctgccgcaaggcttctcatagattttgttaagtggtcttactcggttttatggcttgaaggttaacataattatgaaaacttattgatatcctccccacccctaacgttttaaaaatgatctcgtccaatatgtttgaggtgaataatatcggaccagttcttgtttttaaaagataagaattgctcatatttcccatacttgttggaaaatttctctcaacaattgtatgaaggcaaaatccctcaattgaaacattaaaatagtgattagaaaaacaggattaatcagttatacgaacgtatttttgagagaatataatgagaatacaatgagcttcagaagatctgtttttctttacttggcacttcttcctcaacaattattggcactacaaaattttctaattaaatgttaaagatcccacagacatcattcgtatatatcctcccattttatacggttagccaactttgcgatcctacggaaattgctatttttatagtcaactcattgatctcgagcacagctgctcttttctctcaatgaattacgttatatgttaatcacacaagcatcagtttttcatcgcaaaagaaaatatttagagttcttgcaattcagatgtacctcaattaataactcaatcacctcctatgttcttgctggtagtactgcttttgtcttaattactgctgaatcagccttctagaagaccgttctgtttcagccgctcgccccttttcaaagcttgcgcggctgagttttatgaggggcggcttttttgtgaatggcaatctaccattattagtagcaatatgatttgcagatagatacatatatatccttctgggttcatgtctcgttaccatccacactaatgcataggaccagaaagaaaggacatcgaatccaacacgtattaaaataaggactcctcattaaaaaggcttttaatattcaacttgctatagatcacgcacccttttggcaagtcaaccttaaattattatgatttctgtttgcccacaaaatgacttgcaaaaatgctacagaagcctcacattcgatgttccaggacaacaattcgaagagagaaatgaacaaaaccttaaaaaacgggccaaaaagaaaggcagtttccaaccatctgttgcctttgacacagtgccttccaccgctggttattcttctatagacgacagcagggaaggattcaaaggtgtacctgttcccaactattacacgatggaagagtgctatgacgatgaaacagactctttttcgccaaatttgcaatattatttgagagatacattccaatcatcaccttttctgaatactagaaaagagaacaaatctgaatccagtagttttccaatgagatcctcaaagttgttggaaaagaattctgacatcaaaaaatatttcttggtatccaagaatggaaaaatagtgaggagagactatccaagcacgccagtaattgtcaacgaaacgttgatgataaacaggtttgaaaagaactggataaagttatggcgccaaagaaaactacaaataaatgaaaggctgaatgacaaaaaaaaatggtttacttacccagaacttatcttctctgaagagcgtattaaaccgttatatagaggagatgatagtgcaccatgtacaaaagaacaaaaaagaaagcataaaatacttcaacaaaaggtcggatatcccaataaccctaagacaatagtttgtcacattaacggaaaaaaacatacgtgggttgccctagactggacagtctacaagtttgcacgaaatcttgatcacattgttgtcataactacactgccaaaaatgatttctaacaggaaaaaaactgcaaaagatgatacagaatgggcaccgggatatcaaaaagaagtaatagatcaaaaattaaacgacatttttgattatattttacagctagtaaaagtggtcaaaatatccgtcaaaattactttagaaataattgtaggcaaaattaaaaaaagtctggtagatgtcattaatgtccatactccagatttcttagttcttgctactttaaagcacgagcgaaatgagaatcttattacatataaatccaaaaagctgacagatgtctttcctgttagttatccgattcccacatttgttgttccctcgaaacgaatgtattcgttcgaactgaatctacaaagagaagtaaatgaacattatgtctcaaaaaatcatatgaagcacgaacacactgacgttgagagcatgagcagttcaatgttcaaaaaaaatacaatatcagatatttcttcacatatttccgtagattcgtacgccgaagatttcaaaaggcaaggctacatcaaaaagcagttcaacacctctaatgattccattccaagaaaattgaccggtctcgcccagcattcaagaaggaagatcacgggtgatatagaaaaattacaagacgatgagaaagatagagaatgtactaaggaaaaacttttgttgaagaaaattgatatcataattagagagtcattgaagtcttctttagcgatagagacgttgcctggtaaaaatgtatcgcagtccagtcacggtgaccaaatttccagctttaagaatgctttgataggcaatgggtcgaaaaacacaaagtttagaaaatctttaataccatattcttcctcagaggaacaaaataccacaacaactattaaactcagtagctcgcctacgtcccaaatcaagtttgcaacctctgtaaaacacaaagatggaagagccgcccttggcaaagccagaaatctgcctgatataaggcacagtatttccttcgacaaagaaaattcctttgatccatctgataaaagcagtagtgttgataatagcattcctttgaggaaagttaaaagtgccggtgcgttaagaaaagtcaaaactaatgactcctcaagtagtgcagggtcaaagaaaagctcgtctagttttagtactgtgaacaccttcactgggggtggagttgggatttttaaggtgtttaaaagtggaagttcctctggaaataaatcatccagtagaaggaatagtagcagtggcgatgtttttgaaagtgatgatcgtaacgacaagaaaaagaagaagaaaaaaaagaagaaatcattgttcttattcggcaaaatatgagcggatagtttgtacacatagtgtccctaaaattcctattgatgaatagatcaattttattagcagacaattgggggcagcaactgaatagcagaagaaatttgagttcaattatttttttttcctgtcatacataatggcctatttacaggtacatacatatagagtatgtatataaaatctctgttgaagaagacatcattcttagtccttggcaatcttagccaggatttcagcgtccctgaaaagaataacttcatcgtcgttacccaatttaatggtagaaccaccaaactgtggaatcaaaacttggtcaccaactttaacttgaggaacaaccttattaccattagcatcagtaaagcccgggcctacggcaacaacttcagcttggtttaacttctccacgttcttttcaggtaaatacaacccggatgctgtctttgcttgtgccttgattctttggacaaggacacggtccatcaatggaacgatagatttagcagacttcaaaagggtggacattcttttttttctgtagattcaatatattttcgatcaatggcttctatcagaaattattttaaacctagcacataataagtttgtactgtataagcgttttgactaattttatacataatcaagcttctttttcccattccttcaagattctagaaatttctatcattgatgacgggcattaccccgttaatgaccttcacacgaatgagaattgggcggctaatgagagaacttcgagaggtgcaataagtgagaaataacaactttagaactcattatgattgcttccaatacctaatcctacgtatgtactaaattaaaaagacagacatgcattattgaatattgacattttgagagtaactttttattatgagtggcataataagataatcgacgcaagccacaatttatacaataaaaaatgctaccatcgctgctacatatgaacgaaaataatacaactatcgttacggcctttgctgaaccgtaataaaataaaattccttgttacatttttttagccagctgcctcagaaagaggcgtttactatttaatggagaaagaaagcaaagaaaaataaaaggtattttctttacggaaagccttcgagcaatccaggagaaagtggacctttttttcccaatgaagagatcataggagtatggattgaaaatataatagaacttcgggtaacgaggtgtaatttcacagtccataatacagagctaacggtttaagggtaaatagttatctaagtcaagttttgaaggaacaagtaagaaaggtcgctactgtttctaaacataagatatacaaaaataaatatagctatctcaatgggtgctgcatacaaagtatttgggaagacggttcaacctcacgtattggctatatctacgtttatcgctactgctgcagtggcatcttactttaccacgaaaccaaaaaccaaaaatgaaggcaagaatagttctgccttgagccaacaaaaaagcggtgaaagttcaaactcagatgctatgggaaaggacgatgatgtcgtaaagagtattgaaggatttttaaatgatttagagaaagatacgaggcaggatacgaaagccaactgattatgtataaaaatttctgaaatggtggtgttcttcatcgttcagtgaagggatgcactgatttctataaacttgaagcactttttgaaactactgttctataacgaaaattagcgtccttctttctattaagtatgcattatacatataattcaatatattctgaatagcaaaacggcaatgaaaaaaaaaaaacactgaaaatacttgccttaggccattgtgcatgatacgaatatgcacaaaacttgcctctttttactttacggatcaatgacaacactcaggtgtaagtgatagttgatggcctttcaatatttgaaaggctggaagataattataaaaaatcgaactaattgcctatgattgtttcattactgagactattttttcacctcaagggggtcgtctgaattagcaaagccatggcaactagtgcagtgcttgaagtcaccagctcgtttggttttagatgcaagtaatgtaaagaaattaatttaaataaaataataaaagtttctactttttttttcaattaaaaagcataatacaaccaatcaattttatcctatttggcctgacaatgatgatatcataaaagtaaacggttccttgtttttatttttcttgcatgcacttttcagaagtcttggtagcgctactaacgcaaaatacgaaatattcattggctaataaacttgattttttcattgaatgtcgtttttgaactatatacaatataattaatgctacgaccctaaacttttcaactaactctttgacaaggaagcatcatcacttattacaaccatagaatgttacttaaaggactgttctcatctacatcaacagatcgtccaaactttgagcagaatccttcttgatcaaatccaacatcccttcaggcaaaataggtttaccttctttatctaaaacgtatctaaatggcatttccgtggcctcatttttattgaacctaaattcagggtagtcaatgaacttgatgtcttcaaatgcaatcctgtctttgataatcaactgtgttgttcttatggcagtatccgtagtcatttgtttatcacctagtcttctgctaattaaaagattcggataggcagtctttagttctttggtacgatctcttggaggatgatcacccaatatgccaccaaatacgaaatagtcgaatttcgtagcatcctccggctgtaaatcgattgtagccctagggtccaatagacagactctgccatcttttaacagttccaaatccttgaaatcttcgttaatgcccttcaaatcctttgtagtccatcttaaaccaagttttagtagcctttgagggatgtccttttccgtggtactctctggtaacgatgataaaatcaagttttcagctcctacttctctcaggatttggctatactctaaaatgacccattcactaaacccttcctccatatgctcaataatgtacttcatcgtatatctagaaataatctccacagctgtatcaatctatattaacaatagatatgcccctcaacatctaataagcaaagggcattgctcttttacaatactcgatgagcttaccgaaaatttctaatccaaaataacggaaaaaattgaaaaggtgtcaatcctgttacccgcaagttgaagtacggaaagaatacaaccttacacagtggaactataatagacagtaaagaaaaaagttaaaaaaaacttgtgccttgcgtttactgatcaaccagtctttctttttacatatatttctgatgcattttcatgtttacttaaaatttcttttaggataaacgctgcaatatccggttcttcgaaataagaaacatgtgattttatagctgatataaaatccacttctagcagacttggagacatagcataatctagacgtccggtgtaattcaaacctgtaagcattctcgtaagattttctgataacttgacctcttttttttctggagaagtttttttggactgcaaattattttcatcagtacctggcaaatctttccatatgttttcgccaaattccaaaactttagaagttagtccataagcttcactacaatgtggtaaataagtttgttcgtaatgagccatttctttactaacaagaggttccatcctataagaaatgggatcacagacgtggtaaacattataaatgtccttacattgcggtctctgtacggttaattttctctccaagtcattgggaaattcgggacggtcaccaatttttgttctttgaattaactttaacaatccaattggtgagccaataaagaacaggttgtctacttgaaattctaattcatattttttttgtttggatagaatatcaaataatatcatactacccaacgaatggcccactaaatggactttcccatcaaactctggattaaattctttaaaaatccgatatgttttgttcaattgagaggttacttgttgtagaatcatatcttggtagtatggttcgacatacaacaaaatatctagtagaccgtcagccagtagcttcctcaagggtaacactccatttactgtgacttgtgacaaagtcggtaggtcaggattttctatattttcctccttagcatccgtttggaaacttatcgagtgcctccaggtgatgggtagcacttgaacgttacagttgcttttataatcaggtgctgtgtttaatgattgtagtttctcagaattattgtagatttttttcatattagacctaagtagatttaccgtgtgtgcgaaatttacgtattcgtacttcttacccaaagtctgacctataccgtgaacgcatagtatcaagttatccacatctcttctgttacttctaatttgtctatcgcttgcgcccgaatttttgccatcttctattttgctactagcattagcgccttgactgttatctgcattgttatagtctgtttccatttgcttttccaagctctgtgcatcatcttgatctttactagcattaccattgaacaactgtaaaaagtccgataaattgaagaggtttgaaactttcttttctaactttgtttcaatgctcctcgatttggaactgttactaccatctgctacttccgtttgaggcgtttttgctgccttaaaagatgtggatgtctgtttagtagttgcggaggatgaatatttgtatgatcttgtaatcattgtagcattaatcggtaaggattgagccagattagaccttagaaaggctaattgcagttttcctccatctaaatccgatagtaaaaatgcagtttgtttattggcaaacaaaataaacttgaaagtagattcgttctcatctttattgctggatccatttttttgctctccttcgttttctttatcgactgggtatttacctttgagcctaaatatatcttgcgattctgcaggaggtgtcgtggtcggatcatcattactgtcgtcgaatttgagctgcttatacaacccttcaatttcggaggtaagatcactggacaaaggttgatttgaagagtcgaaccacacacctcttcgtacttgataagtagggccttcccaataggtaggggacaattccatgtgagagaggtcgactttaaacaggtaatcttcgttgactaaaacaggcctgcgttcttgacgcttactggccttttccaaacgattagaatcatcaacggagaacggcttaaactttttgggtgagtgtaaagtttgatatgtgggtaaatagggtttggagttgggtacgtctatggcatagaaccatggtacataaatgtgatttaaccttacgaaaatgtttctaaaacgagtgctggagggaaggcctcgatgagtaaaccgtagcatttcaagtaattgttcactgtgagtatattcagtgatcttcaatattagggaatatgcaaaaaaatacaatccactttttcttccaaagcgacaaattaggtcagaaaaccaacagaatattatattacgtaatttacttatttatatgtgtgtactatgtatgagaaccacgcagtcttgatttcgaccttagattgtaataagatgatgattttgctgcaggatcaggaccctcaagttcattagtcaaaagggccgcttttcttggtttcttgtcagtgggatttgctctcaacctttctcttaaaggtaaatcttccatgggagtagagctattcaagctcagttttctcttacgcagcaattttctttgtaaggaggaggatagcactggcggagagggtgggtccgtagtcgttgttgttgtagccgttgctgagagagacggtgatgggacgtaagaagcttcgtcatcagatttggaagattcctcttcttgctccttttgatatcttaattgaatttcacgttgcttcaaatattcattcaaatcatccggagtttcattaaccatgtcaatcagttttttgaagtcttctttattttggtatagtttttctaaatgaggagtgttcttgacagtctttggagcccgcgtatggttctcggagtggttgattggtgattgtggttttgggattgcaatgtcagagggtaggtagtctttgtttgggtccaaatttagtttcttgaacttagataaaatttccggatcctgcttatcattaggaagtagtttttggttgtttaaaactgccaatggttggcttgaatatagtttagaatgttttagtcgagtatggttcacgataccttgcgcggaagtgaaaccggaacggtcacatttggagcacgtaattataaccaaaatgccgtcatatcttctaaaaatgggctcattattttcagtcttaccgatgataccgctattgctcgtcaaacaagtgctactgtaattacgtctgtggttaagatgcatctgacttggtttaaaagggagtatctggaaccccggctgctcgtctaagggggagattgaggaggaacgaggtgaagaaatgccatccgaattagagtgaggaagcgagacgggagtgggcttggttatggcttctgatagagatttagaacctgttagcctgtaatcaattatattcgaatttgccggacggagggcagaaggttctagcaaaagcccgttactcttgcttctagtatgataatggtggtgtggtatgcgtgttgttgacagatttctgttgctgctcgaagacaaaggctgacagttgatgttataatccgatagaaccgggtatgacaggttataatttgatgcgttcgtattttccgtagccgtactgtcgtgaaagtggccgccgagcacgctatgctgctgatgttgttttattttgagttgatacgtccgttcgattttgttcaatagaccagtatccttatgcagggtttccaagagagctagttttgcgttaaccttttgaacatttcttcgtaagtgcctaacatgcttgtggtttagcattatatgtaggttcaaaacattctgtatttcccctttggcacattcgtacttcaaccgctgggtattttcgctatccttgtccggattactggtggcggtgtccattttgaagggctcatccatgttgttttccaaatcctgaggagactttggcgtggtaacctgataaacgttcgtcatcttagaggatgacgatgaggaagaattaggattatgatgctggtgctgcagtttatcttgggcgggactcatcatgaggagatggacatatacacaaagtgttggatgagaagcgtgagcccgaagagtagtgaaatgccgaagatcagggtgtttatatgaacgaacactagcttacaaatgtggaaacgggatccttcagaggtaaaatgcgccttcagtggccaaagttcatcaccttccttagcacgggttcttgctgtctgctcttcctgcttcttccctgttcgtttttccctcttcctacggctatgcacagtggcaaatgcactgcatgtgtttctgtggcgggtatccctcaattgcgggtaacaataagtaactcaacatcacgaacgacgtttatgtttgctgttaccacaaagggtaaaacgtcaataaaagcaagcaatgttattcgtgccagagaactatatctggcgtacgtcttatatataacacaagcaagggcaaatacgtggttagtggtgtaaaaactgaagggattaatttacatacaactagatccatctttctcaaaaatgacttcagtatcgccctcgccacctgccagtcgatcgggctcaatgtgctccgacttaccgtcctctttgcagactgagaaactggcacatattataggtcttgatgccgacgatgaagttctccggcgcgtaaccaagcagttgagcagatctaggagaattgcttgtctgactggggcaggcatttcgtgcaacgcgggcattcctgactttcgctcttctgatgggctctacgacctagtgaaaaaggattgttcacagtattggtctatcaagtccggcagggaaatgtttgatatttcgctatttagagatgacttcaaaatatccatttttgctaaatttatggagaggctctattcaaatgttcaattggcaaagccgactaagacgcacaagttcattgcgcatctaaaagataggaacaaactgctgcgctgttacacgcaaaacatcgatgggctcgaagaaagcataggacttactttatcaaataggaaattaccgcttacctcatttagttcacattggaaaaatctggatgtcgttcagttgcacggcgacctgaaaactctttcgtgtacaaagtgcttccagacttttccctggagcaggtactggtctcgttgtctaagaagaggtgagttaccattgtgtccggattgcgaagcacttatcaacaagagattgaatgaaggaaagcgaactcttggttctaatgtgggtattctaagacctaatatcgtcctgtatggtgaaaaccatccatcctgtgaaattattacgcaaggcctaaatcttgacataattaaaggcaatcctgattttttgatcatcatgggtacaagtttgaaagttgatggtgtgaaacaactggtaaaaaaattaagtaagaaaattcacgatcgtggcggcctgatcattctcgtaaacaagacacccattggcgaatcctcttggcacggcattatagactaccaaatccactcagattgtgataattgggtcacatttcttgaatcccaaataccagatttcttcaagacgcaagatcaaattaagaagttaagacagttaaaaagggaggcgagcgacttgagaaagcaaatgaaggcccaaaaagactcaatcggaacccccccaacaacccctctacgaactgcccaggggattgatattcaaggaaacaacgaattgaatacaaaaataaagtcgttaaacacagttaagagaaaaatactgtcaccagaaaactccagtgaggaagacgaagaggaaaacttggatacaagaaaacgcgctaagatacgaccaactttcggtgacaaccaagcctcataaacttaactattaaaattgagttaacgataaataatcgaggcagacacccctttgcataatatatcatccgtttaatttatcttccatttatatactcatacatataccaacggagatctgcatgtccgagaatacaaaaaatagtgaacgaaaaaaatatcacatcgcgaaagaaaagctatctgatatctgcaacacgaaaacacaacagtcgcggcatgcagatagtacaaattgagcaggccccaaaagactacataagcgacatcaaaataatcccttccaagtcactgcttttgattacgtcttgggatggctctttaacagtctacaaattcgacattcaagcaaagaatgttgaccttttacaatcgctacgatataaacatccgttattgtgctgcaatttcatcgacaataccgatctgcaaatatacgtgggaactgtacagggtgaaattctaaaagttgatttgataggtagtcccagcttccaagctttgacgaacaatgaagccaatttgggtatttgccgaatatgcaaatatggagacgataaactcattgccgcgtcatgggatggcctgatagaggttatcgaccctcgcaattatggtgatggagttattgctgttaaaaatttgaactctaataacacaaaggtgaagaataagatatttactatggatacaaactcctctcgattgatcgttggtatgaacaatagtcaggttcaatggtttcgcctgccactctgtgaggatgataacggaacaattgaagaatcaggactgaagtaccaaataagagatgtcgctcttttaccgaaagaacaagaaggttatgcatgtagcagcattgacgggcgagttgctgtggagtttttcgatgatcagggcgatgattacaactcaagcaaaagatttgcatttagatgccaccgtttgaatttaaaagatacaaacttagcgtatccagtaaattctattgaattttccccccgtcataagttcctatacacggctggctctgatggcataatttcatgctggaacctacaaacccgcaagaaaataaaaaatttcgccaaatttaacgaagacagcgtggttaaaattgcttgttcggacaatattctatgtctggcaacttctgatgatactttcaagacaaacgccgcaattgaccaaactattgaactaaacgcaagttcaatatacataatatttgactatgagaactgatatcttcgtgaagattcgtgtagtatgatagaacattccagaaaaaaaattcagattcatcgctctctcttcgcttctcctcctttaaggaataaagaaaaaatcacatacatagattaagtaaataggatctgctagaaaaattatatatagatcaatcatcttattaaggtatcttgtttaagcccaaaagtctgctcccaaattcctcactgtagctactaaaacaacctatacgcaagaaagatgtcattgacagccgatgaatacaaacaacaaggtaacgctgcatttaccgctaaggattacgataaagcgatagagctcttcactaaagctattgaagtttctgaaactccaaaccatgttttatattctaacaggtccgcctgttatacttctttaaagaaatttagtgacgcattgaatgatgctaatgaatgtgtcaaaatcaatccatcttggtctaagggttataatagactcggtgccgcccacttaggtcttggcgatctcgacgaagctgaaagcaactacaaaaaagccttggagttggatgccagtaacaaggccgccaaagaaggattggatcaggttcatcgtacccaacaggcaagacaggcacagcctgatttagggttgacacagttgtttgctgacccaaatttaattgaaaatttaaagaagaacccaaaaactagcgaaatgatgaaggaccctcaattagtggctaaactgattgggtacaaacaaaatccgcaagctattggccaagatctgtttactgatccaagattaatgaccatcatggctacattgatgggggttgatttaaacatggatgatataaaccaatcaaactccatgccaaaggaaccggaaaccagtaaaagcactgaacaaaagaaagatgctgaaccacaaagcgattccactacgagcaaggaaaattcctctaaagcaccacagaaagaagaaagtaaggaatccgagccaatggaagttgatgaagatgactctaaaattgaggccgacaaggaaaaggccgaaggtaacaagttttacaaggcacgtcaattcgatgaagctatagagcactacaacaaggcgtgggaactgcataaagatattacctatttaaacaaccgtgctgctgctgaatacgaaaaaggcgaatacgagacagctatttctaccttgaatgatgctgttgagcaaggtagagaaatgagagcggattacaaggtcatttccaaatcatttgcgcgtattggtaatgcctatcacaaattgggtgacttgaagaaaactatagaatactaccaaaaatcattgaccgaacatcgtactgctgacattttgaccaagttaaggaatgctgaaaaagaattgaagaaagctgaggcggaggcgtatgttaaccctgaaaaggcggaggaagcccgtcttgaaggtaaggaatattttaccaagagtgattggccgaatgctgttaaggcttacactgaaatgatcaaaagggcacctgaagatgctagaggatattctaatagagctgctgcactagcgaagttaatgtctttccctgaagctatcgcagattgtaacaaagccattgaaaaagatccaaatttcgtgagagcttatatcagaaaggccaccgcacaaattgctgttaaagaatatgcttccgctttggaaacactagatgcggccagaaccaaagatgctgaagtgaataatggttctagtgcaagggaaattgatcaactgtactacaaggcaagccaacaaagattccaacctggtaccagtaacgaaaccccagaagaaacctatcaaagggccatgaaagatcctgaagtggctgcgatcatgcaagatcctgttatgcaaagtattttgcagcaggcccaacagaatcccgctgctttacaagaacacatgaaaaatccagaagtattcaaaaagattcagacgttgatcgctgctggtatcatccggactggccgctaaaaataatacgaaatataactttattatcttgaattctttttttactgctttttcatacatacgtacatataatgatcttctcacttagtatactaaatttgtttcatgctatggttgatatttgagaaatcggaacttgaagataataagtttcttgggcgagggaaaaaaacatcggaccatctttcctgtcgttctccggatcagccctaggaaatttctggccggaactctccttagaaacaaaaaaaattacgtaattggcacaactttacgtcaacaatattcattacatcagaatgcgaaaaaaaaaaagcgagaatatctaagctccatgacaacattcgctaagctgaaaaaattagggaaataaacttttcaaattgctatgatataatttcgtttcttactatgtattttctacgtatatttttacactcttgactctttcctttttagtaatgtgcctgccataaaaaaagggagatgaaggaaagaaaataaaaatggtgaaaattaagctttgttgattacctaatacaagctgcctgaaactagaaaccataaattgtttcctatctcgtaatattttcgccaccttaggcatcaattttctttggagaaggggggttgcatccccctgaagaagtgcttgccatgtgctttgaaaacttttaagatgttactagtactaataattattcattattttattcttttaatttcgactttaatgattcaatcatttttttcaattcactgttttctttcatcaagccatcgaatagttttgatttttcttcgagatttttgatgtatttctcacgacgctgcctaaacgccttttgtgcgcttcgattttgggcagctctcttagtatttcttaaaggtttgcctgttttaccgatcaactggccatcattgttatatctttcgccttcgttaaaaacctgctctgaaagagaaacggaaactcgacgtctttcctctgaaggaaggttagtcgtggcactattttttctcgtagctggggtactatttgagggaaaatatgaagctgccggttggctagtaaatgtagatgcagtagtgtaggaagattcaaatggtgcgtgtgatgcagtggtgtatggattagaattgaagtgacagtttaaatgagtatctgatagttgcggtctaagctggtatgtgttcagtcttggtaaagacggaggaatcaaattgtttattgtcaccggccttgcaatatgtgggcccgcagtatttggaacatcctcacacaatgctcctatattaacagaatttcttcttccagaaagatctgtaagtgagccagttctgctctcataaccaggctcttcaagtgttgcaatctttgggagctgaatttgcggtagagtcacattcgaagcaactaccgaaattgtatgcaaatcagccttgttctcctctttaataaaccctacaggagggcttggcacgaaagcggtatccgtcattttttttggctttgtactgtctcttgtcattgaatgggaagctaaaataggttgaaaattaaaaggatgattgtccatttttatttgcattaacatttgagtaggtttttggttttccttcttgttccaagctgttattctatatctatgatgagattaacggctgcaaaaagtcgtagttaatcagtaaaattatctaatgaattatttgtaagcagaatgcgtgagaaaaaataaatcacccagttccttttttatatacatgaactttggtaatgatgcagacatcaactagttctcgagtgaggaggtatccttatcaaatcactctctccctagtattgaaagggttttactcgccttctgctcctagttacgatttttgcctagtactccttcctaccctcttcctcatagatttaatgccaataaaattttctttgcatgtcaccattgggatcggtgaggcaactccggttccgattttttttttttcagcgccgtggtatttccgctcgggaaatcccctcccgcattgcgtcagagcttatcgatgtaaagttaatttccctttttttcggttgggctggagcacttggttgcattactaacaaattaacgaacaatagttttaaaagcaagtgccttaagatttaggtcattccttcgaggatttctgggaacaatttaaagaataacagaaacttttgcggcccttttcatcatctacgtgttttgtaagaatgagatcacattccacgtagccctaaacattggcgtacatttccactcggaaccttttctcgacccctctccgtacgccaagttttaccttgaggagtaagtcgtcaaaggggcgtggggcagccatttcttaggaggtgggaagacatggcagtgagtgggccctatgattgctgctgcaggggacttttcaggataatcatgtaaacgataaaacggaaaaacaaaactacggacgttgttacctttccattttgaaatgtttctccgaaaaaataccattttgcacagttcaacattcttgatggcaaaagcgaagcattgcgtcaacgggttagataagtcatttactgtcaattagtaccaatacctgtctttgctcaccgaatggcactatacagtgacgttaagatcttgtagttgtttttcaagaaggcactaaataaggtaatatatggtgcctttcgcaatgactcgtgtatctggcagatctatagctgcacacctgatttttttgctatatttgaatcaggagtaagtttgaaccataatcattccaattcagtttgatagtaccttttttttaaaatttttgaaagagctatcgcttagctatcggcgggcatattgaattgcgcagtagatgaacatttcactagttgtggccaaagaagttagttaaaaagtgtaaatatgtcacagtacttatccttctctaaagaattagtttattaaaagcagcaacaagaagaatgactgtcaaccatttttaggtcattgcaacaaatctcaaaatacgcttttatagataatctaagaagatcgttatatgggaatactaacagtgagaaaatggaagaaacgggttagcgtagaaaattgtaattaaaaaacaacagttttaagaaggtggtgggcaattaatacttgaggattaatacttagagcttattcaaaaagaaaagatagaatttcatgtaatacatgagaacaatgtaaggtttttaaggtaacgagtaactaagttttgaaatatcttcactagccttgcaatcatcttttagcttttctatttgccggattctttacaacataatcacgctttcttctagttgtaattttccttctagatgtcattatttcaaccgatgtcattaatatccttttatggtgtttacaaaaagaaagtttcaagtaccgctcacctacactacgttgtaattcttagatacataactttagttttgtcgcctatgtgcacagataaacaaaacaacctataaaatttccgttgggcccttttgtccctgatttctggtgtgtaacccatttatttctgtcctgtaataattcgtcttcggtgattgccatatatacacagtttagctttactaactataaacatccgagaagaagaaaaaagaaggtctgatttctatcaaacaacatgtgaagataacacaatcgatgtgattgatatcagatttactagccccgttggattgaaaaatctgcaaggaagggctaaagagcaatatactttcttttgttgtttcggggtgatgagaaaattgtaacttttttttttaacttggcgagaaaattgactggaagaagtgtcaaagataaggcttctatcatattcaaaacaagtaccaccaaatggcagctcaactccgaaggctcaaaaacaatacttattgatattgcactcacaagcattttttgttgcggaacgtctttacgtgcaagattaatgatcataagattgcatttttactacctcctcactttagtttaccatttaggacttgtaggtgcgtatgaaaaagcagcaagaaagagaattcaacctcccgatttgatacctggtcctccgggacataaacttggtgatgaaagaccaccgcattacgaccaccggccaccttataaaaaacacatcgacaacattccagcttacaatctgactgatttgatagatgataaactactaaataaatatgaaaactcatgcacggtaaatgtattgacaggtggcttcatctctctagcaagtaattcgtggcacttacgtgcttataattacactttaaattacccatcctttttgatccgatgcgataatggcagtgcaaatcctaatttctctcatgtcttacaagactttgtttatgacatcaacaacaaattcaacgttcaagatgacagtagtaaatacatcggaaaagacccatttcccttaggaatgataatgatcacctttgcttctgggtgtatctgtgtggcaacatggatgctatttttggttgtcttattactgccatccgataatcataatagaagaaataaagttgtacatgtttacgtccttttctctgcgattataagaactgtatttctaaacgagactatagccgtcatatttgacagccaatatcacgatgactaccaggatgcgagccaatttgaatcgttcatcgtagaaactgcaccatataaaatatgtgaattagttgcaaatattttgagtgatataaactggatttatattgttcactacttacagtccaattatggaaaaccaacttggaattggatcccatttaaaatgaaaaaggggacacatatcataattaccgtgggttgcttcctctcactagccgataacattttattcgcaaaccttctttggagaaagaaccttgtagttttgaaggtattttacaagctaatcgaattactgatttacacaattttcatctccattatttgttacttcacatggcataattttgcttacatacttttaccgaaaactgctgaaattaatacggacggtaagtgtaaaacgaaattgagaattctttgggaaaattatcacgaaactataccattattggcgtataatattcttatatttattttattctatttcaccacaatttttttcgctgctttcaccaaacatgttagaggttggacatttaactttgttcatcttttgaaagttttaataacagtgaacgtttggggcttaattggagtattggaaaagagggagctgcacataagcaaaaaaacagtccttggacgaaaaattaacaatagggacaaatttttcgccaatccaacagtcaattattacggagaagatttaggcaagcatttaagcgccataacgttaaacagggatttaaacactactaaaagtaacactacttcccacgattcatcaagtttagtaggatccccttcacccacctggaaatctccaatcgaaagaataagggacagaagaagaagacataagataatgaaaagtgagaataaatttgggcaaaatcccagttttggaagtaaatcgaatggcaaacctaatactaaaacgacattatccaaatatcgacagctattaaggaagcctaggcgaaaaaccaattcatatgaaccaaaaaatggcattggacagaataaagaaggctcaactgttagaccaggagccgacaaacatattagagattccaattatctagctacagacatcagtgacaacgaaagtatggaaaccgaacttcgaaccaaccacatttataattacgaaaatagtgattaaggcaggcccagtggacgaaaagacataactgcagaagtacagctgcctttatttcttgtggtcatttattgcttttattttcaagtcagatatacaagaaaatcaaatcccatcgtcaacgtcacgtataaacgattaatttacagtaataccatactctaccaacattattttagtccgacgttcagtcctgtaggtgttccaaatccttctggcattgacttctgtgcagaaacccttcaaaatgagttccactttacgtcagatcgcataacaaccggtcatatatttttttcttttgctaaaccccctactgcaagcacttttaagaaaaagaacaataaatgcgtctttattgctgtgtggaagtgatttttgtctttcggacaaaaaaaggatagggatgcgagagggctgtgaagtagtgatcaagcggggcctatataagaagggcgcacatcgtcccccctaagaatagcgaagcgatattacactgaacactacaatgtcaaatagtactcaataaatatgactgtaaaaatatgtgactgttaaggcgaatgttgtaaggactcttgtcattgtgggagcacctgccttccaagctgttctggcggtgaaaagtgcaaatgtgatcacagcaccggaagccctcaatgtaagagttgtggtgaaaaatgcaaatgcgaaaccacgtgcacttgtgaaaagagtaaatgcaattgtgaaaaatgttaggtgacccctactctttacttatcataaatacatcatcatattttacccttaattaacaacatttatttaactgcatgaactaaatataaggtatagtttctttttcccggaatcttttttttagatcgttattatttagacggcactaagagaaataaattaaactaaattacggtgcggagctcaaggcatctgcgagtgtttactaacactaaaagagatgaataaaatagatttctcaatgcaaaattaaaattacaatgttacgcatacacacaagtacagatttgtatatagtatttcttcttcgttttatctgtcgtgttgaaacattttgttgttcaagtattaaaagtctcctgcgttgttaaaatccatatcatgtgaattgttggtgccgctcatgaggccgttttgatgtggaatattatattgaatgttatgcaatggttgttgttgtcgtggctgccgctgccgttggcgttggcagcttctggtttgcttttgtacttgttcactactactgttgtcactcaacggttgagatggctcggtaagatggacgaaagaatcccgtgtgtcatttgataaatgttgattagccaagcttagctgtaggcactttctttctaaatgacaaatatattcaatagatttcgttaaaatggacgccttattcaattttgttgctggctctaggccatctaagtctgctaggtctctagatgtaatgggaagatcgttacattttttatacgctactcgtagcgttgggacagttctccttaattgttcaattttatcattaatattggaacggtatttcttttcaattatattgtgtgatacccttcctgtcctcacccttgttattcttttgggtttaacatgaaaatgtttccgtataggtgaagtttttaacttgaagctcatactgtcagcattgtcaatattctccaaattcaaagatgatttaatctcgtctgcagtaactaagggagactctgtcttcgataaaggcaaaaaattttcaaagccagacaattgttcctttttcacgattgaagctgctgaaagaagactcgagtccttttcagatttaagatcggtttgctttacattatcaatgttttcattttcctcgctactaaagacttccatgttatcaatgtattcttcgctgtcaatagtattgccattgtctgtagtcattgtagtactacccgtcgttgttgtaggtatagaagccagagcatcattatagtaattactatcaattactggagtgtggcctgaagtattaggaaacgaggagtcactatactggtctgtggcagaatatgtgttgttcttatatacaggaggcacgggaggttgaagatggatgggatgctgaaatggagcgtaataagcatgcgtcggaggtccttgagaacccaaatcctcggtattgtaatttggtggcggcacgttgtaattgttactttgaaacattaaatacatttggttcgtggttacatttacattctgctcttcgctgccatcttgagcacttctacaatcaaaaaccttgatggcgactttattacctaggtcgttcattacagaattgccatccgaagaaccagaaaaaggtttttgaaaatttggcatttccaatttatactcttatcgttgctaaaatgagtcgtgtactgcaactgctctatattctatattctaagcgaatgggtgggtgggtgtgactaactattaaactacctaagcgatctcgagagccaaggcgagtagtagaaataaaactagaagcgcgctttacaggtttgaccttaagtatgatgcgataagacacttacataggacgatttttgaggcttacaatgtgtaaccaaggtatataaaaggtgctgctgctcttgggaaaaatacaaagaaaacgcctacggtaaaaatacaataccagctatttttttcttttgagaagcccactcaaagtaaaaattaaacaatgatggaaaagaacggaaaaaagttcaaacagaaaattaaaatacagcagagaagactaggcacaacaaagtgggattgtgtctacgcttttaacggtgtaccctttttcctcgccacgttttcactcagatctaaatctctgctgtaatttacagcggcataagaaggcacgtcccctgaaagtaggctagccagaaaacaaaaaggccagaatcggcgcggaacttctcgtatcgagagcaaatgaggggtgcggcacacagtaggaaagggtaactgattaacatacgtacaccccggcataaaagcttctgcaggctttgtaggcaagagacactgcggagaataaaaggttgtgacgcccaataccttcgccggactccttcttggcgttcacaaaagacgatgctgcagcatttttttcttgcgtcgaactcgcgcccacagcaacgagacggttccgttccttcccgtaatgttgctttgattaacaaaattctcgtttcctcagttctgtgagcccgtttgtcagcagaggaatcccaatgaagaaaattttttctggaaagtaaaagcgagcgaaaagtttaaggttcagattgcatcactattcgttcagttgatagcgaatgtagaccgctagcggcttgattagataaatagagtgggttaaaaaaaaggaaaaaaaaaatgtgaattgcacatgcccagcgcgctcgcaaaacatataaagttgtcctcacatgcggcgtgcattgttcatagcggggcaaacatacttgtggcttaatttgacacatctacttttaatcttttcttggtctagtacaatggctttttcccaaagtagaaggcttcttactccaaccgtaccctgtcctactttactgggcattgattttttaattcttgtcttgaggcatttcgacgagattttcatttgaaaaatatacctccgatatgaaacgtgcagtacttaacttttatttacctttataaacaaattgggaaagcaaggagatagatctgactgccggccgagcttggcttgacttagtagtttcgatgtcccttttcttactttcctcatgcaaaattggtgatgaattgaatgattttcgttcatctacgcttttcatgtcaatcacaattctctgtgacctggcaccaataaggctttttcgcagtgatggcctttgcgtgatttgatttttaccatcgttatcgtcgcaatcatcatctctattttgattgacgtataccattcctctacttttttgattaacgtgccgaggaaatagtggttgtctatttgcattaactccgctgaatgaagatgaatatctaaacttttgtaaaacttttgtgcaccccgatatactcctctgggatgacccgggaaatgaggtggtgctgctcgtgggaactcttgattccgcagtttcgctataatcctcgctagtatcgccatcaccgtcatcatctgtattatagatttcgttaccgatagtctttccttcagaattctttcggtcctcttcaatgtcactgacaacttcagaaacctcttcactcaggttgtcgtcatcctctaaattggttgtaataaaagaactaggtatttgtgtagatagttgagactcggaaacaggctcttccaaagattgtgagtttgtgtcctctttaaaatcctgtatgctgtcgcctttttctttgaagttttccacaacagtcatggagggtttattaaaaaatttgcttcttgtatccttcaacgtttcttggactacattggcattacttaatttcctacgcttaattgccattgtcagtttgtcttccgcttgtcttagactatggatgttatttgcaacttttgggttatgatccaattttgtcattttttggaagaacgattctattggtttgactttggcttcagaattagtagtattagttttcccgaactctatatttgacttggatgccagctgtaatttgtgctctctgttggctagaggttggtgaaaatcatatggattcaagtcaccttgagcaatttttaaatgcaagtggtgatctatatcgtcgtcgaaatgaacaatttgctttttctgagtttctctgtgtatgacaaaaccaatgcacgcgtagagtctttttcttttactttcggtatctttcaagtacagcggaatttcattcaagctcactattttcttccgaatagggcaaaataccctttggaattgaaatgctaaaactgcagcttcatattcattaatgtatgtgtctggtatcatcagttttccctcccgctgtatactcagaattatcctttcaatagtattgaatcttctaactaatttcattgcggtaatcaggccaaccttgggaattccatttgtatagtcacaaccggataaacaaaccattgttatgatttcttcattagttaaggatcccaacggaaactttttaggcagtttaataaaattatcgcgacatatttctaaacattctccataatcattcagcttcgtaatgagacgtcgacatccgaagacgaggaggtcagaatcttcggatattattccttgcacaatgtttttctgttctaaatataccatttgagagtcagcctcaaacggagccactatgtaccgaataccgtttagcttacagtagcatatgatacattttgccatttcaggcgttatgtcgacacatttttgaaaatagtccatagcatttttcttttcgccacaggcccacagtctttcagctatggctttgttttcttttctcttatcccttcttttagattcagtagactttttaactggaatggcatcaccatcgaagaccaaatacggttcaactttaaaggttttcaataaactaaatctttttatgaaaaactgcaggtacttatcagttggttttcccattgcaagttcataagcacaagagcaggctgctctatgtagccatgcatagccatcaatggctaacacttctccttcatacctacgtagtgatactggattctgtatgggctttaactgaggaagaagaccttggatacccattcctttctacgcctttcagttttttcgagctccttttattttaatgtggtccaaaaagcaatatcaaatataattctatgagagcatatagatatacctgaaggagcaaggacctgatattttttgttaaggtttttttacacgggccagtaatacaaatttctcgaaagatccttttgccttctatcaatcacgcaaatttttgttgtgcacaaaactagttattgtacttcccgcctttgctaaagacgcgtaagaaaaaaaagtacaaataatgccctataaagaaaaaaatttaaataaaacgcgaacttagtttggacgtaatacttctccttctcgggccggatattcgtatagctcgtagtagtcaacctcagttccacccaacatagcttttgaagtatccgaagaatagaaaaatcgttgccacaagggcgctgttacatcactattaagccaaaaatccgtcaaattcgtcttccagtgatttgtcactaagaaacttcgaagcaatgaactgtgatgttgttgtggaacctgtccatgcaaaatgtgggttatacctactatttccttaatagtaacgagccattgattaatacccatcattgaaaagcaagcgctaagaatggcgcggcgcctatttcttggttccaaaccatcaatagaaattgtgtgagtaatggtggtcgcacttggaccttcaggaatcatatcactatcttcaacacctttactttcactggtatatatagagttttcgaagggtatcagattgataaattttgccttgtgctcctccttgattaagatgaacaattcaggagtcgtgattccttttaatatctggaagaactggacaatcaacatagcccccagccagatgaagtttacgctaatccaaatgaataaaaaaaaggtagagggatcgtaattagaacccttacacaaagtctcattcttgagcagggcacatcttgcatattcttcaacttgttcgtaaatatagttcgttttcttaaaatatgccagacataaccacatgaacaaaaacatgtgatattggaccgtcacagcaaagaagacaaaaagtttgtgattttttaagccaacatcattataaatccatggacaataatggtcatatctggccaccagggcgccgctaaagaaagaatatttactcctcaaaggcttcctttctaatgtctcaacacaaaagttttccctatcaaacttccctaagtcaatcagttgttttattgtttcttgtatcgaagtcaaactatcatccgttttcagacaaccaggatctgaccgtactaatctcagaaatagtacaactgtgagaaaggaagtaaccaaaaactggacgtttttcatggtatagtcagatacactatatggatagagtttcttcgtccatatatatattaaaaaacagaaagtggacagaaagaggccactgaaaaagggagttctagtcaaagaaactttgtaagtgttttttctgggaaggcatggtaatacaaacttctttaatgtgttgaccatgacaacagtgaccagtagggaaagcataatggctagcactggagaaagaacgagagaaattaagtatatgtaaaccatgagtaaaaatggtgacaaaaaaattgtgaattgtgcatgcgagcttttcttgaacagtttgtctttctgatttccaagcctgtcatatccatgatgttgcaacgcttgttcaaaaagtgatttggttcccattccttcggctagatcaaaacagtcttgcttctggttattcctttcgtagaaatttgcaccgctaagtattaagtcacatatgaccctttgatcacctccaactagagcacaatggagagcattgaaccctctgttgtccgtccatgcaactgtggagccaaatttcaataaaagttctacagtgagaaaatctccttgataagcagcccaaagtaggggtgttctgttattgttatcttttgaatcgatatcgacgttgtcattgttgtttacgacaaaataaagaacataaacaacaagtaaaatgttagaactgtaaacgctaaaatgcatgatgttaagaccctgctcatctttgagcgtcggatcagcgccatgtttgagaagcaggtcaacaatgtagatattaccgtaccttgcggcccagtgcaaagcagtagcccctccggggcctgccgcctggttaggatttgctcccctaagtaataggaactttgctacagaaaacctattgtttatacaggcccagtgtaagccggataattcatcaatgcggtcgttattaatatccactgctccactttcgaccacgtccttcaccacttttaaatccccatccttagcggcttcaatgaaaatatcaaccacatattcagtgttggatccatcgcctagaagttgcgctttgttattgtccgaatcacttacagcgtgttgagccacatcagtgacaacagctgccccattagaagtttttttcacgttctcatcatcaataattgacatactggtcataagaaacagtagagtatttcacaggtaattaagatgtttatctgaccgatgaactttacaacttgctagtaaaaagttggtggagttcagttattattaaatgaaaaatgcaaagttttgacgctttctaattgtaaacgacaaagtgaatgataaaaagatcgctgaacgaaagatgattccaaatactcaaaaatagcagccatacaaactggaactactaaattcaactaagattaagcgattaagaagtcaggctcgtttaacaacaagcttggtacatcccaggctgcacgaagtcgtaacttaaaaaaaaataaagaagcgaaaaagagaagatcatttcctttggcatctattgtttgcgaagccatcggaccgaggcacctttgaaaaaaaaaaaaaggagcactttcttcctttttctctcacccagattcttttagaacacgtagggtaccagacataatttagagtagtgtgatacttctggtgtaaaaatagaacaaaatatataaagggcaccactaccagaggatattctctggctacgaaaatcttacatagttcttgtgtgttcattatcagggtgctgttgtatttcttagtgaaaattaagaagagttaaacatggcgattctttccatattagactttaattttagcaaggataacgggaattgccgctgaaaactctggtcctgaatcgcctctctttaaagacatatttaaagcatcctttaatttttgattttcttgcagcaacggatacacctcgttagtgccattatccggtatcacttcgaataatccaaaaaaaagcataagtaacctttgtcttaactcaatgtcatcaatttgatccgcaaatacctgaatagcattttcgattagttctttcttggttaacagttccttagctatcaatggaatcgtggtggcaatgttagcaaagatagcagccactgctcgttgagactcaacgtcggataactgaagaagtttcaccaatatattaaaatttctcaaactctgaggattttccaagttaaagaacttagcagcaatcgttaatggatgactcatcatattacttatgagctctaatgttgatctttgcaaaggaacgttttcgtctagcatcagattctcaatcgtggaccaatatacttttgtagatacgatatgcttgcaaacttcttcaccatcagaggtctccgatgatgccaagttcgtcagagctaatagtgcctcgtaattgtctgtcagctttatttgttcgtcgttatgtaacggattgtcatccactggcgtagaccttggcaacaattcgaacaagaaggggatagcgtttaatgcagagtattttttaaatatcaaacccggattagtgaatattagcattcttgttaatgcccgacaccctagaatccgtattggctcccctatgtcctgcttattggccaaatattctaagatgatagttgtaccaccttgtgaaatgcattgaggaatgaagtttttcgagcgggttatgttatatataaccctaaccacttgttgtttacaattggggctcaaattgtgcatttccctcttcaaaaaggaaatcagctcggtccttaatatgtacttttcgttaaacaaaagaatatcttcctttgattctttctctgcgcctaccttgtctgcgcctgggcccttcaaatctgcgtaattttttaagtcattgatagactgtgaactaccattggattcctctggtaaagtggacaaatttgccatgataactaagagaccatataaacagtgcgtcattttctggcttttaatcatagttaatagaatttcagtaaagctctcgttactcctaatcataatcttaaccgaggcctttagacttaaatatgccagcgcttcaacggacatttcaactttaggaacctcctcgagcttaaccgcactttcattgacattttcaatttttggcatgatacgtcttgaaatagcgtttataaagatttcggacagttgcttcaagtttatacacgttaattttgtgaaagaccatgtcttaactaacaccaatgcagaatatatttgtacatcttccacgtttagtgatctttccaatagttgaaggtaattttctgtaatatacgttctcatggtctcatcaatacacgcggaagataataaccgcagcagttcttttgtaaactgtaaatcctgctcttcgaatactctcttcttaaaaagcttacttagtcctttggtcaaaaatatttcagaacaaagtgttgtcaatgaaggatataattctgatagggttttgactatgatggacaatggatcatttccaacgtctatttctgcctccacaattaagctactcatgaaatcgaccactgctttatcaaagtctttttggaagcttgattgtaattcagcaaaaattataagcatcatcgattttacttcatcttcgcttatgcgcaaaataagttccttcactaaaaatcgcacctccttgaaattgtacttgaacttattcaatagttgtagaattatgctcagtaaatacgtgacgtgggtgtcctcgccatagtgtatcctaatttgcagctcatttaacaatgcaattgttgcgtctttattggaaaagcaaccaacgaaaacgtggatggatgatcttgataatatttcaaataaattgagtgcgaagggaatatcattctgtataagtttagataaatgtacgcgggactcagaatggtcttggtaagacctggtcaatatttcttcgattttctgacgatctttaagggcttcactattcgttaaatcagccggcattttcccagattcagatttttgccttagctggaaaattgtatttatagcatcattgtatttttggacatcaggggtggatttcaaagtcttgtcaaatgcagcgcagaggctatcaatagtagagctatcgattggatcattccctttctcacacagtggcatcgtgattctaattttttagtaatcttttcatgtgagtagtttagataaaacgtcttcactattaagtagaagattcgtaattggatttaagccttcgtgccttatcgcggctgataatcatcatgatcgacgatgaactactgcgccagagtataatcccctataaaacaggcctgctatcactccaaagagaatgcttttatagaagaatataacgtaaattactacaataattgtgttgagatgtcggaagacgaattttttggtggtgataatgaagccgtttggaacggttccagattcagtgattcacctgagttccaaacgttgaaagaagaggttgctgcagagttatttgaaataaatgggcaaataagcacgctgcagcagtttaccgcgacacttaagtcatttatagatcggggagatgttagtgcgaaagttgtggaaagaattaataagagatctgtggcaaagatagaagaaataggcgggctcattaaaaaggtcaatacatcagtgaaaaagatggatgcgattgaggaagctagcctggataagactcaaataatagcgagagagaaacttgtgagggatgtcagttactcttttcaagagtttcaaggtattcagcggcagtttacccaagtaatgaaacaagttaatgaaagagcaaaagaatctcttgaagcaagtgagatggcaaatgatgctgctttattagatgaagaacaaaggcagaatagctcaaaaagtactcgaataccaggcagccaaatagtcattgagagagacccgataaataacgaagagtttgcttatcagcaaaatcttatcgagcaaagagaccaggaaatcagcaatattgaaagaggtataacggaactgaacgaagtttttaaagatttgggaagtgttgttcaacagcagggtgtgctagttgacaatattgaagcaaatatttatacaacgtcagataacactcaattggcttcagacgagctaaggaaggccatgcggtaccaaaaacgtacgagcagatggagggtgtatttgttgattgtgcttctcgtaatgcttctttttatttttctcattatgaaattgtaaaccaaaccaacacacgtcgtcaaatatcatatacataatatatacacttaaaacagattcgtgttaatgaacttgttttgcactttcactgtacaatgcatgggctctctcataatatttctacgccgtcgcatcttaaccagccgcaaagagagagtatattccataattcagtttttcgcctttccttgcccttctgaaatgttgttaatatcatcataccctaatgaagagtgaaaattcacttaacccaagtgaaaaatacaacttcgaagagtgcaacgtgttgaaagaacccttcaaaaatagaaaagaggaaacgaaaaaaagaaaaagtagcatgctgtggaaaaattatgttctatccagttcccgaataacacgtaggcttcataagtcacctagaaagagcagcttctctaagaacttttttatcacaggctgcctactgacagttggagcagtaagcagttatttaacctacaggtacacaagtgagagggaaaacaaacatgagttatctccatcttattttgtcaagtacaagatttcacacaagcgagatattgattcatcacattttttattggaagtaactccgttgtttaagcagaaagttaacatatggtcattgatgactgcggaaaatctgtggtccgtcgagatcaaacaaccggaagtcatggtggtccgcaattatacgcctctaccgcttaaatttaacccagcttcaaaagagattgaaatcttaaaagatggtgacaatgcagatggaaaattatctttctatattaagaagtatgagaatggagaagttgcaagatggttacaccatcttcccaagggacatataattgaaataagaggcccgtttatcgattatgagtttcctcatttgcctaatgagctaaaaagatctcgcgattgtttatacatggataatcgcaatgaaaggggcaataacgttagagaaaattcccaatttatttaccagccttatgacataatgatgttcaccgctggtaccggaatagttactgcgttgcaactacttttgactgaatcaccatttagaggtactataaagttatttcatacggataagaacattaaacaactgggacccttgtatcctatccttttaagacttcaagcttcaaacagggtccagttaaaaatttttgaaacagaccgacaaactaaacaagacgtattgaaaagtatccagaaatcaatcacgaagccctacccatacaaaggtctgctccccttttccaacgttaacaacaagaatattatgcctgtgttggcattggtatgcggccccgaaagttatattagtagcatatctggaagaaaatacgatcttaatcagggaccagtaggagggttactttccaaagaaggctggaactccgataatgtgtataaactttcataatttaacgttcgagattaagaaggcaattacaataatattacatactgtagataatgaatataatgaaaaatataagagtttaaactatacattgttaaagccaaactaagatattatattcatttccttggcataacgtgtagtaactctttgaacctgtctgatatcaccgcatgcaattagtatcttttttagaaggttcctcttaaaatctttatcggcaaatgctgacccggtaccactgatggggagatcatcatataaccattgaaaaacatcgttcaaacggtccatataccccaattcactcagacggatgcaataaaccatcattagcttcgaaaactcttcaggctcctccaatctgatacttattaggattttattttccaggtgagacaaagttacgatctcctccatattttcaaatccctctttcattaatattgtcctagcaaatctctgtaaattcttaatcctaccctttctattaagttcgtcattcgttttgcattccaaaaagttaatgatactttgattatcattcttgatatcactaactatttcattaatattagattcactgccattaaaagagtcggtatttgctttgctagaagacaacccagtagtattagtagtgtcccagtactgcgaaccataggcccaccacccatcgcttaccagaagccatgtttccatgttcttatcgaacaaataaccatcgccattactcagtgtaactagtggcacacccttttttgtaatagagcacaatgttatattttcagctctggtcaatatatcatctgagtatcgcaatgacgggtttaacaatggataaatagtgttggtgggaaaagccagcttcttctgctctatgttccaacaataaagctcccctatgcttgttaagcaaagtaaataagttccacatgcttcaaggaaactaatgctaactcctaatactaggggagccattagttttctacccgaatcagaatatatgtaaatacttccgtcctcactacagaatgaccaaaaggtgtcacctgctgtgcagattgttatgagttttggaataaaatcttgaaatagaacttgatcttgatcgagaacttttgaggtaagcttgacaattgtcggcctttgttcattgccagatccattcttaacatcgaggattaaattcggattattaattggagagtatttaaatgtagatctgattttcggtgttgcaagtctaatccttgagaaagacgtattgggtaggagcaagccggtatctaaaaagtcaattggctgtagctcttttttctgctttttgctgccaggggcaatgttacttggagttgcctcttttggctttctcttcaaatcccttggcacagtgtatgatggagtgttgaattccattgatgtgctctggatagttttgatgccattagtttgattgttagccgttttttttttggtcggtttcttgcccacggcagatctaccaatatcgtttggaataggtgctgcgcttgcagattcttctaatttgatgttttctgggaaacttttcggtatttgttctgctaacggctcttcaagctttggaagctttttgtttacttcttgtaacgatttgatttccgtttgaggcaatgctacacctaaatccttctcttggaatgcgaatgtatacaatgtcgcgtcgtttgaaatggcaaacaaggtgaacccatcctgtgaccaagacatatcgtttattgcggtggaggaaacctggagagcattaaacaaaggtttcattctcttcgtattccaaaccaaaatagtaccgtctgtagatcccgaagtggcgattaaattatagcgtgtgctggtgccctttttcaaattaggcttttcataaaatgctggagaataaacaagaactctacatccatttgaagaaggtgttaccagtgtttttgtaactttgtagttgttatttctgtcaagtaaagcggtacagctggtagcattattcggcacacctttcaccgagtttatcactggtaaaatgtctgcctgaggtgacattgagattctataatgtaatggatacatttgtacatgctgcgtaagtttatttatgagtttgtgtgtacccgttttgttaatttgatagactaaaattgatctatctgaagtcataacagtaaaagtttggccagtaggatctattatgcctgtaataggtttgctcgccttgtcaatagttatttcagagagtttatcaaaggttttatgccgaaataatagtatcttattttcattacttaaaagaacaaataagatacctaagtttatgtcatatttcacatccgttattgtgcttggagatttacactcgaacagaagcttactgttcattttttcgacagaattgatgttatttgtatctctacagagccaacctgaataaccccacagacgatgttcagatccaatatacaatgtttcgagatcacctgttatgaaaaaaatatcaccggtagtatcctgatccacctggaaagaaacttctggctttaaatccttaatcataaccctatcgaatgcagtatcgactagttgttgttgtctccacgccatcacgtgacccccactgcctgccaatatgatatagggaccaagggcagctaaggcattcacttgttcattatgaatatccaaaggatactttaataatctcattgttccggattgtgtaggaactcctttgctgcgtggcgtattcctctgtatggacgatttagcactttttgtatattgttttatgaagacttcataattctagccgaattaactgatatttttttcgcgcttttttttgtcgaccttccaggaagaaaaaatatgaaagcgaataaatggaggtgtattggcaatcctttatcaaatgaaaacaagcaccaaatagaataagtaaatcacattcttaaagaagttggtcattccagatacgtggaattttcctgctgtattttttcatcaatcttttacttgagaaatactagcttttttcaaattattcaagattaagggacttagagaactgatagaaaagcagatcatgggcagtagatcggagaatgtgggaacagtgactagagaaggctccagagtggaacaagatgatgtcctcatggatgatgactctgactcatcggaatacgtggatatgtggatcgatttatttcttgggagaaaaggccatgaatatttctgtgatgtcgatcctgagtacatcactgatcgttttaatctgatgaacttgcaaaagacagtttcaaaattttcctacgtggtacaatatattgtggatgatttggatgatagtatcctagagaatatgacacatgcccgtttagaacaattagaatcagattcccggaagctgtatggtctcatccatgcacgctacattataactatcaaaggattgcaaaaaatgtacgctaagtacaaagaggcggactttggaagatgtccccgtgtgtattgtaatttacaacagttgttaccggttggtttgcatgacattcctggtatagattgtgtcaagttatattgtccatcttgtgaggatctttatataccaaaatcatcgagacatagttccattgatggtgcatactttggaacaagttttccaggtatgtttttgcaagcatttccagatatggtacccaaacacccaactaaaagatatgttccaaaaatatttggatttgaattacataaacaagctcaactgacaaggtggcaagaactacaacgactcaagttagttgagaaacttgaatccaaagatgttgatttgacgaaaagtggtggttttaaaacctaactattaaagaaagaagaaaaaattcgaaatgaaatcctaggcgaaattgaaaacgaaaatgaaaataatggagaaacttcgtcataaaattgtgaaaatcaggtatcatttgttctcctagcattttctttcctagaatattactattttctacctccattcgtattttacttttcctatttaatattaaatttttatataccgttattgccccttacggcaataatacaaccagataaaagagcgtgctccgaagttagcctgttatatatcaacaatttgcaaatgtggttacccacgaattattggtgttattttagtgaatagcttgaaatctttgaatgtaggaagcatccttatttatcaagaaattggagaagtggcggcatcgcgtggagactgcctatgaactaagaggcggtttatattttaaaaactcaaaagctgtttgaagactaatctggaagtactgaaaagaggagatttactcattctttggtgcagcaaatttctttcggcatgaagtttttactgcagcaaataagaaatatgcatgttaagcctataaaaatgcgatggttgacaggtggtgtcaattatagttatttactaagcactgaagacaggagaaactcatggctgattgaccctgcagaaccacttgaggtgtcgccaaaattaagcgccgaagagaaaaaaagtattgatgctattgtcaatacacatcaccattatgaccattcgggggggaacctagcgctttatagtatcttgtgccaagaaaactcaggtcacgatattaaaataattggtggatctaagtcctccccgggtgtcactgaagtacccgataatttgcagcagtatcacttgggtaacttaagagtaacatgtattaggactccatgccatacaaaagattccatatgctattatatcaaagatttagaaacaggtgagcagtgcatcttcacaggcgacactttattcattgccggttgtgggaggtttttcgagggcacaggaagagatatggacatggccttaaaccagataatgttaagggctgttggtgagacgaactggaataaggttaaaatataccctggtcatgagtacaccaaaggcaatgttagctttatcagagcaaaaatctattccgatatagggcagaacaaggagtttgatgcgttggaacagtattgcaaatctaacgagtgcaccaccggtcacttcaccctgagagatgaactaggttataacccattcatgagattggatgatcgtgccgttagactagcagtcggcgatactgctgggacttatcccagatccgtagtgatgcaagagttaagaaagcttaaaaacgctatgtaactggcatgcagtctaaatatttgcaaagtatgtctgaaggactaatgataggtgggtcaggatatcagcttaatcctcacccatgaagaagaagatatgtcaaaagccatattcagtaattggtctatttgtctccgttgtccacgctttcatagccatagaggaaaaggcgtagaaagttctatataacagagtatttagtattatattcccgaggttttaggaaagaaagaagaagaaagagaaggaggaaaatgggaagaaacttaagattgaaagtgtgagaaaaatgaatggccctctctttatatagtgttcaaaaaattgaacagcgatttattgtcatcacagacgttgagtctctctcttttcctattaaaattaatcttagcaagtaagggcttggagggaagatagcgttgagctgtgaagtcgatcaaataaacagcttgagactagttaagtagccacccccagcaaaacgatattgccaaatcaaaatcatggaagaaaaggaaggtatcaaggattcttctctccttgagaagagtaatgttccggaatcaattaatgaggatatttcaaagacgacggatgtggatctaaattccgatgggaaaaaggataatgacacttctgccaaggatggtacacctaaggttgaagaaaaggtgaacaagtcctcaggaattgatgaggacgaagtggtgacacccgctgaggatgcaaaagaagaagaggaggagcatccccccttacctgccagaaggaagtctgaggaggagccatctaaagagaatccaatattgcaagaattgaaggatgcttttcccaatttggaagaaaaatacattaaagcggtgatcattgcgtcccagggtgttttgagcccagctttcaatgccttactattcctatcagatcccgaatctggtaaagatatcgagttaccaacacaacctgtaagaaagaacccagaggcgccggcaagaagacgacaaactcaattagaacaagacgaattattggcacggcaattagatgagcaattcaacagctcacattcccgtcgtcgtaatcgtgatcgcgcaactagaagcatgcatgaacagcgcagaagacgtcataatccgaacgaaagggagcaacatcacgaagacagtgaggaagaagattcgtggtcgcaatttgtagaaaaggacctgccagagcttacggacagagccggtcggtcattacaggacacagcaaacaaagttagtaactggataagtgatgcttaccggagaaactttgcgtcaggtaatgagcaaaacgacaaccaacatggtcaccaagatcagcaagaatgggagccagagattgtggatttgtcacaaggcgggaaaaattcaagaccccagcaacctgagagaagaagattcaattcgtttggcgttcaagtcggtgatgactctttagaaagccacggaatcacactacacaacgaagatggatttgaagatgatgaagatgtgccacctcagttaccaacgagaacaaaatctggtgagtcgactggaaaagtagtggcagagacaacctacattgatactccagatacagaaacgaagaagaaatggcagccgctaccaccggaacccctggatactacaccaactaaagtaaacgctgtttctagaaataagaaaaatccggatgaggatgaattcttaatcaatagtgacgacgagatgtaaagctgatatctacgtacatgtgtatacgtgccaatatttggacgcatcttattttacgcgcttgtgaagaactcactaccttcttgaaggaagtaagaaaaaattttcagaattgttgatagtcgtatatcttccattataactattgttagctattaattcagataatgtagataagattgaaaacataaattcatcataaaaaagaataggtcttttacggcacccgttcagacactttgacacttcaaagtatatgcatcagcacacttctgaccattctacgtattgtaacagcaacatgagttctttaaaactccaattgacattttcgtaatgtgttttgcatatcatctaaatttcaatgacagatttaaaaagtcaagtaattaaaaattttcataagcgtgcttttttatagtgcgaagaacggcaaaggcaaccttaagaaaaaaaaatgataggttacgtgctatatccggaaaataaagaaagatgagtaagagttaaagaaagaattcaaccaacctgatgggtgtatgaaaatcccgattttatatcgacagcgctagcatgcatgaacagtgttttgacggtcaagaaaaaacataacctctgcataatgtacttacttatcaaaacgttgcaaatcttgtatgtaagaggtgtttgggtgttttttccaaacgacccgaaggagggcaattcaaaataaaaaaagcaaattttatcaggaagagaagattttagtcagaacgggccatgttcaatggccaatttcttatgctctagagtaataattactaaggaggaaagtaagacaaaaaacggtctatcgttgttttaagtttacagcataggcatagtgatagagtgtgagagagtctctaactcggcgtcagtttagagtcatttttttcttttctccccccaaaggtcataagaagataaggatccaaatttagaagacaaaaaaagttttgttagaacgtttatcccattaaaaataagggaaaagagaaacaacgttatttagtgatttttttaattgagaagcattttctccagtgataatttaattgtttttttattcggaaaagaacagaaagcgcaagaagacaactccttcacacttaggctattaattttcccgcctccccattaattgataaagataaaggttgtctgagcttacacttattataaacaatggacgatataatcacgcaagtttctccagataatgcagagtccgctccgattctacaagaacagcaacagcaacagaactcacagtacgaaggtaacgaggaggattatggtgattcattgattcatttgaatattcaagaaaaccattatttcattacgagggaccagttgatgtctctacctgaatccctattactgtgtttatttccctcaggtgtttttttggaccgttgtggtcaggtcattactaatttgaccagagacgatgaggtctacattgttaatttccctcctgattgttttgagtacatcatggagatatatacaaaagcgcatgatgatttgtataatcatcctgtggagaaattttttgacagaccatcaagtagctttgtttcgaatgcaaagggattttttggactgagtagcaataattcaatttcgagcaacaatgagcaggatattttacatcaaaagcccgctattattgttttgagagaagacttggattattattgtgtacctcaggaggaatttcagtttgattccactaatgaagaaaataatgaggatttattgcgacattttatggctcaagtgaaaatggctgctggcagttatttaacttcaaaaacatcgattttccaaggtttgtattcttcgaatagactaaagcaacaacagcaacaacagaaaattgaaaaggggtccaattcttcttcaaatactaaatctacttcgaaaaaattgggacctgctgaacaacatttaatggatatgttgtgctcctccggattcaccaaggaaacttgttggggtaacagaactcaagaaactggcaaaacggttataagttcactgtctctttgccgattggctaacgagacaactgaaggatttaggcaaaaatttaacgaggctaaggctaagtgggaggcagagcacaaaccttctcaagacaacttcatcaccccaatgcaatctaacatatcgattaactctttatctgcaagtaaatctaacagtaccatttctacagcaaggaatttaacaagcggaagtacagcacctgctacagcacgtgataagagaaaatcaaggctgtcgaaactagcagataacgttcgttcgcactcttcctcgagacatagttcgcagaccagaagtaaacctccggagttgcccaaattgtatgatctagtgccaaaacctaatatcaacgctaagctactattattttggagaaaacctgctcgtaaatgttggtggggtgaagaagacatagagctagaagtggaagtcttcggctcttggaaagatgaatcaaagaaaatcattgaattgatcttgccaacaaacgttgatcctgaagcagaactacataaaatcattgtacccgtccgattacatattcgtagagtttggactttagagttgagcgttattggggtgcagtgagtgtatataatatattagagaaagaaatggaaagagatcgggccaaagacacaatatgtaacagtatggtttcttggtatcccctctttctattcctcccttgttacgaaatgatgtatatttgtatctctataacaaaattatatgaactgtctcaaagcacatgaagaaggaaaaaaggtggcgtcgaagactgctagatatttctcttcgtatcttcccatccccttctgcaaataacggtttttccattgtctatttcaaagttacccgcataataaagtcgtacattgttcgaaaaatatcactcaaaagcagcattgatccggtataaaacaatagaaatttttttttttttttattgttataattattctgactcacgtctggatttcgttagttcgtcattttttcttaatttcagtaaactgtgatcacgagtctgcaacatcattatacaccgtatatctgtattattaagaatcagggtctccttttaatttgctgttgaaaaacatcttaagggagtgtgattgtctgttgatgtatactagtctggtaaagctaaatattcttataaaaaacttttggtaacccattattacaggaaacaagatccatttatcagataaaaattataaaacattaaggaatcaggacctttttttcgacaatcatgatagaggcgttggaaatagttctattgctcgttatacaatcacttcaatatatctgtcgcacatgcatagcttttttgctaataccattcttaggcctgtatgcattcgatctcttcctatacgtttatcggatgatactttatctgtcacaaatgttcaattacaagagaaaactaggacgttctaaaacaaataataggccgcatagtcccaggctacataagatatacagtagtggggattgcatggataccttaattggccaagtaagggatttgagagtatttttgttatccacgatccacagccactctaaaagattcttttctacgagatttcagacaaaatcaggcattaactctgctattgacgcgaatgatgttgaaacaacatctgacgtatctagttttacaaatttacatttaacaaggtcatcggaagaaggttattatatcgcaggatcgatataataaaagaaaatatggaaaaccctttcatgggtgtttgcacggaattaggatcacataatgaatacacacaggaggaaaacggctcgatacatgatttggccataacggcaaaagcgtatactcacataatcgtatgcaaacatatcacacaaatctatcatacgtatgtatacatttatataatatatgcatatggcggataatatattattgttcactgattttgtcactttatacgtagtcttcctcgcattatttagagacgagggagaaaaatgggccaaacatatttgatcattgtacgtgatgaatccatgtcctgtaggcttctcaagagaacaaaaacaaaacacagacaaaataattgaaaaatggacggtatgtttgctatgccaggcgcagctgcaggtgcggcctccccacaacaaccaaaatcaagattccaagctttcaaggaatctccactatacacaattgcactaaacggtgccttcttcgttgcaggtgttgcgtttattcaatctccactcatggacatgttggccccacaattataaggggttggttcttgtatagttgagattttttcacttacctgtatatatattggtttttgggttctcaaaagaatttgtcaaatatgtttatattttattcccgaattatgtagagttagcagtgtatataatggaaaaaaagcaagtatgctttacatttagtattccttttaacgcaagccttttgtatacgggctgtttactgttcaccggaaagccgtgacaaaagagagtgacaaaggtatcgaaatcacaaggtatatgctgtgtttgtatttatataagctttgcctcacaagtaaaagtggatcaacaaactgagaagaaacaaatgggacccattgatgtcgtaataatatattcattggtgtatgaaattagattaaagcttttacgtattttgaggtattatgtactgaattctaatcctttaacactttcttaactattttttcgacttcatcccaatcatccgttggaacacgagtcatttctatatcaccgaagtatttctgaattgcagataaaatattgaaagaatttttgtcatgtacaaaggaaatggcaacaccttttctgccgaatctaccggttctaccgattctgtgaatgtaagtagctggatctgcttgtccgttagcaagcgttggaagatcatagttgacaaccattgagacagtaggaatatcaataccacgggccaggacattagtagtaatcaaaactttggatctaccctctctgaagtcgtctattaatctgtctctttcttgtgtctgtaaatcaccatgcaagatagaaacttcatgaccttcacttttcaatttcccatataaaacgtttgcggtttttttggttgcaacaaaaataatggaagatccaattgtcattaaaccatatagctcagttaaaacatcaaacttatctgcttcgtttttgcagtccatgtatagttgtttgatggcatcaacattaacttcatttgtttgtaattctaaagtattagcatttggaacgatcttctttgcgtactgcctaactgcatcggcaaaagtagcactaaacaaaacaagttgagtatccttgggtaaaaatctcttaacacgaatacactggtcacctagaccctgctgatccaacatgttatcggcttcatccaaaacaaaaattttaattttctgtagctgcatcaattttctacgcattaggtcaagaacagtgcccggcgtaccaacaatcacttgagcattaatttgcttgtttttctcaaaagaatcgggaacaattaactgactggttatttttgtgaacttacccatttcctgaacgacttctagtgtttgtctggccagttctctggagggggctaagcaaattgcctgtggagatgcgtcttctgggtttactcttgttagcatcgttaaagaaaaggcggcagttttacctgtacctgattgagactgagcaatcatgttcctaggcggattatgtaataataatggcagcgccctttcttgaattttggatggtttttgaaatttcatagcatatatcccctttagtagttctggtgctaatcctaattcatcaaaagatttagcactgtacaatggagaatttgggtcagcctggatatcagcaagtttgaccttaacttcatattctgagctgattaaattactatcctcctgttttgtttttttttcctcaacttttggaactaatttttctgcaggcttgatcgaatcagcagtcttttctggttgggacttaacagtctcttttgttgaaacttcacttgtatcctctttctcattatcaatctttaaagaagctagtaaatcggccggatctctctttgtatcactcattccgatctaaggtggtaagtatttttatagatgttcttggttgctgatcgagtattttatggtgtataaaggtcaactggttttaaaggtaatgcaaattttgcaatgctttgcttgattgaaaaatttgcatacgggtaataccgcgttgataataatgtaacaatcaaataatcaagacaacagcagagttattctttaaatacgatatatatgggagtatcatcatatttaaatgttgatttttttgggttttttttttgggcaattttagagcagtaggcttaaaatatattaaaattattaaaggtattacttaatcttaaaggtcgtcgaaatctataatagtacgtgtatcaaacacttttgtaattaatattaatgtcgttaagtggttaaatagtggggtatttcgtttttgcgttgttgtaaaaatttactaggacattccatcaggcttccaatctaaccccaacctttgataaacctgtgtttggcattgaaaccagatggcagccctctcctctgaagttagagaaaccttattaacgacatttttctgtgtaccagcacctaatgtcttagcatcatttttataattttttagttgcaaatttttcattaaagccttttttaaaagactaccagagttagtgcagtcatgtattttaaaaccatgcggtatgaggcttggaggcggcatgtcaggccttttcaaatttgaatttagtaatttccatctcttgtattcggagcgcttttgtttaaagtcatatctgcattgggcctcgacggcaacatttaataaatagttctcaattatatttctccattcaggctttgatagacgcataatgggttcctttgacccagtcatttcttcatgtctttttcttgctgatgcaactgtatattttgcgcttgtcaacttaaaattgcggtctagatttgcttctatgtataagtctgagttaaccaatgtcgctattataaactcatcactggaacttaggggaagtaattgtagtctgaattgcggtaagtttataccggaggtcactaccgtcggtaactgggaaccccattctggccttaattgttccacaattaacaaggatcgtatatcgtttagatcccagtccagcaattcgcgctttgtaaacttaggacgtccgttataaagtatatttgctggatcagacatcagaacttcgggagaatacatatcatagaatgttttgggtaaagcgtcttcaagtgttacttctgtgacgaacttaggtgtttttgtatcaattaacgagctgcctgtggtgatgtccgtaagagcagtagatggctgtgaaaatatactcgattcgtatgaagatgaatggtctgaaacaaaactttgactgtccggggtatttatgtgttggatatttgcattttctgcagtattactgttcacttccataggtttagttcctgcagtaggcaataacctttttatgatttctattcttgccctgtctgcatattctggtggtgtagtaacaaaattgttgttgctcctaacatttcctgaattggaactcaaattatagtgatttggtgtgtttatttcttggttattatgtggaagattgctgttgaatccaatagaaggaacgctatttgtcatttctgtgtcagcgttgggttgaacattctttggattttcgtcatgtcttttcgattttcttttccctaatacttggttcctcgctgttgctggaggtggtgaaacaaacatctcgttttatttgtctgttaagtagtgcaaaacctcctacaatcgcgatggtaacgaaaatgataggtaaatgagagcttctaatatattaaactggtttcctacggtacgatatttcttgaagcctttcttctcctctatttagttcgaaaacgtccctctctcgttaactcaaaagaaaatttactaaactataactctgtcttttaataactcctggaatttttccgttatggaactaagagcagccttcgctaaaagattttccgtgttttcaaaaggaagggaaaaaattggacaaaaacccgcgtacgaaaattttcctgcttagctcagtcggatttattgaaaactttatttcatttttccacaacatcccacattacccgattgtttgttgcaagattttttgaagaggacgcttgcatattggccaaggaggaagtgtaagatgtgctttcgtgacttgagcgaaggggttggcgttgtatagcatgaacttcccaatatgttgcattcatccctggatgataacagaccaaagaccaaatttgattttaagtttaggaacttagaaaaaaaaggtagtgccgtattcgaaactttcgccgtggactgcctctcttttcaaaaaagaagaacagaccatgctttttctcctggatctggaagaaaaaatacacgaagcgtataaatcaaaatagagttcggtctattggcttacaaggatttcgctattttacaagaggacgtatattcatatattcatgcttcagcatgattttctcttaacttaatatgttccattttttgttataaaatattactgttcgtcgtttgtaagagcagacactattatcttaaaagagcttttttttaattgtatgaagattttataaatttgcgaaaacctaaatttaccataaaataaaatgcgcacgagtagttctaacgcctatttgctcttgaattgtcataccgactttgcttgttattccgagagtagctgttgccgctgtactgtccactatttctatttccggaatagttattgttcctgtaatttgaattttgtctgtaattattgtttccaccatcatacctgctattgttgaagccgggttgactgttgtagctattcctaccatagttgtgggcgggttggacattatttctactgagctcagcaaaataaaagaatgctcgatagccaccagttcttggtttgtactgagtaataccctttggtcctactggaacaatattttgcttcaaatcattaccaaagttccagcgacgggagtaattttggttattatacttgtacattatggaatcaaggtcatatgctgttagtaccggttctgacggaatgaacccgttcagtataatagacttatttctcgatggcaacggaattaatctataggacatctttaaaatcaaggtggtagataaatttggcagtgacccaccttgaatcggacatacaattttcccatttaattcgaaaccttcaacgtcctttgatacaataccacttaaaccactcttgaagtgttgaaacttcacaacaacattgttgttgttgttttcctttgagtataatttcttcgaaaacctctcataattagcattcttgttacttattaataaaacaggttctccgcgaatatttcttgccctctcagcatcagaaagtaaaggatattgtgcacgaacagctgttaacagtctatcctgatcgatgaatggtagcaacgctatgccttgccaggacatcttcttaccattcatatctatgggaaattcttcaggataaaaatcaatgatttcagagtcaggttcagacatcaaagaccggaaaatttttggcaaagcatggccagatgcagctggtaaaacactcatcaattgttcgtaaggtaaaaatggagtaccttcttcgaactttatctccaagtgagaaaacccatggaaatctgttgccagaggagcataatggtacggatagaaccaattccaagaggcacaaccttgatagtaatacattagtacccaggcgaccccttcgatatagcattttaccatatcttttcttaactgttcaatatcttgaggagtaacgtgaaatttagctgtgtaatatctttcgtggtaaccaggttcgaatagtttgacaaattcatctgtatcaaagaccccatttttgggaccttcgctgacattcactgtgctgtggactggtgaatctcttgatacttctgtagtttcagagttttccctgtcgtttacgtcagccacaatctcatctttgatctctgcatcgagatcgcactctgattccgctttctctgtcttaacttttttgctatccttagcaatttcttcctcttcattatccttttcaagacggtgtttcttatttattattttctgtttcataacttctgcaaggttaaaattagttttgttagccttactaacagcatcatcaatttcttccttgctgatatctttcatcagttcattgttcttatcactctgttgcttaactttggcgattgcttcttcgttcccctcgttcgcaagcatcagttcctttttcaaccttaccatatcactggtggtcaagttccatgaaccttttgctaaatttccttgtgtgtcatacatttgcagttgctccgtagctactgtaggatgcctgtcttgaccttttgacatatttttctgcgctttccttctttcaaaagcttctttctttctggcttcttgaatatgtctagttttgaagatatccccctcacgggagccaaggtgttgcaatagcgtttcaacagaagggaggttcaagacaccgtcgcaggtcatgtacgttttcaatttcggtagtactaccttccaaatatccaagagaatatcaatactattttctctgacatctaagcatggtaaatgtggtaaaaagtcattaccacagaaaaagcacatgaaaacccaatcgtcgatagccctttctaaatcaaatgtaaatggaagacccggaacccataactcagcggacaagtattccctcaaaacatttatgtgcagccacaagaaaggttgttcggaattttgtttttggagaaattgtttttcttcttcagtcatatttatagtatcttttaagttatttcttttccgattgtcttgagcaaaaacatcttctcttagaattttaaaatgtggttcatgagtggcaaggcccaaaaaaattaaatcagcatccaaaccgtatatacagtgcgttgtgttgggattatattcaggatcagctctttgagacctaatgaaattcattattttgtgctcaccttcacctgggacggtggcgtcactgataatcacctgcaggtttttccaaccagggtcagtggccagtttaaatgctgtccaataacggagggccgcggcaagcttatccataaatggggtgcctggagtgatcgcatttgaatcccaagttttcttgttcctgacggcatcatcgattatctcaccaacttcttctcgctgtctcataatttcttccctggcttcgttttcaatctgagcatccctagcactcctaaatctacgcgctctctgctggttcattttggcacgaggagcaacaccatcaacagccataacaagtaccttgcgtggtctagccatatttaacacacgattggtatattcaaaaactgccaaaagcatttcatcttcagtctctggaggcggtttgttttctgggtgcgaacatggatgaacaataccattcatatccaaatacaagttgtctaactcaccgtttggatttgaggcggaataatccaacggcaatatgacaccgtcgactatctgaggttgctcttccaatactggggatatgatctttggatattttcgagatagccatctgaaaaatgacggaacacccattatattacgaaacttggctgtagcacttccttgaagaacctgtctcactaattattacgggatgtctttatgttgtaataggttcatcgatgaggtttggttttttattgccatagctgaaaatcttatctagatactctcgttacccgacttatcattcccgagacgctcaaatatacaacctgatgagaaagtaaggtaatatacctccaaatgttcaagattataaaatacattgcagtgccttaaaaacgtacttccgatattatgtgatagtaaacttttcgtagtttttcatcagagatggggaaagcttttttggtgaattgattttacaactacttgtttcagtatactataaaaatcgagtaaaattcgtgaatctttgaatagaaaagatttcgtgaacatatctataaattaatcactttcttaaccgatataagattttagcccggtgatataggcttcaatcagcagttacgcttttttgctttaattttactgtttatggaggtaaactaacgctcctgctctctttcatatatcaacagataggtctgttgattgattcaaataaatttattttccttatgtgcgccataattatatgaccctataagctgccgatagcggattttctgttctctatgggaaactctgtagttttcttttttttagtttagttcgttcccaaaaatggaagaacgtcaaaacagtgatctacattaagctgaggcgaaaacactaaacgaggaaagttatacgatggcacaggaacaaaatagaaagtatgtatgacgttgaaggctgattaaagcattgaaaggggaaaaatacttgtgaactaaaaaatgtacatattacgatgtcgaaatataaggaagtaaaaatgctgtccggttcttttgaataggagaaaaaataaacagaacatagtcgggaacttcgagaaaaaaagtaagaattgaaaaatgcatatgaacgatcagattgacattcaaattctacgtatcactaaagtttagccttctttttagaggaaaacaagttagctattttggacatgaattgtttgaaggtgctaatcgggtatttcatgcttgcttggaattcctccttttcaatatcaaattgttttgaatccgaagtatctaagatatcttcaacatcgtcagtatgtggtaaagtttcaggatcaacatggcccggtgtgattggaatcgaggtgcttctacctttaaacgcaaatccagggtggaagatggtcaaagtgaccgtagcgatggccatcattaatgcatctaagataataaaataccactcgtgtgtgatcagatagccatcccaaccgacaactaattcagccaaacggtaacaacaacgggtaaaaatggttagtaccgcaacggttattgccagattaaaataatgaaaaacccaacgtttaggttcgagtctcaaaaaatggaacttttccctgtataaataatcaacttctgtttgcgatatctttaagaggctcaatgagataggtctagaatttatgtgttcccatcttaccgatatatatatacggaaaaggaagtgaaaccataacataagaaagatggccatcgatgcaacttgaatggccaaaccagcaatgaaaacatgattgccggttgttgtggacgttccatctgtgaccgccacaccacacaggccaccgcctacagcttgcaccacaagcgatacgatatcggaacatatgaaaataaaagaatacgccattggagagggcaataaagagaacctgtggccgtatacttctataagctttgcaagttgataataaataccacccattgtgaaaactggtgcaatagtcaaacaaatcatgttcaaaagaaaagcgtccatatcggcgacattagaatgcgaccacgtcctccctataaatccaagaacttccaaaatacctgtgcatataaaagcgattgaaaaccagtattggcgcatcagtaactgtacgacatgtattgtcagtagtataccccaaatgacaatcatcgtgatattaaaacgaaggttcggtaccataccaccataaagggaatttactgttagctgctgcttctaactgtggcaaaagactgcctaacgtattatttgttgcgttggacattttgaatttctcaacgtctataatcagaaaaaaagtactgtgagaaatctattttagaacaaccagcagtaattagttacgcccttagtatactattgcttgaactgctaggaaaccagagtttacgtagaaaagtaatgaattttaagtctactactgaaagaaaaaaaaaaaatactttactgtgcaagcgacaaggaaaactcttcttatttctattgattctggggtcgactgcaaataataaaccttatatagtgttttgcccatcagctcaactgttttaggtgaaaatgggaggcacaccaaagaaaaataaacagggcaaattagagctccgtgggtacaaccgatcagaatcacacctattcccttttagagagcgagatagcgagaaaaagtcaagagcttttcgacatttgcggaaaaattacgggggatgcttacgtacagctagggggcgacagaaccctcaaggcatggccgtgcagcactcgcacaggacttggtgcaagaagttcggttactaatgagaatgtcaactatcggagctgccacaactactaggcaacgtcgttttccagtggtccctgacatatcaattgccgcactgtcactgtgcgcaaatataataggaaacagaggaccgacggagaccatatctttccgcggaaaaagagtccgagcgaagtccggaaggaaatatgacggagcaagaatgcttccgcggatgtaaaagattgtgctatgctctggattgccctctcggagagttttgttggtttgtttcactgaagccattgataataaactctttattgggtgatgacgaggctgagcaccaaaaaacctaaaaggaaaccaaaagtttaactcattaaataagttgtgactatatttcaacacgcgctctaataaatatagcctttcttttagcttttctataaaactagataaaaatagtaatttttgagagtacttaaggcaacagaaggagtgagtaaaaataaaaaagaagcgtggatgcgctcagccttgtaagaaattgtccaggacatcttgaaatttaccatgagaagccttgtttgctttgcctaagatttcttcggcggttttgtaagcttcttcttgttcagcactttcattgtcaagcaggttacctaggtcaatatatgcttcggcgacttgaacccaggtgtccggatcatcctccagtttagccttttccaagtattctaaagccttttttgtgtgcttcaaagcggtttcttgggcgttcttggcttccttgtcgctaaccttttcagaaccgccatcatcgtactgtaggcttaagaaaactttacttggttcttcagctttttttaggtatagttcccctagggtgttagctattgatgcatagattttcacatctgtatttgtgttgtcaagcaatttatcaaaatggtttcttagccactcgtaattcgcttctagcgattgttgtaggggatatacagggtgttctggttccaactcaatatcaatgagttcctcttcctcttcattatcgctatctatgccctcttgaatagattgttcgcgaccaaaattctcgacgatgtccaataagtcattcaccatttgtaggatttcaaaagtaaattcagtatcgttttcataaattgaaaaatgcttcttaccatgttcaagctgtcctacaagatcaagttttttatccttcgatttcaaatggagattggaaatatattccaacggaatcctttggaaaattatctttgctaaaactagttttagaaattgggattcagggaaatgcgaaagacctaattcgactctttcgatagcactttcaaaaaatgaggatacatctttttttctcttttcttcagtggcttcctcatcgcctgccttgaaaatagtcaattcagataaagccagagcatatataccatggaaaatatcgttcagcgtcttcttaatctctttatcttcttcagaaagacgcaataatctgtcacattcgtgaacgattccatttaaaacatattcgtcgtctctgtcagagtgaaaatatttagaccacagtcctttcagctgagctaattcgtcatctaaatcagcatcatcgtcaagctcaacactcatttgacttctcacaggtgtggattctctggaaggttcatcgctcttcttttcgacactttccacctttcttttcttttctctactttgtttacctaaacctaagggtcttttagccatttctgtacgattactttcttggactgttctccttttttcttcaattctttttcttttgggtgcctacaattgttctattatttaaaaactagtttatattgaaatttttcaaaatatgcaacatttcaaatgacgaaaaaaagagttctttttctcgcacttttttttttacctctttcggtcgcaaaacgatatatgcggaaaattgtttttccgctacaacctcatgaaatggaaaaagaaatggtgaagttactccagctttcatttgtttatatttcgattgccttaacgcttaaaaatgaattgtaaacataaaaaaaaagtcgttttctccctttcttccccgtacaaaaaaagaaacgaaaaaccaaagaccaaccaacagattaggttcttgcgtaaggcgtttcaaaggttaagcaccacttcttgattattaatattattagttatacgttatataagagtaagtggttacaatgaacggtctctcttgatgagtcaggatagatgaagaaaaaaaaaaaaaaaacgaagagaccattcaagtaatttatacatgttattttgtagagaaatgcatcaaaagcgttcttttcccttgtgtaacatcaatgccgattagacgttacaatgcagttcccagtgaattagatgtgtgtatgatttaaccatgataggtgtttaaatttgtatctttggagccttagtttgttcagcttctagcttatcagcgtttctttgatgtagctgttctttgcagctcgttaagccattacaagcatggttttccattaatctgtgtttcgagcaaaagtgacctttgcaaaaattacagtcaccgatgaatttcgaagccgcacttgaacaggtatcgaaataacaagcattcttctttttcttcttggtcgttttcttagtcacccgcctactgctctgacccgtcgatgtcacgctagagttactagaagaccttgaattcaacggtatagcacccaggacggtcccggaatctgatttctttatcttagcgtggtatgtgcttttatcctcgatctcatgcatgggatccttgggagtaacttgtctaatttcatcctttctggatggaatttcgatttcgtttatatcagacatttttagtttctattcttttggtgattttgatagttttgtgcttcacttgatgtaaatgaatcagtaaagcagaataaatagcggtttagcggataggctgcttgatccttttatccaagatgtatgatagagtcaggaactcttcaagcgggaaaggcgagaatatctcttatgcaaagtctaagacttcggtggcaagtatttcccttttatatcttctttgcttctgggccgatgcagtctttgccaccgcccccttctttctttttttccctgacagggccgaagctcgcagaaaacagaaaggtgaaacgaaccgcagagctgtggagcatttgatctcacccgctttgcgataagctggcaaggttaaatcggatttgaaccactccctttccctcagaatgaacatccgatagagtgacgacgcacctccgcagcatcgtaagcgctaactatgagacataaaactccctttggaaaatgagttaagtgtcctacttgcctatttttagccttctcttctggttatcagtgattaatgcaaatttattctatgtaaagatatatatagttcaaaagttttacaataatgaaattagtcctatttaagatcgctgtagccctcctttatcttctttcttttttccttcatcgtcttcatcttcgtcttcgtcatcttcatcgtcgtcgtcgtcgtcgtcatcatcgtcgtcatcatcgtcgtcatcatcatcatcgtcgtcgtcgtcgtcgtcgtcgtcgtcgtcgtcgtcgtcatcatcgtcatcatcatcatcgtcatcgtcgtcgtcgtcattatcttcatctttaccaccagtatcgttcttcttattatcatcctcctcatcgttatcttcatcctcttcttcttcctttcccgcagaaacatcgggataaccacctagtttgacgactatcttgccaacaatctcatttgcatccatcatcccacttaacccgatgtcaccgtttatgcccatgactttttctgagggtttaaatacagttacccaaggcatctcttcttgaataattcgaaaatgttttttagtcattatggaattgaacgtaccgctacccattgaaggcgctaggaatatgggaaacgttggattccatgcccttattacacttgtcaaaaggttgtcacataaaccaagggcaatcttggccaacgtgtttgcggttaatggtgcgacaactagtatatctgcccaacgacgtagttctatgtgtaatacaggatcagttcgttgtcgccatacatcccactcgtcttggtctgtccaaaattgtatatgtgctggcagttcaatttgaggatgttgcgatacaacgtttgaagagttgctgtacgtacgactaccaccaagtgtcgaaggaaatccagtagtagaggccatttgtttttcttcctcctgtttattatttgtctgagaagccgctgagtttgaagacgtcttctgaatgctaaatttttcaagagaggctacttttttcttgttaccagttatattgccagcattagaattggtgctgttgaaagaagtatcgatactattgtgttgtttcttatttttcctcatatacttcattgcaaaaaatttggttgctgagttagttagtataacttgtatgcatattttgtcccttccgtaaatttcttctaattttctgatcatgtgcttgagtttgaaaacagacaaagaacctgttgccccaaaaagaacgtgtagcttgccgtcatcttggggaagccttggatccatattggtcataatattttctctcttcaagggatttgagactgcattgggagacattgcttcttccaagacagactccaacaatgtgggctctccagtctttgatatggagccctctcgttcaatgttgatggggttaaatgtattcactaccacagaggggcgaggactagtactgttagaccttgatctaactgatggggtgtgtaaaggatcttccacgtagaaatgtgggtgctcctttctggggctatcggaactattgtcagagtttaaaatagaatctgttccaccggtgaaacttagctttttagccagcaggctggatatgttattccccatatcagcattggagagaatagaggttggagtcgaaaaagaagaagcagaagcctcgccatcttttggtacttttgtatttatgtctttcaagtttcttccttgatttgcaccctccgctgcgatgtgtacagacgttgctttcttttcgctggactgtctggccacctggttaggtggagtttgctccacatccgacctgagactacccaactttggatcgctgaatgtaacagttggtatcctttttaaccctggctctggtgtattacttacaactgccccagaagttccgctagcattcatgattgacttagtttgtgaaccagtgggactagttgatttccttactacaggagtgtccagactagaaacggaagaaaatggtcccgtagaatttgtgtcaggcattgccgatgaacctatattggcctgctcagctccagagagagtattcgaagcaacccctttcctattgttcttcaggctagatttgtttgtcattgcgtctctgcactataattatggccagtattcctctttctggtctcttctttgaactaaagtaatcttataaaaggctatcctttttttggcaatctagtattaatcctgatcaaaaagtcctcaaaacgagccctcttcaaagtgctgtaacaccattcatctcataaggggagggcatactgagcaataaaacgttttcttaccttttcggtcttttggactctccaaccagaaagttaaagggcaaaaaagctcacatgacacgcttgttttggaaaacgtcatagaaaaaccacgtgaaaaaaaaaaaaaaaaaaaaaaaaaaaagaaaaagaaaaagggcagctgccaactagtacacactacacagatatttatgaaaaacactaacttctccttttggaactgttgacgtaccttcccttaccaatgcggacgttatgctgcttcaacccagtaattgcaaatggagaaatatagttatccgcagaaccgccaccaatccaattgtttagaatcttctcgttgtgtcttcttgtccattcttcttgctttatcaccttttcgtactccttttgatcttctctgagaatcacattttcctgtggtttagaatgtacgtgtccctttttgccgtaccttttttgggagttcttagataaggggctggctacagaatatctgtttcctctattgttccattggaagttcgacttcaagtgcggtgtaacgttccccgtgcgtgagtcaacggaaactgcgcatcttaataaggtaccctgtccaccgcatgaggcacagaagtgctttggcttgccgtcttttggtagaggaaatattttgaaacaggcgtggcatcttagcatataattacggattcgcttgattttcagacctgacatgaaattcattagatttagattcatctgcaacgctacattttggacggcaaaatcgccagtcgccaatgccacctgattctctggtcgattcaatgcgacatggcgatcctcttcggacgcttctacacccaatgaaccagtggtatcttcaccactatccttaataattgcttctgttaagttctcgggggtaatccaatcaccatcatcatcagcatcctcgaatacttcatttaaatcggaagattcctttatattttcatcattacatatctgctctttggatccagcctcctcaacatgttcctcagctttactctctagctcaaggtttgcattttcagcttctcttgcttctcttgcttctctttttgccttttgcttttttccacctcttctcttgttctttttttttggaacactttcagagtcctcctcctttttattatcttctgtgagcttctgtttgccgtccgtaccaacgtcagccttggacgcatctaatgcatcacctggttttttcctcagtctccaatcgccattatttagtttaatttctaactcgtatgtcaaagcaagaatatgcaaatcattggcactcagtacggagtagtcaccggtcaatttggcgaacgtacttactttggctatcgagttttcacttggatgtactaatttcaaagttccgaggctctgccaaatttcaaggtttttccttgcttgagcatccttaatttcttgaaaaactgtgggagtagtataaaaagactgtgcataattctggtaatgtgtgtaggactgcgtaattaatggggtggcatccaatatcaacgcccttacatgtgcggtttggttttcggtcatattatgctcctttaaagaaactttagaaaaatactgaactatgatcgccgatgagatttatctagcgctgactgaacgacctctatgttaagaacatacttgagataatggtgctgtttctccatgtagacttcttcttagcaggtaaaaatttgccaatgcaaaacaaagctcatcgaaaaattttgatcttgcattatggaatgtccgggtttttctattgagacattcaaattttgaattcttcttcaatagaaccaggctcagcacagatacaagagaaatgatagtagataataccgccatagtgcttatgcatcatctgctaattcttttaagaatgatcttctcagtcttacactgacgagcactatattgatgactttgatcactataaacgaagccaatataagcactttagggtgtaaggtctcaagatgagttgatcatatgcgatatatctttgaacgctaataattgaacgaaagcactatgacaaagtaatggcagaagtcttttaaggttaaagaggtagttgttttaaggaaacgaaaaagaaatgcctgttgaaaaagatttaaaaactgcctacaaagctttgtatgatgagaaggaaccactgaaggccctccatctttatgatgaaattctcaaaggctcacccacaaatttaacggctctcatttttaaggcagcatgtcttgaaaagctatactttgggttttctgattggcacagcgatgcaactatggaaaacgcaaaggaacttcttgacaaggctctaatgacagctgagggtaggggcgatagatcgaagattggtcttgttaactttcgttattttgttcatttcttcaatatcaaagattatgaactggcccaatcttattttaaaaaagccaagaatcttggttacgttgatgacactttgcctttatgggaagatcgtctggagacaaaattgaataaaaaaaataaaaagcagaaggattcaactaataagcatacaattaaaccagtggaaagtattgaaaacagaggagataataattcttctcatagtcccatttcacctctcaaaattgaaaccgctcctcaagaatcccctaaatttaaaatcgattggtatcaatccagcacctctgtcactatatcattatttactgttaatcttcctgagtctaaggaacaagtcaatatatatatttctccaaacgatagaagaactttatcgatatcgtaccaagtaccgaaatctggatctgaatttcaatacaacgctaagctttcgcatgaggtggatccaaaagcagtgtcattaaaaattttcccaaaaaagctggaaattaccttgagcaaaattgatagcacgcaatggaagaagttggaagaagatattttaacggaatcctcaaggttatcagatgagggtaaaaattctgattctgcaacccgcttattatcagcagaaacggcatcaaaagagagattgtcttatccatcgtcctctaaaaaaaaaatagattggtctaaacttgacattgatgaagaagctgatgaagaagcgggatcggctgatagtttctttcaaaagctttacgctggagcggatccagataccaaaagggctatgatgaaatcctttatagaaagtaatggtactgcattgagtacagactgggaagacgtatctaagggaacggttaaaacttcaccaccagaaggcatggaacctaaacattggtaaatgattagtatatacctacacaattacaatatgtagatatatagtatggtagtaatgttacattttcgatttagactagccaacctgcgtatttacttggaatgcttacatgattatattgaatattacaaattttattatgtccatattaatccagagtcacggtgcaatggaaaaaggaaagggagaatgatagaataaaagaaggaaagaaagagacaatgtagcgaaggctagaaagtgatgtgaaaaaaaaaaccacaaaaaaaataaataagagatcagagggttaaatgaatgcgcttttaagaaattcaaatatctgtaaaggagaatccattcaatttcgaaacttgctcatttttccatgtaataaaatccttatcattttcatcttccatcatactggtatcatcaaatccgctttcaatatctttttgttgaatgtttaattgaaatttaccttctggcgacatggaaagtttatatatgctgtgctcaggttctttataaggactgctcaatttttgtgcgtaatcttctaatgagcttttgcgttccgggcttcgtacattctccttacccgtggtgccagtcgaccttttaagaagttctaaagccttttctttagttaattgagggatatgactacccttagtgtcgactttgttcagcgggataggaaacaattggcgtggttttactgcatgttcgccatgcgtatgatttatcctaggcgatgatgaaagatcggatgatctgtttctgtttaaggtaggtctctctatattccctttggaattcctagatattactgtgggtgctagtaatcttgttgctcttctgttcggactagataacttcgttgttccttgcatatgacgagcaagcgagttctcttgggatagatcattctttgttaagccttgtattgttttctttgaaggcgttttataagtaatgttggcatcatttaaattcaaaccaatcggtaccctgatggaactttctgtggccttgaaagtgttttttatgactttattctctttgttcgcaccacattttccctttttagatctctgcattctaactctacatcttggatattttgcttcgatttcctgttgctgaatgtcaattgcttctgaaagtggcttacctttgaacaaaaaaggttgatcaaatagaccatcggcctcttctaatttaattcttaaatcattgatgactcgaggaaagtgtcttgttatccttttcctcattttttcttcagttagtaatatcttatgagaatttctagacaaaagccgtgaagagtcttttgaacttctttccaaaaattcttgatcttcttgtaaagattcaaaatctgatattaattttaaaattggcttataaagggtcagtttttcttctagtctttttagctcattttcgcaagtttctagaagaagctcatcttcctgtaaagttgttgcactgttccttagttcttcaaatacaatgatgaatttagaccgactttcttctgaatactgtaacgtacgccacaattcctgaattttgtcccaggaatctgatataagtttttttattagtttttttttcattgcttcaagtcgcataacttctttagagattctacctaaggactcggttgataaacttgaattgttacgcataaaagtctttatgtattcttgagaaatttttagccttgtccaaagtttttggcattgttccatcaggagcctctttttgtctgctctttccttatggatagcttgcagtttttccaatgtaatatcaattttagacattctttctctgtctaccgggtggaaatttggtatttctgatgtggagttttcctcttctccatatgatcttagatcttgttcaaaatcttcaccgattaacgttgctaggggagttccaagttgttcacatattgatgaaatactaaccttttttgtgagtacgcttttaaacctcctctcgtattcttcctcgtaaatttttatgacttcattcatgtgtttcacagattcttcgttaatagttttaaatgccgatccctttaaaatatcttttctattatctataataaatttcatggacaaaccaatatcgcctttaccattttctatttgtaacaaatatgcggttaatgtgcttaattctggaaactcggcgatagcctcgttatctgcttctgtcaatccaggaaggttttcttttacagattgtatgaggtgttttagagtgattaaggattttaaatagtcgcggagcctgggtaaaaaacttcctaggacaaatttttttgctgtatctaatgctgcttttttgcttagtaaggaaagtggctttttcggtgactgtggcacagttttactttcttgcagtagaatagcatttctaatgtataagtcaggaatagtctttatgccacttgggtcatttattctctctagaatgttatttagaatatcctgttcaattccgttctctgcggacagtcttttcaattcttcgtcagcttgctcaaaaaattgttttatggaattagatatagtggtgaatatgattttctccttggtgataatttccgtattagaatacccaatattttgatatatgacattgagattctccagtaatttctctagatcctttgaaataagaatgaaattttctctatacatattatccattgtgttacctttaccattttctgagtctaaaaaatggtaattagtggacacgtttttcaaaggagaaccaaaatctctaatacgaactggggtcaacttcataaactctttagaatttgattgatttaccatggtcgacacagtcaacggtgttgctaaagaagggttcatatgcggtataactgtagtagacccagaattttcgctgtttctcctcgatttaatgggcaaaggggaagaagttgctgtctccatttcaacatcaaaagtagtgaatccaaaatgaaacctttgaattctaatgccagaatgctatatctgatgattaaaaatagcctattaaaatgctctaattagtccttaaaataattattctcggtaatagccgtttgttcgtatctttgctattgttctgtgaaaaaaccaggtattcgactttaataatatttttgtatttgtttcctcttaaagattctcaagcttatttaccttttacctcattgggaaatattagatgacgaaagaaaatcacactgtacgattttctgggcggttatttagtgaaattaaataataacgtagatatggcagacagacttattgtttataggcagttctttacaattgtaactataaaaagtggctatactaggaaagaaagtttttaaagatgatttgttttttctatcttaaatctcatatatttatttttattcacttctgagaaatacaagttgcatgtctcaaaacttttacttttcaacaaaatattaatcaaaaaaaataaatgaaaaaagaagaccatattgaagaacatttaaaatcctttgtttgaaatagagatcaaatatcttgtattagctggttttaaatcagtagtatattgctatgtatggtttgataagatgatacagattgttagacgaaattattatcataatgttatctatattatggaatgccaacaatcatcagcaaatacgtaaatatgacaatggaaatgaacaaagaaaagaagaagagaaaaatataatactatgtagaattgtcgagctccaaaggatattctatcttgttatccgtaacataatcagcagggcgatctgtgcacttgttatgaacatatgacatttttatttattcccttcgtgttattgtactcgtgttttttataaattttccttcctcgtagatggcttgaataccaagtaatatttcttctaccacagtattactggcgtaagcaactgaattctccgaaaagttttttagataaactgccaagttagtctgtcattacctttatatcgtcttcctttaatctgtaggtcagagtgttcactgcttcaaataaatctgcagatattcttccattatattcaaggttcaatattcttcatgctttatagagaacagtttgaaaattgctgcaattgatttctaaagttttcttgaaccaaattggcaacaaatgaaacggaacaaacgtttgaaatgttttgtacaaatatgaatgctcttcgtacgatagtggtcgcagaattcaccctgttcattagaatgaatgttgcctgtgggttggaatttttcaaaacttgatgtagaatttagtccaagtagaagtattcttcccccacagaatgtgtggcggtgaaaaattgcgagacgtgattggtgtatcaaaaaacatacgagattgttgggttagtatactgtttcaactacgtgaagggcttctcaatggtgatatatactataaaattgttggttgagtatctgattgaaaatacatcgacgacattatagtcgggcgtcctaaaaatgaccaactagatggcttggcttgattcggagtgattatatcgctataagtacggtccattctgtgacgacagtaattgagcagatacgatgatgatgattctctggagcagctgataaaacaggtgtattatccgttgaaagttggcgttgctggaaaccttatcatatgaggtttgcaaattggaaacgtgtgacgaatttgatttgtgtacgcttccctagaagtaaccaaatcataggctctaccatgaggtaatgaatgattattattgggcttctaccgttgctaaaggctataatattagatacacaaaatatatgaaagttcccctcgagaattgaaatccaccaaaagagtatccatatctctttctaataatattgatattcttcttctgttctttatgataatagtcattatattattacattatatatccttgcaatccagctcccattaaatctgatgactgtttctcatctttagggttatctttttacgccgcatatgatactatattaataatatgaatgctagtcgataaataatacttgattcctattccaacatactctatccaaaattatttcctttataaaaattatacctcaacatttatcaaatagtttagcaatgtatccttttcggtagttaattactttaaataacctaagttaaatacccactatctatagaaatctttatttaggacgctccgaagaactcatccttgttagctcagttggtagagcgttcggcttttaagcgcatttgcttaagcaaggataccgaaatgtcaggggttcgagccccctatgaggagttctttatttttgtcagtaactattcgggtaccatcctcttcttttctttttcccccactataaaacgagtctatcaattcccttcaagcattagtggtagtaatacattttaatcacatgagagtgttcattcaaaaatatatactatttcgtgtaaatcaagtgctcaattactcttgtgcatcaagtatgctagtaattgggccgtaaattcgatacaagcaatcccagtagcagctgtattctcgtccattcctctacgtgccacaatcacgccatgcgcatttacagcctttatgtatattggaactctaatccatttcaatttgtttagatttctcaaaataacctttcggttttcatcaaaaggcagttttttaaatttagatttccaaacaccatcatttatagttgtgtatttttggataaattccttccaaggaagctcttcttcgtttacaagattactattacttgcttcatagttcgcatccatatctaaagccgaatttatgatggacccgtatgcatctgtaacatagcctttcagttgctccgtcaatcctaattttcctctgacctcattgtgaagaatgccattagagagcattttgcggtacttgcaagtaacaatataactataagcggttcccaggccattcataaccagggctattgggagaattaagaatgttgcaactagtataataagaatagtgcgtccccactttttataagtcttggtcggtttagtaggagcatggctgttaacgtttaaagcgtttaggtcgacaatcttaggcaatattcctttatagccagatcccggaatcttttcttcgaatgtatatttcaatttgttgtcaaaatctataaatgggtcgcaatccgtaataaacgccgtatagaaggctaccgtacggtcatttttgacattcgcaaacgctatcctccatttaaatagcgagagtgcttcaaggtactcaccctggctcaatttcaccaatatattgttactagaatttgcgataaacatttctctcccgcttttacctaaaatagtagatcccaaggtcctcagcgcactatataacgcacttttatatgctatgcccgtaggattgtaaaactctacccccaaatgaggcgttgccattgtaatgaataattgtggttcaatatcctcgaacagttctttaaattcggtcaacatcttaccgatcataaatcgggccactaatccgccttgcgaatatcccattacgcttagtttggtgattttcccgtctttataatctcggataaattcacaaacttcaatcaatgtcctgtacccaatgatttcgataccatcaaacgtcttaaacatggcattctgctttggtaaaaaatatatcatatcatcgttaacatcttccttttttaatgtagtggataaaattgtcctcatagattccatatgagtatagttaccccatagcccgtgaatcagcacaaaaaggtgtttatccgaagtcatctgaagcgctgtataatatatatggttgatcacacgaagttttctaccgattattgcagtaaagagttgccaccctttctttattatctttgtttttcattttgatcttatatactgaaaatccccgttgatcatgatttggtaaagagcttcagaagagtttccacagtttcctgcaatgattcaaacgaaacctcttcaccagatcccatcgaaatgcgttttaattcatccctgtgcgtaaattcagctgcatcaaacgttatcttgtataacttttgatagtctgtaatagaattagaaatacctcgaagtcggaggccacccaaaattagcttggacaaagtttcattgaattgaagccgtttgtcattaatatgcacgttgcgatacacttccgttttcgttccgatcttcctttgttgagattgttgtattattatatcaatactaccttcctttgatacggaggcccttgtctttccaatatcttgcttcaatttggtgacctggccatcaaactcatgcttcattgttagatccacttgaaagcagtttaactctgtgttctctcgaaatataatcaagtatgctggctcctgcgatcgctgatcgaccttgtcaaacaattcaatgacaatgccacgattcgcgttccttagttttgatttgaagtaagcctgtgcggttgcactggtactataacatctatatgtattcatatttgtggagcggacccacaaaggcagttttgcgagatctacatactgaatgaattgtcccctcaactctgaagttgatttacttgctgtaggtcgattgctccaaagttggatatccctaatgaccaaacttccctgctttccgctaagagtaaaatttagtgtgcataatttccgtgacatcaaaagtcaggcgaattggtgaatgctgtcccctttcaaggcagtctatcatttcttagttacctgccaacaggcctttatcaggcctcaaagaaaaaaatttccttgcgtagcccgcttttcgcccgaacctggcaaagcaaacagacgatcgaaaaatttccaacgatcttatctaggtggaagttataaaaagaagaataaagcatcgtcaacctttttaacctgaattgggaaacaacgggcacacacatttgttggagtttgtatgattgctaaaaaataaaaagtaattaaaaaaacatcatagagttgtaaggtctcagggaaatagaaggaacaataaacctaaaagaatagaagaaacagaatgccattacctccgtcaacattgaaccagaaatctaatagagtctactctgtagctagggtgtacaagaatgcctgcgaggagagaccacaagaatactgggactacgaacaaggggtgaccatcgattggggaaagatttccaattacgaaattatcaacaaaattggaagagggaaatattccgaagtgttcagcggtagatgtattgtaaacaaccagaagtgtgttattaaagttttaaaaccagttaaaatgaaaaaaatttatagagagttgaaaattctgaccaatctaacaggcggccccaatgttgttggcctttatgatatagtacaagacgctgactccaaaatacctgctttgatctttgaggaaatcaaaaatgttgatttcagaactttatatcctacattcaaacttcctgacatccagtattatttcacgcaattattgattgcgttagactactgtcactccatgggcataatgcacagagacgtaaagcctcagaatgtcatgattgatcctacggaacgtaaactaaggctgatcgattggggcctggcggagttctaccatccaggtgtagattacaacgttcgtgtcgcttcgcgttaccacaagggaccagaacttttagtaaacttgaaccaatatgactactccctagacttatggtcagtaggatgcatgctagcagctattgtcttcaaaaaagaaccttttttcaaagggtcgtctaatccagatcaactggtaaagattgccacagtactaggaaccaaggaactgttaggctatttgggtaagtacgggttgcacttaccatctgaatacgacaacattatgagagactttacaaaaaaatcgtggacacactttataacctccgagaccaaattagctgttcctgaagtggttgatttaatcgacaatttattaaggtatgaccatcaagaaagattaacagcaaaggaggctatggatcataagtttttcaaaacgaagtttgaataattggacaacaatactcttagcaaggcaattctttttccaccactgatttccatttataaaaagcaggggttttccttttttgtagcttgatattagagaatatccttaatgtgaatattaaattgcaaactctatttaacaacgaatgtagattattatatgaccagaaaatcactttatatagatataagagccttccgtaatgctatgcaagttttgatgaattattatattgtcgtgaggcgtgttccgaggagtttcgtcgccattgggatagagatgctcgtaatcgtacgtgtctggaagtgcctgccgacggtagcgatgtctactctcgtcccagacaatggaatagttttggaattgttctacatcatttattagaacacatgattcacgaaatctcccacgtttgtcaatatctcgcctacgaacagtgtcatcgaatgatattgaacgctgagagagccatttaccttttgagtaaaatacgctgccttttttcagcaatgaagaagcacttccctcctttcttacatccaataattgcttcccttgttcctttatattccccataggaaagtccgttggagtaggttgctctctttcatgtattccaaccagatcaggtccgtaaagaacagtaacgtctatttctttattccagtttatgcttagtggatcaattttgtattcatctaaattgaagtgctttatggaccacctcctccatatacaatgatacaacctagccatatatatgctatagtcaaactcattttcagaagagcaactgggtaaccttaataatttatgcttgcgcattttcagcaacaagcgccaggtagtggacacgtccaagctatcatagttaaatttgaaatgaaaataatctatggcggggcgaatatagttggtggcgttgtctaatagtgctatatttttttttgtcagcacactgtcatctaaactagtcattttcactaacaaggtagtatatgttagagtcttggagattttcgacctgttcagactggccaaaagagtgctaatatgaaaatgttccctcttataatatataacatctgtgacaaaaatctattcttccacctatcgcctgcataacatgaggcctttcctgcgggatagcttttgcttcaggttcttctgaggttctgaaaatcaatatatttttccgacaatttctcactatgcctctatcccccttaaaaagaaacactttctaccctcttttctaaactctgcacactagaccgagacagcaaatcggagcccgagagaaaatccggaggacggaaaaactagaagtaatcttatgcggggagcatgcaccagaacgcccagaaaacgtgaatgacactacatactttgatacggatgttggtatttttccggctttttctattttatcgatgccgtgtctgctgccattacgtacaggtaggcaaaggcaaacaagaatagcactttttcacttgctgcttttttttgtgaatgaagtttatcgtatattctgttagtgccgctcgtatcagccacttacgttatcattctaaagtaagtatacgaaatgtgcaaaccttagtagacgttcaagaattgctcgataattgcgaacaaaccagctgctaagccgggaagttaagtcctcaacacagaaatgatgcaaacaatttattaaattcagtggtaatgcaacagcaagaggaaaggtggagggattaacgcatttcagacagctttatagggggaaagaaagcactcgcaaacttgctgcctgttcgcagtcattggttgcaaaaactaaactctactcacgcacactggaatgaatggcaatattcttttttaggttaaccggccggacagtaatatagtaatcgttttgtacgtttttcaagaagcgacgcacaactgttttccattttttttttttttttttcagtgatcatcgtccatgaaaaaaatttttcatttgtctctttcgtgcttcctggatatataaaatacgatttatttagttgtctttgtcaatcctcatctttctttactcattatttcatttcggttttgtcatctctagaacaacacagttactacaacaatcaatcatgtctcacagaaagtacgaagcaccacgtcacggtcatttaggtttcttgccaagaaagagagctgcctccatcagagctagagttaaggcttttccaaaggatgacagatccaagccagttgctctaacttccttcttgggttacaaggctggtatgaccaccattgtcagagatttggacagaccaggttctaagttccacaagcgtgaagttgtcgaagctgtcaccgttgttgacactccaccagttgtcgttgttggtgttgtcggttacgtcgaaaccccaagaggtttgagatctttgaccaccgtctgggctgaacatttgtctgacgaagtcaagagaagattctacaagaactggtacaagtctaagaagaaggctttcaccaaatactctgccaagtacgctcaagatggtgctggtattgaaagagaattggctagaatcaagaagtacgcttccgtcgtcagagttttggtccacactcaaatcagaaagactccattggctcaaaagaaggctcatttggctgaaatccaattgaacggtggttccatctctgaaaaggttgactgggctcgtgaacatttcgaaaagactgttgctgtcgacagcgtttttgaacaaaacgaaatgattgacgctattgctgtcaccaagggtcacggtttcgaaggtgttacccacagatggggtactaagaaattgccaagaaagactcacagaggtctaagaaaggttgcttgtattggtgcttggcatccagcccacgttatgtggagtgttgccagagctggtcaaagaggttaccattccagaacctccattaaccacaagatttacagagtcggtaagggtgatgatgaagctaacggtgctaccagcttcgacagaaccaagaagactattaccccaatgggtggtttcgtccactacggtgaaattaagaacgacttcatcatggttaaaggttgtatcccaggtaacagaaagagaattgttactttgagaaagtctttgtacaccaacacttctagaaaggctttggaagaagtcagcttgaagtggattgacactgcttctaagttcggtaagggtagattccaaaccccagctgaaaagcatgctttcatgggtactttgaagaaggacttgtaagaagttttgttagaaaataaatcattttttaattgagcattcttattcctattttatttaaatagttttatgtattgttagctacatacaacagtttaaatcaaattttctttttcccaagtccaaaatggaggtttattttgatgacccgcatgcgattatgttttgaaagtataagactacatacatgtacatatatttaaacatgtaaacccgtccattatattgcttactttcttcttttttgccgttttgacttggacctctggtttgctatttccttacaatctttgctacaataccatttgcccttgggagcttgtttcaggcctacgcaaccataatggaaccactcgaagggacaagccggattatcacaagccaccattggcccataagatacattcctacagaaacaataaacctcctcttgattattattaccctctgttacatcaccctggttaatcccaattgtggggctagttatgctctcttttctttccctcgatttagcctttttcaagttaatctttaaaagcagttttggctccttatatgctcctggttcttctaacgtcaacttcgacttgatattctctagcgaagagttgaaattttttgtcactgacttctgtatctctagttccttcttatgctgctttaagaaatgaatctgatcatcgaccagatcattaatataagtcgctaccagcaacagatccctacaggccctttccataccaggctcatcctcttcattcttgaataagtcgattgtttgcatcagtcgaagagatcttattagttcacatggtaaatgatccaaagtgctaaggaaactgtacctgatatccgaatccgagttttcgttggcgagatgttccattgctgtagacgaaaaaaacttccttgtaaagcggatgtgctagcgcatcatacatttcagttctattaagactttcacagatgctgttgtgatgttctgtgagccaatcccaaatgtttgtataaggacggaaataagacggagcgccacgtgactgaagattttttttttctcggatttcttggtaatgggcggccggtatttccggcggccaaaaaatgcgaggatttggttggtggagagggtcgagcgcctttaccctgcgtagatactaagggggctctttctagtatataaacaatttgaataataacgaggttagacgtccaactggatccatagactatctaagcttttagtagaggccattcgttttcttattaatcatcggtttcacaatctttctttgttaagcaacattttatacatttttgtactttatcttcaaatattaaggacaagaaagaaaaagaaaaagaatccatattctatattagtgtaacactatttttcttaaatattttttccagtactcccccagtttgataaaaagcattcattgaatttccccacatttgtgatatcttcaattgattagtttgaactagttctgaaaaataatattttacaatttgcattttcattacactatatcatctactattttttctcagaagcggaagttataactaatttgacaatgttttcaaatctatctaaacgttgggctcaaaggaccctctcgaaaagtttctactctaccgcaacaggtgctgctagtaaatctggcaagcttactcaaaagctcgttacagcgggtgttgctgccgccggtatcaccgcatcgactttactctatgcagactccttaactgccgaagctatgaccgcagctgaacacggattgcacgccccagcatatgcttggtcccacaatgggccttttgaaacatttgatcatgcatccattagaagaggttaccaggtttaccgtgaagtttgtgccgcctgccattctcttgacagagttgcttggagaactttggttggtgtttctcataccaacgaagaggttcgtaatatggccgaagaatttgaatacgatgacgaacctgatgaacaaggtaaccctaaaaagagaccaggtaagttgtccgattacatccctggcccatacccaaacgaacaggctgcaagagctgccaatcaaggtgccttgccacctgatctatctttgatcgtgaaagctagacacggtggttgtgactacattttctctttgttgaccggttatcctgatgaacctcctgctggtgtggctttaccaccaggttctaattataacccttacttcccaggtggttccattgcaatggcaagagtcttgtttgatgacatggttgagtacgaagatggtacccccgcaacgacatctcaaatggcaaaggacgttaccacctttttaaactggtgtgccgaacctgaacatgacgaaagaaagagattgggtttgaaaacggtgataatcttatcatctttgtatttgctatctatctgggtgaagaagttcaaatgggccggtatcaaaaccagaaaattcgttttcaatccaccaaaaccaagaaagtagttgacaaaaaaatgaaaaccactattatttaaattacggaaaaaaaaaaaccaataaacaaaaaacataataaaagaaatgaaaaaaaagaatattagtagagcatactgaattgttttcagaaagagagtgaaaggtaacaaaaatttacctacttttcctttttatttctctggtttcgtttcttttttttcggccaccctatttattttttcactgcttgtaaacaacgtctcacttcaatagtgtctccttcatgtactgagatactgctgcaagcgaaatatcacgaataataatataaaaaaaaaaaaaaaaaaaaaaaaagatgtttaaatgttaacaacctaacagcaataaaaaataaaaataaaggtagaagattgcaagaaagaaactttacaatattttgtttggatgcccaacaccggcgtcttggtgttcttctataatatttattttatttattttttatttatatatgtacatatatattcctattatctattaagaaagtaaacttagtgtaaatctaccactgttccaaggctttggccatccaccttctctttcgttccattaataatatgacacaatcgttgaggatgcgagcgagaccgttatggtcgatctttgaagtcgccgcgtaacgcgctagtattttttccttaaagaggcaaacacttatttttccctaataggaaatccctcaaatcggtttttttccatattagtcccgttctattgtctggtttcatacctctaaaatttctctcgctgttccatcaattaatacaatcaaggcacagccagcaaatactaataattctcttaataactgcttcccctttgcagcaccgataagggatctttaagacggtcttgaaaatttttcgttagttcatttttcattctcggaagtttttttaaattttgagaagaagagctggttgcacattccaaggtgattaaagggatttgattaagtatatattcaccaacctgggttgtgtagttgaaaaggggaataaaaatatctcaagaatacttcgtgaaaaatattcactatggataaaagcatgatcaaaaaaagaggcaggcctcccatcaccaaagattatcccaatcccctacaaagccccatggcgcattcttcaatgcaggttcagaagcaggggcctcacagttttgccaaacctttgatgaaagtggggcaatctagtccatccccgaataaaagaagactcagcatcgatcatcatcataatttggcggcaactacgagaaagggcagatacaggggcgttcttctttctactcccaccaagaaatcgagcactaatggctctacgccgatctctaccccgtcttcgaatgacagctataataacacggtgttttctgaaacaaggaaaacctttcttcagagttcgccgcctatcatgacgtcttctccagctttccaaaagaaaaatgactacatgtttccttcacaggaacaattcaaactttctttaaccattaccgaaagtgggaaggccgttattgcaggatctttgcctttctctccatcgtcaaaatcgtctcatttaatgaacaataataataaaaagatcatgcaaaatgaaaaaattcacaaaggaagcaagaaaaatgcacccaagtttgagaagagacgtattctttctctcttaaaacagatgaagaatgagaaatattgtgatactgatacgctccccgaagcacctccagcgaaaccaagcagatctgacatcatcgacacagaattgccgactatcatagaaacttcagcttctccaataggcagtgctagaaacaataatatactgctttcgcaaccaccacaatcacccccttcaagcgcgcaacttaagcccccatccactccaaagagttctctacaattcaggatgggatttactcccaatgttgcactaaattccgtatcattaagtgatactatatccaaatctacaaatgctgtgggtgccagcaataataacaatcagaacggtaattccattagcaatatcgcggatgctaatactttacttaccttgactaatagcccgggagttttcttatcacctcgaaacaaaatgttgcccaagtcgactactgcatctaacgaacaacagcaggaattcgtgtttaagttttcaagtggtgacccgttattgcttactgacgacgcagatgggaattggccagaaatgctgttcaatgtatctaatacgcccagacgtcaaaaatgttttaacacacctccttcatggataaactttggttcacctggattattcagcccaccaagaagctctaatgtcatggtaaatggcaccactgtagccaccgcatcggatagcggcaacgtccatagacaattacaagctcaattggaggcgcaagtgcaagtgcaatcgcaatccaattctcctactcaaaggcaacaacaacagcgtcaatttcaaatacccccacctcacataaacatgaactcttccccgccacaaatcaatatcgcttccccacctcatcaatctatgtctcgggtgtcatctatttacttcaacaaagaaaaaaccacaacaggggtagcaaatatgctaggtaacaccaaaagcgaaaacttacagccgccggcgaatttatttaccgctgcccatggaccttcaactcctagaaatcaagaatttcaattacccactttgattgaatgcactccattaatccagcaaaccatgaatggctcattaggaaccaaatacataccaggtacttcaatttcgaacagtgcaactcctaatttacacgggttccctgttggaaccgggaaagctccctctagctttgacgattcactaaaacaaaacccgtacagcaacaaacaggatgatgctagaactgccttgaaaagattaatcgatgatcagtgaaaatagtcatagattcatgaaaacgatatgagccaaaaggaccattcaataatcatgaagcgttaaaaaatagtttacttaccttttttccttcttaaagcattttcccagagctgatagataatatattgaagtagtacttatatacctttcaactgatgcatgtgaatggagttgaccttcattcagtttaatgtaatgttattttaattcaagtgtaaaacgcacaatacgtaaacgaaaaataatgaggaactggcgtgagggactgcataaatcgaaatctaatcgttattcaattagttagtaggtgaaaatgtacaataaatatttctaaaatcgattcatatataaataattttatatcactttttttttaacgtcctagggaagcgatattgtatcactgccatagtaattcgtcaaaattatataaccacgataaggcaaaccacgagctgattatacctaatgaacaatagacactatatatcattaatcctaagaattcaaatttttgcaaaaatgaatatctccacttgacttcatccaatatttgtaatacggtgacgattggtaacaatgaaaagatgtacgttaatgccaacctatccaagaaaaagattcttctttctacacttgaagaaatcttcgtagtttttctaaaagcggcaaaataaattatacaccaaacataagtgtataatgttttaatgaaaaaatcttggcctttgtacagaagaggatacaaggaaacataaccagctgaggcaactaacataaacggtaccaaaagacgacgatcaaatccaacaagaaatgtgaacggaatgatgactagcattatagctttctcatgcacatgccacccgaacaaaaacgatgccaacccacagagagtcaacgagccaacaaatcttttgaacgatggatcaaacaaaagtggaagtactgctaagacctggtaaaatatcgtcaaaataaacgttaattttggaggaatttgagggagaataacaaaaaatacgtcttgaactagacctttacttccattgttgtttgccgcgagcctttcattaatttccttgatattctgagggatcagaggaggtttaataaattttgtagcaaaagtgtggacgtacggtaatttcaacattaccgtagtgagtattttatccataaaagaatacaacgcccagaaatttggtgcccaatatgcatgcgtcagtcctcttgagaatgggaataacctgctcaacacttgcggcatttgatgagcaaatggaaggaaacaaatagtgaaaattccaacaacaacggtagccaacttcaaaagatttgcccatcttatcaggaacaaaaaatctttgtaacttttaaacttgaaattgttgacattgagaacgtatgctctcaataaaaacacgaaataacatggcgccaaatataaaaatatatgcttgaaacatatggctgtagtatacagaacagcgcacaagatgtatctcttattcttggcggcgacaatggagcctattagaatcgcaaaaagaaaaccattatattggaagtgaatgtgatctattattaaaaacccgggtgatagtacaatgctagaagcaaccacaaaactttgagatctttcacttagctttgtagtattaatgtatatttgaaggatgacaaatagaagaatttcgctgaagatgacagtgagtcgttggaaaacgattgttggcaaaccgaactttccgatctccactatatccaaacaaccgtcatcacgtacagatttaggaacaaattgcgataaaaaccattcaaaataagcaaaaaatggcggataatccaatgtccattgactagtgtgctcataataccattcgctgatgggcaatttattggtgattgccagccaatttctatgaacgtcaaaatctgtactgaagtagtcaggaatcaatagtaattttaaaaacaatgtgcttatccagaaattccataaggagtagcgcttggatccctcacctttttcggtcgcggcagtcttcaaaaccttttttggctcgtcatttttttttaactttgccttctttgtcacagccatattttgcctcgaacgatcacctttcatcgtaggctatccaatagacgtcaaatgccttgctgaccactacagaactgtaatgaacttcagctatttttaacgtatgttattctataattctataccactattgtcgttttgaaaaatgaaatttcacttttcggaagttgtccgctaagaacaactaagtgataacagtaaattttaaaaatgctttgaaaaatgggttaagcaaaggttatttactataactacgtagtgaacgaaaccatatatctcttaatttgcagcagggattttataaactttcatacatcctgcaataacaagccatggactacgaggataatctagaagcacctgtttggacgaactaaatcatgagggagataaaactcagagcctcgtttcaaattcaattgaatcaattggtcaaatatctacaaatgaagaaagaaaagacaatgagcttttagagaccacagcttcatttgcggacaagatagacttggatagtgcgccagaatggaaagaccctggtttgtcggtggctggtaatccgcaactagaggagcatgacaattccaaagctgacgatcttattaattctttagcccctgaacaggatccgattgctgatctcaagaatagcactacacaatttattgcaacaagagaatccggtggcgcattgttcactggaaacgccaactctcccttagtttttgacgatacgatatacgatgctaacacttcaccaaatacttcaaaaagcatctctggaagaagatccggcaaaccacgaattctgtttgattccgccagagctcaaagaaactccaaacgcaaccattctctgaaagcgaagagaacaactgcttccgatgataccatcaaaacaccctttactgatcccttaaagaaagctgaaaaagagaatgaatttgttgaagagccattggacgataggaatgaaaggagagaaaacaatgagggcaagttcacagcttctgttgaaaaaaatatccttgagcaagtggacaggcctttatacaatcttcctcagacaggtgctaatatttcaagtcctgctgaggtcgaggaaaactcagaaaagtttggaaaaaccaagattggctcaaaggtgccaccaaccgaaaaggctgtggctttcaaagttgaagttaaagacccggtcaaagtaggagagctaacatccattcatgtggagtatactgtaatcagtgaatcatcattacttgagctaaaatatgcacaggtaagcaggcgttacagagatttcaggtggctatatcgtcaattgcagaacaaccattggggtaaagtaataccaccaccaccagagaagcaatcagtaggcagttttaaggaaaatttcattgaaaatagaagatttcaaatggaaagcatgttaaaaaaaatatgtcaagatccggttctacaaaaggacaaagattttctactctttttgacaagtgatgactttagttcagagtctaaaaaaagggcatttttgactggatctggcgctattaatgatagcaacgatctgtcagaagtccggataagtgagatacaactactaggtgcagaggatgctgccgaggtcttaaaaaatgggggtatcgacgcggaatcgcacaagggatttatgagtatatcgttttcatcactgcccaagtacaacgaggcagatgaattctttatcgaaaagaaacaaaagattgatgaactggaagataatttaaaaaaattgagcaaatctttggaaatggtcgacacctcaagaaacaccctggctgcatcaacagaagaattctctagtatggtagaaaccctagcgtctttgaacgtgagtgaacctaattcggaactgctgaataattttgctgatgttcataaaagcataaaaagctctcttgagagaagctctttgcaagagactttgacgatgggtgtgatgctggacgactatattaggtcattggcaagcgtaaaagcaattttcaatcagagatccaaattggggtatttcttggtagtaatagaaaatgacatgaataagaaacactcacaattgggcaaattgggtcaaaatattcattcagaaaaattcagagaaatgagaaaggaatttcaaacattggagagaaggtataaccttacaaaaaaacaatggcaagcggtaggagataaaataaaagatgaattccaaggtttctctactgataaaattcgggaattccgaaacggcatggaaatatcactagaagcggccattgaatctcaaaaagaatgcatcgagctttgggagacattctaccaaaccaatctttagatgatctgtatacaataactttatgtgtcacgttcctcaggatttatgaattaggagatttttgttttatattattacatactatacagtaagtaaaatgaataggtccgtttacagccagtgcgacgtagcatctttgtaaagagattgccaaataaaggcttcgctcagaagcatttcaatatccgtttcagtccagtcctttgtaggagggttctgtaagaaagttatagtttcttggaaatccatttccattagctggtcactccacttgatgaggaatgcagcacaaacaaacacatgaaactcattcaacgaagactgtctcatttttccactgtcttcaacagcattgtttggtgtcatattagaaagagctgtggtgggagattggaaatcttttgttggtgtaacaaaacttgccactcgaggttctgttggagtaacaggaggtttaatgtcattggacgacatagaataagaagaagtgacctcttgtgaagtttcagataaatatgtgtcccacatccttattactgtacccatttgaaattctctcatcaaaaggcaattcatccatctgaatgcaaactgtataaactccacatgttcattttgaaaatggttatatagatcagcatcaattcgtttcactagctgactcaaattcttcacttgtcttaatatgcctggttgtccgtgaatatagttatcggtaatttgttcgagcaatttggtaagacaccaaaacgtgtccgcttctaaatctgtaatctgttcatctaccatataagtagaggggtcctttatctctacatcatctatttgtgaaggcggcagatattcggtaagaaaagtctcgaaaaatggtgtaactaaatcattaataccttgcacatatccgctagcaggatgcctgattgcccaaagatatagtattcgttgtaaactgttctgtacggatttgaactggtagaggggaatgtggggatttgttctcggtatatctatctctatctgatgccaagttgggatatctcttgagtgctggtcagaaaaggtatgtttcagactatccctatattctttcctcttcctttgtaagaaaccctcctgtctcttggtgttcacaggcaaataacctattaataatttccaaacaacaggcctgtgtatttttgggataccattccaactgatctggcgcagatcctgttgatttatgattgtcttatctttcaaaatattgtcaaatttagaaatgcgctggatgatggagtttaattcttgaacatcccgttcgttttcgatttccaactgagttttcttggaatcatttgttttctctttttgcagctgtggtaattgagggtatgtaaaagaggaggaagaattccgtactgcggaggtccccatattcgaaatcgaattgatggaagaagaagtggattttcgcgacaaagttctcgttggagctacaggtgtaccaaatccaccgttagtaagtataggaataggcatattataatcgtcaataacagcactccaatcctcatctaagtctttgaaatatcgatcaccctttttgttaggctctgtactgttactgcaattgttgcctacactaccactactgctatggcggggttgttgatggtggtgatgacgctggtgatgctgacgtaagagtaaagcaggccggggactttcgttacttgcagtgcttagagtggggtttacatatcgtagaggtgaataggaattcgaggtacgtctagtgcttgcttgttgctttgccatagcttcaaaattaccgtcactggttctccgatctctatctgccgaggaagcataacccgagggtaaactagtagattcagtagtattcattttgtataacgatggcttcttggaggaagaagccgacgatatcctccaagatttcatcagggaagttactaaactggaactgtccgaattatggtcccgttcgtgcatttcctttgcagcggatctcacacccattatatggttacttttattaagtggtcggtattggtggttgttgttgttatttgtatccttgatctactctccaataatagttataaaaatagaaagaaaacaaaacaattaacagcaggacaaaagccaaacactatagcaatctggctatatgatatgcagaaaatagtgattactgtgctctttgctgcatcatgcatcatatgtttggcattctgtcctgtcagatgaatgggcgaaacaattcggggagctttgttgcgacttggtacccggcaagccgcgacctatattttgcattaaacgagttcatcgtggatttatcgccatgagccttagcttatcaagcctctcacagacaattaagcaatgaaaaaggtataccatcggcgcagaatggttaactagtgggttcatactgctgtgttatagattgttacctaagtgatcaccaaaaaaaagtgcaaaaaggaaaaaaaaataagagacaggtaacttccacaagcttattcttccaaaaatcaatcttatcttcatgccagcaatagttgcgtgctgagctcaacagtgcccaacccttgtgcaccgtagaattgtagaatacaaatacataaataagtgtgttcccgaaggactaaggaatgacggcagaggagtcttgtgaccgccctgctgcaaaacttggcaaggacagaaattaagtaatagatacgcacaaccttggagcaccaagaaatggctgcaaaagtaaatctatagtatttcaagctgagatatgataatatgttcaaagggctaaagtctcatgaaacagcgtcactacaagtcacataaagttcgtacagcaagtctatgcatgctttcctcaaaagaactacccaaatataaacacatatacaaaaattcagattttacatttcaggtttccataatatgttaaaagctagatcttacatagtgtcgggaacaggtcattctaaaaaaagtaaaataaaataaaagggtttcaaagatccatacttctctacattctctgactttttaaaactgtgtactggcgaccaatcgacaaatctgcaaccccagcttcataagctttctctcccaccagcaaagcctggacctccctggttctaataatgagcgactgaagttttccaaaagaaaccttcactaaacatgttatgctcctcaatcacgcgatgaaataaaggcctattttttgatccaacgcctttgaaaatttccttatggctgggtggggtacctaccatgaacatgttaaaggtaagtggtggcatattatggagttacgcccgtataccagagtaataatgttgccgccggataggcatggcgcccccaccggattctcttgctatatggatggcataattagcttatgaaaggattggtaagaatatgtcttctagcaagaaaatactaagaaccaatagttcctttttttataaaattattgagccatacacaataatgccgatatttgtcaccatagacatacttgacagtaaagtatttgcagctgaggatcgatctggtagtattcccaaattgtaagatctgtacagattttcaaatgaagcgttgaagtttcctctttgtatatttgagatcttcattttatcggattctttgtcatcagacaacttgttgagtggtactaaaggagtgcttttcatcatccttttggtgaacgatttcaaatacgttagtgttttctgagctagttttgatcaattcaggtgattcgttatcagaactctcaggtttgtattcgtgtccagttgtgtagcattcgcctaacgtgtaagcacggatttcttcctcagaaatttcactgtatggaatcatgcccttctttctcgcttcttcgtcggtaaatgcaccatagtaatctttgtcatcatgtctaacagtaattttgaatgggaagaagacacatagcccccagtaaacgaaaaaagaaatcaaaaaggagaagaaagaatcaccataaaagaatttaacaatacctgagtcgtggaaatagttattgttgacttcccaagcgataccaggtagaccgggagccataccacacacccaggcaacgatagctctccagttgacacccttggtaaaatagtattcaccctttagaataaaggcattagtaatggaatattgcctcttcctgatcagaaagttatcacagatcatgacagcaataataggagtcatgacaacaccgaaagaactcatgacagttaagaaagtagaagaagagttgtagaagttccatggcaaacaagcccaggagatacatgcgcaaaaaagagcacctctcttgatatcgacgtatttgggcaacaaaccggccatatccataccagtggcaaacccacagttggagatggtggaggacatttgagacatggtaaagcaaagaccacagaagaaggcacctgcgcgagcgcctgcagaatagttgtttgtcaaccaataatcgaatatatccatgggcatccaaaattgtttaccgtataatttgtcgcaggtggaggcactaatgacaccgaagattgggaccaaggttgctgggattagtaatgcacagacgctaccggtccagatagccaaattggaggaaccgaatcttgaatagtcactttggttggtggaacctggagaaatggaaccgaaccagtatgaaatcatgtaaacccaagcccatgctcttttagaaccagtaacggtagattttgtggaggtaaacaattcaccgacaccatgggcattcttagtcaagtaaatcactatacccagcatggcaaagcaagtagctacacatgaccaaattaaaaggtagttcatatggtagggtttcatgaaatagcagagcgcggtgaggacgtggaaaataatgaagccgaccaactgcttggtggtcatggcaacacttggggacaaagtattgggcaggtgcagatagtggtgggaccaggaatctaatatcatgttgatagatagaccacccaaccaagcgttggaaccataattgacaatactcatcaaaattctaatgatgataccgaaggctgaaccgtaaatgccaaaaacgaatctttgggccaaggtgaaaccgattttccaatcataaccggggtaagagttggccatagtgaaaataatggtcaagacattaccgagaagaaacgaaacaatggtctctgggtaacttaggccgacacttagtgcagcagaaccactcatccatgtacctgctgtaaaggacacagcgccccagtacgccaaattagaccagaacccccatgtttgatttgcagacttgataggttgcaaatcagggttcctcagaaaattcacggcagtcctatttttggcaggaatttctaaatatctcaaaaacttagagactatactactgaagctcatgatgatacaggtgctgaagtcctttttttgatagttataatggggatatcagtacaataaagaataatataaattctgcaataggaaataatataggtaattgttcttgataattctggagtttataagattttaactctatttatgagaatagagaaggaaaattaaaactacaatagcgaatgcaaatttttttccccgaagaacaaatagcggtagcaacacatgctgacgaaagttgtgttcctctttttttggagcaggtctgactcaactaaaaagctagctgcatgcaaccacgctacattggcacactatatcctgacgcccgcgctatactctgacgcctgcgctatatattctgacgtctactccataactattatagtagtggccactgttgttcgtaacccggcgcggtgttcgctccgagcacgaaaattctgtcgtttattctcttccttcttccagttccattacttaaaggagctgttttatttcattcgaaagcccgatgacaaattctcctctttcatataaattaataaggcggtcagcaggaaactcctattgccaaccgtcttgcgaaccgaccggtcgctgcgcgcgatcatgcgtccacgcgcttctgtggcgacggacgactacagcaagacattactctggtcatttacgcctggcgcccagaatgtacaagcgcagacggccagatcatatgatgaaacggaatagtcccagctataccggtgatcacaagacgtagttacatagatgccttggcgccgacacgatatttcttgtcgttctgtgccagtaattccttttcttctcgactatgcctctaagacgtcagtcttggaagcatagtcttcgtaaaaaaattttttttttgaggtttttgcttccatttctttagactgaactaatttattttttttattattattcagtaatttttatatatttatttatggacttattgaggtgctttgggggtgatgacgtccccagtgaggcccccagggtagtggaccgcacctaacttcccattcatgatgtgattacgcattttaatcttgtctatatgttctacaatgatggcgtcagtgccaatgccgttcgcatctatgagggagatgaactcgctctcggccgttgggtttgaggcggtgccgtagtgtccgccttcattccggcttcgcggtgtctacgaggcattcattttatgtcgcggcaactacttgatattttccaccaggcacaaggagaaacatggagaaattatatatagagaactatgagtcctgaggcggccgttcagtagctcagattgccagggttaaaaattgctccttggcatcctatgtgctgcatactaaaaaatttttagccacgtagttgtatacttttgtttccggggatgagaaattagccccaggtcccagacttacaacaaggtagataggggggcgcaccttgtcgtcatgagacccatttcgtagaaacttgaatttgttgttgttacttctgttttcaagtaggagtaacgaggccgcgtacaatttgccagtggatttgtcgcctgcagcagcggccgcgacgcgacgggttgatccaattttgtgcttgcttcttcaactgaatattttgagtccactgcatgtggaaaacagagttttcagtcagtcttgtatgtatattattctctttagctccagaatttctgctgtgcttagtaacttcttgccgttgagctgattttagtagtataatttttttgcaactctactgatatcaagagcagtgatatgtgctttaatgttggcatttctttcaagccaatcaccttctaccattggtcacggtctcagtatatttgtcgtaaatattagtactctagtctggtcagagaagtggcctttctcccaccaaaacgttgttgttctgtcttttttcttattatttactatttattggatttatcaaaaattcctcaggaacaagatttaatattcttgaaaatcctgtatgtcataaatcatgagcttggaaattgacacgaaatatcggatggcactacttgatgatcgtttttatcactaccgctgtactttaatttcataatttatttggtgacatttctcttgaagatctggcaagatgtacacggggagctccttcaactgttaaaaatatttttaaaagtaaagacgtcaccatactttttcaccataagaacaattactggtccagattaagaacggttggagtaagagccaattatcattcattgactggtatttccttttgaactatattatcatataataggtaagaagatggcaaaaaggaaggagaaacagtggtctgatgtgatagggaagtaaatgtcaacaaatacctaacagtactatctgatcgaacaaagaaattccaccaaactgtcagtaaatttatttaatgagcagcaaggacatagtgcacaactagcactctacttcgattgggttattgaggaagaggatagtatgcccggaattttcaagcatttacatgattatggtttcattggggtgcaagaagacccagcatgattagattgctatgtactcattatataatatatctccgatgaatatatttccgaaagtttactgaaggcgaccttggataaaccatagttttacggcaaatacaccatatcactattttctttctatatagctttgctaaggctttttttagtgaccgagacaaagaagaaaattttccataaatgaaagaccattgtttattccgaatcaagttttccgaagaattgttgtattacacagtccagagacagcagaatctttcagaaattttaatactgttgtgacagcatcttgtctattatttattggatacgcaaaactcatttttttaaaattttttttataatttcctttaaataaaaaggttaaagctgggaaaaatgcatctaaataataaactaatgatttagtttccctcatttaaaatatctaagaaggacagaactttgtttggggtacttacccttgagtatttttagcgattattcttggagttctcagccagaagattaaaagaatatatgttactgaatgcagtgtgatactcaagactaagtagtcttaacaacaagttaacaagggcgtgtggtctagtggtatgattctcgctttgggcgacttcctgactaacaggaagacaaagcatgcgagaggccctgggttcaattcccagctcgccccttttatttttgattatttatttcctattggtcgggtaacagattttttttatttttttcaaggcccttttgttttgtaaacaaagaaatttcacaaagtgagcgtctactaatattgataatgccatttccacattacaactactgctaggcgcagggttatattacttacacacgcatatatatgtttaattgggtatagaggggttattgtttgaccatgccgaagagaaaaattgctcctaacaaggaaagcagcaggcgtacggtctcccacgatgatttaaccccacaaatacaagaatttcaaaacctaatggatctcgaatcgcaaaaagtggaaaacatcagacagtcgtattcgaggcaaaactccctgctggccaaggataactccatattaaaaattaaagttaatagcttggaaaaaaaaataagccagctggtacaagaaaacgtgactctacgatctaaaacctctataagcgaagctatctacagggaacggttaagtaatcaactacaagtcattgaaaacggtattattcaaagatttgacgaaattttttatatgtttgagaacgtacgtaaaaacgaaaatttgcccagttcgagcttaagaacaatgttgaagagaacgagttccaggtcaagatcatgctcattgtcatcacccacatactcaaaaagttacactaggttatcaaatcacgagaataacctgtcgcatgaatcaagttttaacaaggacgatggtccagatcttgagcctaaggctaaaaaaaggaagagttctaggcggcaatctatgtttgtatccacgagtttagaacctgaagacgaaaccggtgaaaacgaacccatgatggaaaattcctctgtagaggtaccggcagaatcacacgagtctgcgcaagtggaggaaacaatagatgccttaaaccctgaagaggaaaatagcgattctgtcagtaattttaccaattcaattatagaatactccataccagaggagaatccgacagaacccgagcattcatcttctaaactagaaatattcaatgacagtacaaatatgctaagtacagtgccgtcaaatcctttgccgttgcctttaccaggcccatccgcaactttacctactaccactagcgatgcttcaacggtctatccttcatcaagttcttctactaattctcatccaaagaccaaaattaagcattccatgaagccgcctaggatagaactgaagaaaaaggttattgacgaagtcatgcccgtaagtaacatgagcagcaacagcgaaatatcatttacgagaactagaagaactcgtggtaaagctgtagattacactttgccttctttaagagccaaaatgaggaggccttcagaaaaacttgtggatgctactactgtgattgatatacatgatctacaggtttccaagagaaatcgggaaacttcacataaaaggaaaagtttatcccaagattcaatacccgacgaaccgcaattgagagaagtcgtcgtctcaaaggattatggaactccaaaagggaaaaaaacggaagatgaaatacacgaggataccgctcatctaatgaccacttccaacaacaacagcaacaacaaaaacgaaaaaaaactaactagcaacaatagccctaaaaaatcgtcgcctttacttgacattacaaataaatcggagaataagaaaaagtcaacaagaactaaaaaattgttcaaaaatgcaattgtcaataatttatctgatgaaaattctactacgcgaccctccaagtcgtcaaagggaaccagtaataataacaacaattacaacaatttcgacaataacaattcaaacattaataatgttaataataaatctgttagctttagactaaatgaagatgatttagcagtatttgatttatttggaaatggtaaggcagtgaaacatcaaccaaaaacatatcgcaccaaaaaatgatatatagtctttttgccctggtgttccttaataatttctatatttttgcataataaaccattgtattatatacattcgattttgtgtgtatatacgtaagtacatgattttgtttctcctcgtgctgtcaattatacactcattttcatttgaattcttggatgaggattataatcttcaatttcaaagtctgtcaacttgaaatcatcaatgtctttaacgtcccttttaatctttagtttcgggaatggtcttggatttctggtgatttgttctttcaaggcatcaatgtggtctttataaacatgtgcatcccccaaagtatgaatgaactcacctggctccatgtcgacaactttagcaatcattctagtcaacaaagcatatgatgcaatgttaaatggtactcccaaccccatatcacaagaacgttggtacaataagcatgaaaggcggggcttaccggatccttctccttctttggggaaactgacatagaactgtgaaaaaatatggcatggcggcaaagccattttgtcaaaatcagctgggttccaggcactcataatgattcttctatcgtagggatttgtctttagtttatgtataacctgtttcaattgatcaataccttgtccagtatagtcgtcatcgcacgtcttgtatttagcaccaaaatgcctccattgaaatccgtaaacgggccccagatctcctactttcctatctttgaaccccatcttatctaaatattcacgagatccattaccgtcccaaatcttaacaccttgctcagacaataggttagcgtctgtatcaccggccaaaaaccacaatagttcaagtatgatacctctagtaaaaaccttcttggtcgttagtagtgggaaggtatcatcacgtaaactaaaacgcagctggggtggtgcaaaaagactcaacgtaccagtgcctgttctatctggcctaaattcaccttcatcaatgattcttttgcatagatcaagatattgctcttcttctttgttttttccgtccatagtcatcctgtaccgttctgttatgaagctctctccttgatactttattgtttgatatacacagtcacttacaagtttagaaaatacaattacagctatgctatagtaaatatttcaggaaacgcgtcaattaaggtctttttcattttttctatttaacgcgtcaccaaatattaagtttgagaaagaaggtcaaaaaagcaacacctcttccaacctgttcaatgcggtcctacgttgaggacacaaagctaatctctttgaggtagctgcagtataatgacgggacctttgcatattttattggccttttccaatgaaactaattttttaattgaatctcaatcccgtcctttacagacgagaggggaaagaagcttgttcgcatgatccatcctggaatatggatacatgtcatgtaatgataaatcattcctacctttgctggtatctttctgaaaagggcacatttaattaagaactgccaacaaggaaagatctccgttaccctacccaacttgtgagctcagatgaatgagaataactagaatacatacacatacgtctagtatcatttcccccggtgctgggaaatcacccgtaaaagcagtgaagagcttattaactcatgatgtctgatttaacaccaatattccgtaagtatgttgctgttatcgatgatgctagaaatgagcaaaatggtatagatgatcatgttgaaaggaaacaagaggacttcgggaattctaatgaaacgtgtgaaatgtttagggattcgtttattaaggaatgtgcaagactattgaagttcctagtcgaattaaacaaggtaataaaacagattgaaaaaaactatttagatgactttaatatgagtgatgcggaaaaggacgagtttgacatggaatgcaggctgcaaattcaacaatatttcaaaaagtttgaattcctagagaattacgaaatggaaaggcataatttgtcgctgaaaagatttcagtcaaagtctcacagatggtcaaaaatactttccaataaaaacgacaacactaagcatgtgatacatccgcaagacattgaaaatggagtttatgaatttagattaggtgtcctacggtgtttgaatttgtggataaaatatgtttcatccaaattcactaccatacaacaggaaagattgatattagaaaataaaatgaatttcaattcaacgcctatgcctactttatccaacaatgcggatgatttctctgcagatgcaatagacatctcagtgtcacaatctgctcccgtagaaactgtacaagacgaagtaaaacattatgaagagacgatatccaaattaacccaggagcaactacaagtgttggagacagaacattcggaactgctaaatcaaaaaaatgagcaattgaaaaaagtggagactataaacaaaacaattttagacattgtcaatatacagaacgaattgtccaatcatttaacggtgcaatctcaaaatataaacctaatgctgaacaatcaagatgacattgaattgaatattaagaagggaaataaagaattacgtaaagcgaaacgagctgctggaagaactgctaaaatgaccacttatggtgccattatcatgggtgtttttatattgttcctagattatgtaggttaatatcactttcataagatatgtgtaaaatgggttaaaaaaatcaatctatcatcaacttattactattcattttatatattaaacaataagtatgaatgcctagtataatttcttagttgtaggattactggcatgcaattctgccaactgcgataaccttatgatctattgatgttaaaacaatattgttggtaatgtatttggaatcaatcacattaagagcaaagtctggttctataatttcgacttcgacaataagtgactgatttggattaattgagatgtcgttagtcccgagaatcttcaccaattttaccgcgttgtgcgtcaaattatggtaaagaagcaattcagaacccaagtcaacgggatcacttagcgcgtgcgtttgtattgataattttattaaacgcaaggctaacaactttagtgtgtttggtaaattcggtgatagtgtattcgtctttctagagtgaattattatatcacccttacgaatgtgaaattgctttttcgtgaagtcttcggtattatgaatcttaacaagaacctctaaaatgtcagggttcaaaccgactgatatattattttttgtgttagtctccagtatttgttttgaattcttcattcttgaaactataccatagtaatgaaaatcttcatattgtgtatgaatttcaattgtctggcctgattgaatatatccgctgttgatcaagactttgagtgacacgtaatttatctccgctatcggttgaagaacagaagattgcagtattgtgcctacaaatggctcttccaaagttgtttctattttgttcatattatgctctaccaatagatatagttgcgaaaaaaatgtcggaccttcataccattcgggaacataatttatagagtcaaattctgacttatacttagattttgtgatgttttcagttttattcaaattcgaacctaataaacccgaacacgggataaattggaattctgcgtctgtccactgaaagttttccttcaacacataatttagctcagactgaatcatttctagtcggtgcttatcccaactaattagatctgccttattcaaaagaattatcaagtgctttttgcatgcggaattcttgttcaaataagagatcacttttaaaatttcataaatctgattatttggaccatctaatgatttttcccacgagtcataattgcaatcaataaccaatacataaacttcaggatcaaaggtcaaaattgagttcagagtttctttattgaagtatttgatactaccaggagtgtctataagcgtcaaggttgatgatggcggtagtaaatcattttctacctgaataactttcttaaacatggaaaatccattttctctttctgttttggtattgtctagaatgaccttaaaactatttgaagatgaaggatccaaattactgctttttttttgtagttccctcattgatgacatagaaatttcgtttagatcatataaaagatgaccaagcaaagtggatttgcctgcgtttgtatcaccgaggaacaaacatgtcaaattcagaggatgggtggcaatgaatgaatgaatatcaatcgactcagtaggtggtgtttgaaggttaattggttcctttttttcggccttgggcacagatttgatatttaagttttctaatttttcattgaaagcattaagttgggccgattgtattatatcatcaggacttggtctattgaaattctcaatggctactttacgagttgttttcggcaggttacaaggcacaaaaataccaaggagctcattgttatgcttttttaaggacagaaatgatgaattctgcgacgatagcggtattgatgtactcaacgagttttttttatcttttatgataaagtttgtgaacgcaaaatcgtcggtttgatttatgcatggatcgtttttcaagaaacagtaatggttcatttctttaatagccttccatgactcttctaagttgagtttatcatcaggcgatttccttttggtagggagttcgttttctttgctgtctaatgtcactgattttccttgtttctccaaatcactatttgacttctttaaggcagacaactttaaactcaatgaaacactatgctggttcggggtaaagtcgcttctttttaccttgtcttttgcaagtagcgtcttcagatccttcctttttgtctcagcattgttatctttagtttctctattcttatgtagtctttctagtaaggatgcacttttcgatgtactatgagactggtccgcacttaaaaggcctttagatttttctattctttttcttgctaattgctctaataacgacatgtcaggtggtactgtaagtttcgaagaccacctcctcgtacgtgtattgtagaagggtctctaggtttatacctccaatctgttatagtacatattatagtacaccaatgtaaatctggtccgggttacacaacactttgtcctgtactttgaaaactggaaaaactccgctagttgaaattaatatcaaatggaaaagtcagtatcatcattcttttcttgacaagtcctaaaaagagcgaaaacacagggttgtttgattgtagaaaatcacagcgatggcagattatgatagtgcgaaatattggtccaagcagggagctcgtcgtgggttacagaaaacccgttactactgccaaatatgccaaaggcaatgtaaagatgcaaacggatttcaatcacataacaaatcgccatctcatttaaggaagattagtcaagtgacagctgaggacgctaggcgctacaatatccagtttgaaaagggatttctacagttattgaagcagcggcacggagaaaaatggattgatgctaacaaagtatacaacgagtatgttcaagatcgcgatcatgtacatatgaatgccaccatgcatcgttctttgacgcagtttgtccggtacctaggccgcgcgggcaaggtagacgtggatatggatattgatgatacatctgagaacgttgaaggtcctttgcttatcaggatccatccctcatctttatcatcaccttctgaagatggaatgctgcgaagtcaacaagaggagcaagaagtcatagccgccgagcttttgaaaagacaactcaatcgtgctaagcgacaaactgaaaaggtatatcaaccagagatgaaatcggaaattagcggggatagcactctgaaacgtgttcaagtcaccttccacgggaatggtcgggtaaataaaaagaaaaagaaggttcctccacggaaagatggtatcaagttccgttgattgaaaatttttcttttcaagcgatgaggttagcgaagttgttcgaacaagcccaaatatgtttagaaggcagtacgaattgataccctgaactgttactacccgtatacacgtattaagtaagacaatgagtaatggacacgtcaagtttgatgccgatgaaagtcaagccagcgcaagtgctgtcacggatagacaagatgatgtgctggtaatatcaaaaaaggacaaggaagtgcattcaagtagtgatgaggaaagtgatgatgatgatgctccacaagaagaagggcttcactctgggaaaagtgaggtagaatcacagatcactcagagggaggaggctataaggctggaacaatcacaattgcggtccaagagaaggaagcaaaatgaattatacgccaagcaaaagaaatcagtgaatgagacagaggtcactgatgaagtaattgcggagcttcctgaggaattgctaaaaaatatagatcagaaggacgaaggtagtacgcagtactcatcttcaagacatgtaactttcgataaattggatgagtcagatgaaaatgaagaggcattggctaaagctataaaaactaagaaaaggaagacattaaaaaatttaaggaaagattcggtgaaaagaggaaaatttagagttcaattgttatccaccacacaagattctaaaacattaccaccaaagaaagaatcatccatcatacgttcaaaagaccgttggctaaatagaaaggctttgaataaagggtaatatatagcatacaacataataaaataatagtacaatcacaaaattaatcataatgttcatttatctataatcaaacaatgagaatatatactgaagtttggtaggttattcttcagagatgcagtacgatatcaccaacggtatgcagacacctatcaaaacataaacggattcatcatgaggtaaaacgacttcctgttcaacgctgagatcgtgatcatgagaatctccaccaacaaatgctgtgaaagacgcatatagtaaactgccaccactcataagcagaagatttccacttatccaatccatcgttggcgaatgactcagattcaaaagggataacactatgtatccgatcggagtcgatgacgcaaacaagaaaacgttacagatcacctcccatttcattaagttttgtctcgataccatcaaactagtgagggaaagaacggcaggaattttatgaataactatagcaattaacaccactatgagcagtgaatcattgttcgttgtcgtacctaatgcaattccatcagatagtccatgaatgaataaggcaaagacaacattgttttgtattaagttcatccatatttgtcttggatggtttattatatctttccagctttgaaatttgacagcatcatgcgtatagaccgtttgctttctagaaacccatagtgtaaccaacctatcaagaacataaacacctagaaacccaattaataaattcacaccaacgtttccatcatgttcgacacacgctttgataccttccggtattaccaacataaatgatgtacctaacaacattcctataccgaattgtgatagaacggcaatcttcacacggtaactactaacatcgtcattgatcgtttgagtatctgcgttcgtagtaaaatcagaaattgagtcagcaccttcttggtttgtgacaatggaacttttttgtttatcaatataatacaatgggataagccctatgaggaaggtagcaatcaaaagaaaacttgctagcagtattacacccaaaaacttcattattatcggtcttggtaacactagctttaaaccgcgcttatttgagaagtttttatgcagctaaactgtttctcgtcatttttttatagttatttctcgaaaaatattataaatagacatgcaaaatgattagccatgtcgtataaatttattaccaagaacaaaaaatacaccccgatgtcttccccagggaattcaggcgtggctatagattctaccgttctgaaagcaattgaattaggaacgaggctttttaaatctggagaatatttgcaagcgaaaaggatattcacaaatgctttgagagtatgtgattcttattctcaggagcagattatgcgcattaggaacgcgtatcaattagatactgcgagaccggataacaaacgattatatcatcctagatacataaagatattggataacatctgtgcgtgctacgaaaaattgaatgatttgaaatcttgtttggacgtatcacaaaggttacttaagttagaaccaggtaatatcaaatgctatatacgatgtacaaggacgttgataaaattaaaagactggaaaagggcatataaaacatgttctcgtggactgcaattatgcaataacgatagcaatcatctaagacaacaaaaacaattcattaaaaataacatggttcaaaaacaggacggcaagagaagttatatagatccattagaggagaccaaaatagcaaaaaaaaaaaagaataataatgttctagaatcgttaccaaagaagaagattaaaggtagtaccaagaaaactgatttagttggcaatttgccgatagaaatactacctatcatattccaaaggtttaccactaaggagcttgttacgttgtcgctagtttgtaacaaatggagggacaaaattttgtatcatttagactgcttccaagaattcaacttggcaccaataaattttaaaaattttgtaaagtttatggattttttacaacagaatttcaccaggacgtatagaaaatatattctttcacaagtaaaagtcagttctagaatcacttcggaagagttacgaataactcaattattattcagtaaaatgccgaaatgtataaacatcgaacggcttatactgtcaatgccaacactaactacaacacaaatctttaagttaatggttagaggaggcacagatttttttacaaggctgctggaattatctctcatgataacttataggcctgataaacaacatgaattggagatactgcagacttgtcctctgttgaaaaaaatagaattaatttttgtcaattcactggtaccaattttcgacggaaataatagcgttgggagggatggaagtttcaatgtgatggcccgtcatactaatatgcagatatccactgcggataatgatgaacagggaatagtagaagaaaaggtgatttatagtgagctagagaagataacattgatatgtgataagaagaaaattaagaattttccactttgtcgtgctctattaagaggccagtttcctctattgcagaaactgacgataactggtgtaacatttcctatgaataatcaagacataatgaattttcaatggctattgaacttcccagacctaaaagaactatggatagaagataacgacaactgtgaactcagtaagtttttgcaattgttaaaattttcgaatgtctggaaaaacttggaaaagttaacctttagagagaacaagctatatccaattgttaatttggatgaagatcagcctgttacgaatgacgacgaggtgccatccatgctattttacaaggaaaatctccaaaacctggaaaagttggatctaatggggacatcgataagtggttctgcgttgactagattatgcgagcaggaatacttggatggtcggaaattaagaagtttaaacattgggaattgccccaacatccagttcccaaataatcacgctcatacagcaaggatgatactggatgtgaatgcagttttgaagagactctccaagttggaagaaataaatttatcgcatctcagctccttgaatgatagtacgatgaagtcattcattattaatgtaccatttttggaaaatttaaagaggcttgacatttcgcacaattttgaaattacaggaatatcaatatatgaatttctaaaaaaatttcagatggatcatgacaacgaagcgggaggtcaaccactggcatatttaaatattgacggatgttcccaagtgtctcatatcacagttaatatgatccgagcgcagaacttagttactcaagtggattgtgtttatgaaagagatgtatggagaaaatttggaattaattcatattcatactcatagattaataaatcactgatgataatgcagtatccttcggaaaattcttagaatatttaatataacaaaatggcatgtaccttttggagttgatggaggtgagaatatagaaagctttttatataaaaatgtacttattgtctttcatttcaattttgaaaaatgtctgaattgttcatgaaattgtcgtttgtggcagccgacatagcgtccatggggaacctgcttggattgaataaagtgttatcaaatgaaccgttttcaatagccggtatgggaaaatcttctgagtttgtttgaacatcataagaggaaattgttccagatttttttctatttttcctcatctctgccgacatattttgattataataagaagatctttttttgaattgaggtcgtgatggaaccttcaatggtgatttctttagccgtaaactagatgcaccgatggcaaacgataaagaatttgccttctgccttgtaccctgctgcgtgaatgaagattttgaacgttgtggagatgtagaaggcgatggagaaggcgataacatatccattttcctcttgttgaaggtagaagatggagaaggcaatggctgaagaggaaatcttcccggtgccgctgttttgttgggagacttgataattgatagtgaattggaggaggattcttccaagtcaactcccggcaagtcagcatccattatggaaagagatttgatttgctcactgaatcgaggttggtagaattgtaaagggttttttattgacgaagagattattattttctcctttaggaatgtgatggccttatccaaggcgaattcttggccacagttattttgaatcatggaaattttcggccaagtagctcttgcacctaaagtagtttggtgcaataggaaaagttgagatgggttcttcaatacttcgtggaattgaccaaccattgatagatcgggtaaaattgtgacattgccagagtattgttgtaaaaaaaggtgtttcaatttggtcatcaaatagggatggaactcaagctcctttaggatgtctaaaaaatgaatagtttcgtcggaaaaaaatttgaagatctttgttacttggtttctgaaacgggcggtaatttccttttcaatttcacccccaacgcaagtgtttgaaaactttaacaggggaaagacatgtatatttacctggcaggcgataatgtggtcgacattgaacatttcagaaagacgagaaatgggcatgtcattatctacagatccgtccatgaatttcatgtttgataaatgtaaatttgttgccccccactctttaatctttccagtgtgaggatctttctcgaatagcggcgtggaggggaaaactccaggtagagaacaagatgcgcatacggcagaccagatgagaacgtttggagcggttaaattgtttagtagtttcggctgttcgtatatggaagcaggcgagactgtgatattcaggatttttccagtcttgttgtaggcttccctaaaggtcaagtttcctaaaaacgaaagcattgtgttaatcaaaggttgattattgaaccaggtaccgttttggcagaacctcgatatcttgattagtaagttttcgttgggagatttggaattgtcgtcattgaagatgttaaactccatattaagtacattggtcaacaaggagggaatttcctgggtcgtgtggacgcaaaatatgctggcaacaatggcgccagcactgctaccgctgatcaccttaggcatcaggtccgattcaaaaagggcggcaagaacaccaatgtggaaaaggccgaaagtgctcccaccgctaagcacgagagccgtgcgccctatgtttcttctcgtctgttgcaaaataccgaggagatagtgatcgttcatatttgactgatggatcagcgcggtgagcactgcttgagactcttctaggtagtcatgtataatttgttttgtgccggtatgcgagtgcctgtaaagattaacgttattcatgttgccaagattacggacccacttagttctaatcagataaagcaggcggtggtagtcgtgagtggttctcaaatggcgcatacggatggtcaagtcttgcagcagcttatagttatacaacgaggactcgtcgattgttttccattcggaaagtcccgttaagtcgtctaatcgcgacgctatgtcattccattgatcgtaggagatggcgtgttttttctgggaagacaaatcggatatgagcagctgtttacgggagagagtcttgtggtataaccatttgaagagcgatgatgagtctgtggcaggagtgttggaaagttcgtagtatttggataaaagaaattctgttactggcaaggtattagacatagcaacgaaacagaaccgtcttccttgtgctgtttatgatgtcttttgtctcctattgttttcgaattttatttttttttttttttatttttttatttttttttgttttatataattcctcgcgctgccttaatgataattcttgatttactaattgtttcatgacttctggtgctaaagggaagggggaaaagggaagcgaaaacttcaagagcagaacgaaaaaaataaaaaaaacaaaacaaaacaaaacaaaacaaaggcaaaacaaggcaaagaacctgatggaagaaagcacaaccagatattaatagcaacgaaaaatagtagagacattgaagaatatgagtttgagaacgccgaagagaagcaggactagcgatgaacaagaacaagaacaagaacaagagcaggtacagaacccagatacacatgtaaacaacgagcatcagcagcgacctgggccaaccactctattgagcacgccagtacgtctcaaaaatggctttggaacaccatcgccgccgtcaccaccaggcataacgaaaagcatcactaaatcgagaagaaggccgtcgacaacgagtcttcagggtatattcatgtcgcccgtcaataagcgtcgtgtcggcataaccgcacatggacgtgtatatgaccataacgacgacggacacgaaagtgagagtgaggacgacgaaaatgaagaagaaaatgaaaatcaaaagaagtacgacggacacgttagtatgcctttgttgccaccgacaacgcccaagtcaagacggtcggaggtgtttctgtcgccgtcgccgcgtttgaggtcacctccgacggctgcgcgtcggtctacgggcgagcggcccatccgcgaaatatcacatactttgcgcaccaggctcaattacgcgttagtcaagctgcaaaatggatggacggacaagacacttcccgagctggagacggagcttgctccagcagtgcagacgccgccacgtcgctatcacaacagatttccagatagtgcagacgcgggtacttccgcgcatacagcgtttcttcaggcgctcggaggccacccaccacgggaggaggccacggctgtcgaaacactgatgctattgtcgtcgcctaccaagaagcaacaacaccgacccgtgccggcgacatctgctggagaacccacggacgaaacggagcccgagtcggataccgaagtggagacgtcttaatgtggtagtacgagttttttctccgcaatctcggagttagtgcagccgcgcccgctgctgcaccctttagcatatatataaagtgcgtaatgtgcgtgctaaaaaagctcactagtgcgtactctgcttatctctgcgtatccgccgatcaacatccgcggctaaaatggaacagaacaggttcaagaaagaaacgaaaacttgtagcgctagctggccgcgcgcaccgcagtcgacgctgtgtgcgacagatcgcctcgagctcacatacgatgtgtacactagcgcagagcggcaacgccgctctcgcactgccactaggcttaaccttgtgtttttgcacggcagcggcatgagtaaggtggtatgggagtactatttgccgcgtctggtagccgccgatgcggagggcaattatgccatcgacaaggttttgttgatcgaccaggttaaccacggtgattctgcggtacgcaaccgcggcagactcggcaccaatttcaactggatcgacggggcccgcgacgtgctcaagattgccacatgcgagttgggcagtattgacagccacccggcactaaacgtagtcatcggccactcgatgggcgggttccaggctcttgcgtgtgacgtcctgcagcccaatctgtttcatttgctcatcttgatcgagcctgtagtaatcacacggaaagccatcggcgccgggaggccagggcttccgcccgattctccgcagatcccagaaaatctttataactccctacgtttaaagacgtgcgaccatttcgctaacgagtccgaatatgtaaaatatatgaggaacggttccttttttaccaatgcgcacagccaaatcctgcaaaacatcatcgattttgagaggacaaaagcctctggagacgatgaagatggtggacccgttcgcacgaagatggagcaggctcaaaatctcctctgctacatgaacatgcagacttttgcgcctttcctgatcagcaatgtgaagtttgtgaggaagcggactatccacattgtgggcgcgcgctccaactggtgtcctccgcaaaatcagctgtttttgcagaaaactctacagaactaccatctcgatgtcattcccggcggctcccacttggtcaacgttgaggctccggacctggtgatcgagaggattaatcaccacatccacgagtttgtccttacctccccgctgcagtcctcacacattccgcaattgacccttgaagaaagagcggtgatgtttgaccgggctttcgactcgttcaagaatgaagctttggttaaaacgactaaacaaaaactgtaaacacttgtgtacactattacatatattattcaataataattaactgacgcaatctatggcactggcgtggtttctttttcttttgttttccgtgcaagcgcgatgcaactatatcgtcgaggacgaatgtgtacccgtctttccgccagacaggtaacaagtacttcaattgacttagaagaaaaacattaaggaactttaacgtaggagcaacacaataccaggcacacgctcttcgaacactgaaccacacgcgtccgcatcaaactcttcctcccaaacatgaattggctgtttttggtctcgctggttttcttctgcggcgtgtcaacccatcctgccctggcaatgtccagcaacagactactaaagctggctaataaatctcccaagaaaattatacctctgaaggactcaagttttgaaaacatcttggcaccacctcacgaaaatgcctatatagttgctctgtttactgccacagcgcccgaaattggctgttctctgtgtctcgagctagaatccgaatacgacaccatagtggcctcctggtttgatgatcatccggatgcaaaatcgtccaattccgatacatctattttcttcacaaaggtcaatttggaggacccttctaagaccattcctaaagcgttccagtttttccaactaaacaatgttcctagattgttcatcttcaaaccaaactctccctctattctggaccacagcgtgatcagtatttccactgatactggctcagaaagaatgaagcaaatcatacaagccattaagcagttctcgcaagtaaacgacttctctttacacttacctatggactggactccaattattacctcgacaataattaccttcatcaccgtcttactcttcaaaaagcagtccaaactcatgttctccatcatatcttccaggatcatctgggcaaccttgtcaacttttttcatcatttgcatgatcagtgcctatatgttcaaccaaatcaggaatacccaattggcaggcgttggtcctaagggcgaggttatgtatttcttgcccaatgaattccaacaccaattcgccattgaaactcaagtcatggttcttatttacggaacattggccgcgttggttgtcgtattggtcaagggtatacaattcttgcggtctcatttgtatccagagaccaagaaagcgtacttcattgatgctattttggcctccttttgtgccttattcatttatgtcttctttgctgctttgacaaccgtgttcacgataaagagtcctgcttacccttttcctttactaaggttatcggcaccattcaaataagtcagtttttttttttgttttcaccataacaaagagatggaaagttatactagataaagatttttaaaaaatataaaagaaaataaaacgaaatttatattttacacagtgcatcttgtccctctctttctcgctaaaacttagtttcttcttcgcccatctcatgattcttcttatggtttgtgaggctgcctagtccaccgaatacccctttcttgatcttgccaatggcaccaacaccgccgcctatcacggtcgtaccagctttcaaaccagtacctagtcccttggatgctatatctccgaccttcttttctcttttactcacgctaatggtgtatcttggcttaaagctgaaagctaaatgcaacataccaccgtcttgaccagcgttctctaatccttctaccggtacgtctaattcggtagtaccctcgactttgaccttattcaatgggatttctgctgtaccaatggtatcatccgcagatgtggaatcccagtccatgactttgattcttagaacatcatttaaacggttattgatttgaatagttccttcatcattccatttaggattcaaagttttcttaacaaccttcgtcttgtaagcgcagtcttcctcattattgatgtaatactttaagtatgggtccgaataaccatttaaatcggatgctatcaagttttctgcactcctcgacataatcgtcaaatcaccagaatttgtgatcaggtcatttgccggcaactgttttgtatcaatagggaaccatgatatttggagcattagtttagcactgccttcacctgaaagatgtaatattgatggcttataataacagttcttaactaactcttgtgtgggtagttctacttcacaaacgcatttctccactctgttgtagtttttatttttagcaactctaaaagtggtaatggatttgtccaattcttttatgatcacgtcacctgaccaaccattcttgacaattctcgatggaatacgtggactaacaaatcttggatgaccattatcatcgaaaaacgcttggacgtatagcccagagtcgggcaattccccattaaggacagtgacagcaagaacaccttggttgtattgcaataattctggcaaatccaatttctgtctattactatacatgtcttccaattctttgacctcattccattcttgatcaaatttggctttgtcttctttagaaatttttttctcatcaattgctgacttacgcagttccaatgcttttttctttttgttaactttatctaaatcttggatttcctctaacgttaaaacaggtaaagcgggataaaaggaggtatagtatgttatagtgcccttaggttttttcttaggcatcactagacgaccaactttagctttttcatcaatagtttcctcatatttatcattctcatccttcttaaataaatcttgaacgttaacattgaattcaccaagtgaacgatctttgttgactgtttcgacatccatacattgaagcgtaattctttggtttggtgaagtaactgcaacataaataacttgattccagacaggattcaaagtttggctcttgaaatcagttctacccttcgataaaccattaaccaaaactttacagtatggatcaatggtaccaaacttttccaaatttctcaaatcgtttgccttctcaatgaatactctgatggcgccaattggtggcgtgtaagctacagagttggaaccaatctccagtctaacaggtctccaatatgtggtaatctttatgtcacccttttggttttttaatggaatcaaatttttgttcacttggcttctatctattaaatcattcagggtttgaatggtagatccaatttcttctcctttgccatccttgacgacaaacttatatcttgttttacgacgatctgcaataactgcttcgtagtctgaattccacttcaatgtaccagtgtcagttgccttaccagtggttaacactagtttagcattcaagtaaacttcaacgtaggcagtaaccttctgttcttcttcagcaaaacgagaaccttcttcgaccacaactttagcaataccagtattcaaatccggtagttcctccacagatccatccggcaactttttctcttctaaagttgggaagaatcttaaatcaaaagtcaattccccaaccggtttagagtttcttaaaaactgagctttcaagtttctttgcgtggttttatcatgtaaagtattcaagttgtactgaattctgcctaggactttatccttcaattttgcacgcttatcataaacactaatggtcaaggggtcagtgaatgagtttaacaagacgtacagagtttcgtcccaaacggggttcaatgtgtctcttacggttcttgtcttggcaatagatatatcgttaaattcgaaagataagtaagggtcgattgattcgttcaatatcgaagaggtacgttttagcccctttgcatttttgacagttatttctaatataccaatggacaagttggaaccagataagagttgtggaatgttcaattgtaaagaaaatggaggtaacaagattggacccatatatttcttggccatcttttgtattagtgtcataaggcctgggatagctaaaatttcccaattgaagatggaacggccgaataaggtagcaacaaaatcaaaatcaggaaccttcagtagctggatattaacagtttcgacatgagggaagggagtcatcaatttgaatttcactctagcatgagccttgaaagcaatgtctgacacagaaacagggatggtgataccaaaaattttggccttaacaaccgctaattcattaacgtaatttctgacttgcttagcactcatgtcgcataaatcgtgaggagtaaaagaaataccccagtccatcacaacaacatcggatgcagtgttttggaaagtcttcaccaaatcaactctggggggtttaacaccaagtgtcaactcatcgatccatagttgagtaataaatttgggaatcgcctcattagtagccatttgttcattagcttgctgaacgattaattgactaacggaaggttctaaaatgggccagtacttatccaaaaaggcattcaaccattctagggattcatagtcgttttccactttctgcaccgtgaactctttctggactaactctcttatggaacctctgtattttttagcagaggttctatacaacaatgaagtgataacgatgacaaaaaaggccgaccccattgaaaacttataatgaccaagtgcaaatgatgccacgcctccgataaagaaaatggctaccgaatgataccagtcaccgtaaaggctgtccggtatgatgttatctaagaaggtttctctagtcatatccatcaattcatcatctaaagttaattcgtctttgtcttcccagccaccaatctgtttccagccgacataagaagcttcatggatacttctcttgaagctttcatcactagcatgtgccgccttctcagatgacacgcttttactggattcggtttcctctttcgtctttggaggttctaacttatctatcccatttatgttagctacttgggctgtttcgggcttctttggtgctgttaccccagtatcttctttggccatattgtatgtaccacgcaattgaagttttcagaatgcactagctatctttttttatcttagctattcttcttcaattatcctacttattcttcagcaaaaaaaaaataataagctaagacaatgctatacaagtcaattaccagccagtaagtccaaattggagtagccaatgctattagttgataattttgacggccgattatactattccaattgcagcaacatccctgtcccttagctttttgaggggccttttgttataatttttcatgcagcattccggtcgccaaagttgttatcacttctaacgtaaatcgttttctcgttatgtccgctattttagaatgagaataatggataaaattggcctaaaaagggagcgagtataacgttactgagatacaattgtacattttgccatggaaatgagccaactagtctaatgagattttcaatgctttatttctttttttagtttctcattttattgtttctctagttattagtcctttggttatttttatgtcaccacctcttgtcacatgaccatttttgttacttgcttggttttacaatgatttatacattcttgggcctctcttgacatatttttatcgtcataataagttcttcattcgttctctaaaacaacaaagttagactccatggccaagttggttaaggcgtgcgactgttaatcgcaagatcgtgagttcaaccctcactggggtcgttaattttttaatttttctcctacactgttgctatgtcggagttatctcataagagctgaaaatatgtggtaaatttagtcagtatccttcgaggatcagctagagcctattcaatgcaattgtcattaatcagtggcttggtaaggcaatagaattcagttataaaatataatattactagaacaggagcattatggtatcagccaacggcgacttgcacttgccaatttctaacgaacagtgcatgccggaaaacaatggatctcttggatttgaggcccccactccgagacagattctcagggttacgttaaatttgaaatacttaattgataaggtcgtacctattgtttacgatcccaatgatattgtttgtgaccattctgagattttatctccaaaagttgtgaagctggcttatgaagcatgtggcgggaaccctaaagacaaggccaacaaaagaaaatatcaatctgtcattattttttcacttcttaaagtttgtgagtggtattccatattggccactatggaagtgcacaatgccaaactttacgaaaccagaaatttagcctcacaacagttatgtaaattgttaattgaaagggaggagacaagagacctgcagtttcttttcatgcagttactgctgcgtcggtacgtaatcaacgagaacgatgaagatcaagaaccgttgaatgccttggaacttgccacagatatgcactgtactacagtgataggatcgagtggatttcagcgttgtttaaaatggatatggagaggatggatagtccaaaatggcttggatcccacaacttttatcaaggacgattcactggcggaagtgtcattgatctctcatttcaaccccgtaagattaaaggcgcctgtataccaaaattatttgcagatgatcttctcattttgtttctagggctttataccttggtggttaatggtaaggactctgagagagtccaatctttcgatttgttagaaagcatattttatgttttcaatactggtttcatcttggatgagctcactaagctttattatattggttatgcgcacctatcgttttggaatttatttaatgataccacatatttgataatcacgtttgctatggggttccgtgcaatgagcgtaacgccccttaatgcaaaatactcttcagaagattgggataaaatatcatatagagtcttatcctgtgcagcaccatttgtgtggtcgagactcctactataccttgaatcacaaaggtttattgggattatgttggttatcctaaaacatatgatgaaagaatccattgtatttttcttccttctattcttaataatgataggattcactcaaggtttcttaggtttggattccgcagatggtaagagagatatcaccggacccatcctgggtaatttaacaatcaccgttttgggtcttggtagttttgatgttttcgaagaattcgctcccccatatgcggcaatactgtattatggttactattttattgtttcggttatccttttgaatatattaattgctttgtattcgactgcgtaccaaaaagttattgacaatgcagatgacgagtacatggctttgatgtcacaaaagacgttgagatacattagagcacctgatgaagatgtctatgtttctccattgaacttaattgaagtgttcatgacacctatctttcgtattcttccaccgaagcgtgctaaagatttgagctatactgtaatgacaatagtgtacagcccatttttgttgcttatttctgttaaagaaactcgggaggctagaaggataaaatataacaggatgaaaaggttaaacgatgatgccaatgaatatgatactccatgggatttgacagatggctacttggatgatgatgacggtttgttttctgataaccgaaattctggcatgagagccacccagttaaagaattcccgttcgctaaaactgcaaagaacagcagagcaggaagatgtccattttaaagtccctaagaagtggtataaaaacgttaaaaaatgcagtccctccttcgaacagtatgataacgatgacactgaagatgatgctggtgaagataaagatgaagtcaaagagctcactaagaaagtggaaaacttgacagctgtaattaccgatctactcgaaaaattagacataaaggataagaaagagtaaacgacatgtgttcaaatactgcttaattaatttctcagaaatccatatatatatatatatattgctcctcattgcaactttgtaaatttaatgttcctttaatttatcattatttacaatattaactaatccatctcccgattttcggcataaaataagtttatattttggtctacatgaaaacaaaagtttaactaaactaacgtgtacaaaccactttgaaacgtatataaaggtctaataaaaacgactggcgttttgaaagataatataatgatctaatgcagttaaaaaatttacaaattataagaagaaaagaaaaacaacgattacggtaaaaaatgaaaactccctctcctttctaggtacgataaattatgactttcatctttcccgttttgaagatctatttatctcaatttgcccagactttttttttatatatatttattttcccctctctaacaactgcaagcactgtttgcgctggtcccatcattagcagcgttcaaatccactctttgattgttcgactcacgttcgttacttgcactattttgctcttcagccgtcttcagtggtatcttttcaccgattcccaaaaatacatcgttaacattctctcctgtctttgcacttgtttcaaagaacaacaagcccttttcttccgctagcttttcaccttcttcccttgcgacttttctttccccaccttcttgcagcatatcgatcttgttaccaactaacgcaatgatgatatcctttgatgcctgttcatgtaattccttaacccagtggcgcgctttaataaaggattgtggttttgtaacgtcgtatactacaagagcagcttgtgcgtttctatagtacataggtgctaaagatgcaaatctctcttgcccagcagtgtcccatatttcaaacttaacagtatgttcatttatagtaactctttgagtgaggaatgctgcaccaatggtgggctccttattttcggcaaaatcattagatacaaaccttaggactattgacgatttaccaactgctgcctcacccaacagtaccaactttatggaagtgactgatgtgttcatttttttgtgtgataaaagggatatttttttatagcttagataagtcgacgatcttgctttttatttttaaaatcgttgccacttttataagataagctgctcgtattttcacctcacttctctttctttgtcttttcggggatattgttttagcaaaaagccccataatgcaaaccgagaaaaccaaaaaaaaaaaaaacacgtatgaggtgacaagaaactagataatcagcagactaatatctataaaataaatcctctggtatatacctacctcagcataagtttatatcgtcataatctaggttttggctttgttgttgcctccgggttcataactattgaagtagcattggagacaattgagggtgttccagaatcaccaaagaacgccactgttactgtcaagtcatctctgtatcttctactcatcggcgatggtatacttaccaatgccgatacatattcttttcttccgcccgcacttaatgcatttctaattaaatgagtggcgacgtttttgtcttcaataagatactctgggtttgatcctgatggtgagctcgaattattatccttgtacctgaatgccggtctttgtgcttccttgtcttcagatacatcgataacttttggtaatttccccggttctgccttcacaggtgccagattcatatttttatccatccacctgataaccaaggaagcaatttcttcattagttagtaattcgaataaaccatccgaacccatcaccataaatttagtgttctcaccaattttggcagaagtaatcactggttccgcagtgacatatgggggtgtcttgaaatcccttggctctcttctaaaataaagtttggcaacttcaggcaaatccgataatggttttccatcgacttctttgatcttgtagcgatagtctccaaatgccctggatggttgtaatgaacccaatattcttccgtttcttataacgtttggttctcctggatgttctttcctaattctccgtacttcatccaaattatcaccggtctggtcggtggatagcgactttaccgtccaattgccctcgttgtccaaaccacaaattaaagcccttgagtctccagtgacagccactttcaaaattgagttagtggagttgtataaacttaatagtgcacaagaaccagaaatcgctggtaaagtgtttgcaatatttgtgttgtttggatcttgaaacagcttcctgaacgattcgattacaagatcattatctagtttcaaaaaacctttcgaaattgcagaatcgattaattggttggggtcggaatggaaaaccgttttgttctggtcatatacctgacctaattgatacgctacataacggactagatctttagataatttttccgaagtgaaaggaccaccatgtccatcaaaaattccaaaaaaatacaaatccttctctatggacttgccatcctcactttctatcggaatggtaatgatttgttctacgtgatcgtcttctattggatggttagagggcaactgtgccacatcatacctgaatataccagtgccacggttaacaaaatggctttcctctctatcatgtagtttagcctctattttagaatcgttcaagataagaacagattggtcattctgagaccgttgactcttttgtgtctctgttccttttggattaggtgacggcatgttaatgttaccactagtatttgtagaataatcttttattccgttaattgtatcaagggagaggatctttttaggggaatagtaggagtaggtcaacagtagggacccgcttagtagagcaatgtttagagctttagaatgtgatgatatgaatagctttgtccttgaatagtatgtgctgttggcatgtgatgttgaatatgcacgttggagaaacttctgtgtgtattctctaccagattgacatttagatagaaccttaaccgttttctttatagctacggttctagttaagggagacatggagagattgagagaagtaaaagcacttcttctgttgaaaaatttcagtagagcacaaattcaattaaagtagcaatagatgtttcttttcctgcctatcacacgatttcgtttaccctccaatcgatccttttttcttttttgtatcttgtgtagaaagaagtgaatcctgtttttctacataatgaagggccggtaactgctcattactgagttttaaagtagaaaataaaaatgtatgcaattggtcgccaatacctgataactaagaatgtaactatgcaagggataaggaaatttagtcaatgctgcccatcacaccctgaacagcacaagattgcaacctctgagagtatttcttaagttggagactagtggaggaaatgaattggcacgtagctcgtcgaacatgatgaactgtgatgataatgaaaaaatttttgttccccagcgatgagttagtgaaaatcgacaatatatctttttttaatcaatgtgttttactatttctagaaagcaagggaagccactctattagtaaacctctgggctttacacatataaaatcgcaggaaagttatatttcgaagatgccaccaaaaaagggaaaacaggcccaagcggctggtaagaagaaggataatgtcgacaagacgttcggtatgaagaacaagaaccgttctaccaaagtccaaaaatacatcaaacaagtgcaatcacaatccgaccccaagaaagaagagatgaggttaaagaaactcgaagaaaaaaagcgcagagaagccgaagaagctgaacgaagagcactattcaaccctgtagcagaccaaagggttcgtgcgggtgtagatcccaagtccatggtttgtgctctgttcaaactggggaattgtaacaaaggtgccaaatgtaagttctcacatgacttgaacgtcggtagaagaatggaaaagaaagatttataccaagatacaagaagtgaaaaggaaaatgacacaatggacaactgggatgaagaaaagctgagaaaagttatcctgtcgaagcacggtaacccaaagaccaccaccgacaaagtatgcaaatacttcatcgaggccgtggaaaacggtaaatacggttggttttggatttgtcctaacggaggtgacaaatgtatgtacagacactccctaccagagggctttgtgctgaaaaccaacgagcaaaagaggctcgagagggagtcgctcgagaaacagccaaaaattacgctggaggagtttatcgaaacagaaagagggaaactagacaaatccaagctaacaccaataacaattgccaacttcgcccaatggaagaaggaccacgtcatcgcaaagattaacgctgaaaagaagttatctagtaagaggaaacctactggtagagaaatcattcttaagatgagcgccgaaaacaagtcatttgagacggacaacgccgacatgccagacgacgtcacccagggatccgcatgggatcttactgaattcacagatgccttgaagaaggctgaccaccaagacgacggcggcatcaaggactacggtgacggtagcaaccccaccttcgacatcaaaaaagccaactccgccacgctcgcatagtctaaaattcatatagactaaactgtatatatgccaccgtatatataatacacgcacacacaccaacacaaagcatgtcacgtcatgtagctgatcacgcagcacgaccgcggcccatgcttatctgccgtctttttgcccctttcgatatcccacgccccacgcccccacgttgttgaggtgttttttcacctcggatccgcccgacaatatctgggattaaaagtgctcgagttttgctctctatttcacaatcggtgatagttgagcttcctttcactgcatctctttgcagcctcgggggatgaggctatatacttagagggcctgaatatatgtttgacgcatccctccttcgtacgctaccatctgttactcttgcaccgttattatatgcttgtaatttttgttatataataggcctttcattgtttttaatatagactttcatcatagggcatccggaatttcttctcagaagcctcgcaatttttctttatattaggtttttcagactttacatttgtacagaaactgcgtattgttgaccattaccgagaggaagataaaaaggcatagatagttaagtttagcattatagaaccaacacaaacaaaacaatagaagacaaagagtaagttcaagacaagtagacaatgacacacatcacactgggacaagccatctgggcctctgtcagaccaatcatcaaaatctatctgattattggtgtaggcttcggtttatgcaagatgaacatcttaaccgttcaggccacaaggtccatctctgatatcgttttaacaattctgcttccttgtttatcattcaataaaatcgtagcaaatatagaagataacgatatcaaagatgtcggcattatttgtctgacgtctgttatactgttcgcaactggcttggggtttgcctttattgttcgcagtgtgctgcctgttcctaagagatggcgtggtggtatacttgcaggaggtatgtttcccaatatcagcgatctacccatcgcctatttgcaatccatggaccaagggtttatatttacagaagcagaaggtgagaaaggtgttgccaacgttatcatctttctggccatgtttttgatatgtgttttcaatttaggtggtttcagactaattgaaaacgatttccattacaaaggtgatgacgatgaagaaaatacgttgaccaatgatgattctgcccaacagccaacacaaccaattgaaggcaattcttcttcttcatccaaccaagatatcctgaaagagcccaacgagtctaccgttcctaacagttcacaagcaagctacatttctgagaaaaataaaaaagaaaaaactgaactctctgtccccaagcctacacatactgcccctccagcaatagatgacaggagctcgaactcatccgcggtggtctctatcgatagcattacacactcactacgcacaaaccatgtggatgcccaatctgtaagcgagcttaacgatcctacttacagaactagaagtcaaccaatagcatacactaccgagtcaagaacatcacatgttcataataaccgcaggaattccatcactggctccttacgttccatcgatatgcgtgaactacccgcggaaggcatgtcggatttaattcgtgaatactccaatgttgatcaatacggtagaagaaggaaaagttctatcagctcccaaggagcaccctctgttttgcaggcagacggtactatttctccaaatttgactagaacctccactttacaaagagtcaaaacttccaacctaacaagaataatcacctcagatgccactgttagtaagaaagatattgagacttccggttcctctttaccaaaatggctacagaaatttcccttaacaaaatttttcgtcttttttctaaaaaattgtctaaggccttgttccatggctgttatcctggctttgattatcgcttttattccctgggtaaaagcccttttcgttacgaccagtaatacaccaaaaatcaaacaagccccagataatgcacctgctctaactttcattatggattttacatcttatgttggagccgcttcagttcccttcggtttgattcttttaggcgctactcttggtagattgaaaattggaaaattataccctggtttctggaaatccgcagtggtattagtctttctcagacaatgtatcatgccgatctttggtgtcttgtggtgtgaccgtctagtgaaagcgggatggctaaattgggaaaacgacaagatgttattgtttgttaccgccattacttggaacttaccaacaatgaccaccttaatctacttcactgcaagttatacccctgaggacgaaactgaacccgttcaaatggaatgtacctctttctttttgatgcttcaatatcctttgatggtcgttagtttaccatttttggtgtcttatttcatcaaagttcaaatgaaattataaagttcgttaaggaagaaacaagatctattcatgcattcccattctcattctcataatttcatttcatcgtacaactgaatcagggtgtaattttatagttgtttgttggtctttttttatcaacgtagaattcacttatttcagattttatagagtttcatagtataaaaataataatgaaaacaaaacttcatgctttttcttctgtttatacaatttcacttttgattgttattcaaaaaaataacatttagtcgcagcttctcagtgttactaatctttttcttcttttttcgaacataagattttctgatggaacgaaaaaaggtgatcttttaattatttgtgaatcataaatatccttttcattaatttttaagtggtatagcgtatttacatataaaacatacatgattatttcatgtttataatcaaaaattataaataattatttaatctctaatatagattaattagagtctttccacaactcagtagcatccaatagtcatgacaaatttactgtacttggatgtgttaaatattgtccttttcataatctgataataaataaatggaaatattttcaccatagtttatgccaaattgtgcttctatttgaattttctgatcaaaccaggcttgcattatcgatgctctatttttcgcccaaacttccattatcatactagaattttttgggcttatacctttagttctcacaaatgtgcataaatctaaaatgacaccatgcttatttaacaactctgaaacaattaaagtcgttagattacccaagatgggattatgtcgttccttacacctaattaagcacactaataatccacctgctttggcaatcaaacaactaccaatgtcactgtgaacatctttaacggttctctccaaatcactaacaaaatgtgtcaatcctagaatttcaatggattcatgaatacttcccaaaacaaacaacaagttcaaattgacgacctctccctgtgaattcgtgcaacttacgtttttgataaagcccagatcaccagttctcaaatagcttaaagtgttattcacttcgctcttcatcttacttttgaattgttctgtgataaagggatctttgtacaacttgttttttgaactgttacacacaaagtagtcgaatgcattagcttccgaacagcaccaaatctcaccgaattctccatcaacacatggtaggagtgtctctggattaactactgaaacgtcagtacatacaggaacaacaccagaatcttgaatcttgatatagtttccagcacttacatcattggggttgacttctctaattataccttccctcagtgaaaatgggtctaaatataggtcaaccggaggaatatccagatacgaccttaatgatataagcggattgaagtgatgttgatagacataacttatttgtgtacatgatagggatatggttgagtaccgttttaaaatattttcaattgtataaatccttggtctattaggaaaaggtatcatgatatttcgaacacccttgaaaacatcttctctaagcgagccagatgtattgtttttggcagagtttatattctccttcttatttttgaatccctcaatcaaactagaggctctatccagtaaagcatataacgtttcaagcttcaaatataaatcttttacgtttaaattttgaaggccaattaaaaactccttagggtcagtaagaacatcagtaaggctgaataagcaagttgaagcacccgtataaattcctaacaaacagctgaacataaagcccaatccagatgtatgagaacatatagagaaaagtggactattatttcttaactgcaaagtttctttgactattttgcttgcattcagtaaagacgaatgtgtcattgttacgtgaatattagatgttacatcatactctgtatttacccatacaacacacggtgtcataccaatcctagtacctggtttggccccaaatttctgctttaacacattcttaaacatagatactgttaacgcattctttgtcttgacttttgagaaaactgtaatcttgggtatcaaacttttgtatttcttaaaacatttgtttacgacattattatcattcaacaatgagtgcaatttagcatcaacaaatactcttttcactttgtaactttgaataatattaaccaagccttttaggtcctcttctatgacagactccttaacgcttggtaggggaattaccaataagttacagtacaggcaggccatgatcatcgctacgtattcaaccgaattttcacacataataataatagggtcaccatgcttcaatggaattttagaacctacgatttttttcaaaaagcctgcgacaattttaccaaaacttgcccatgatacctttttgtgaacgttattatcgttactagctgaagagttgactaggtttgtgtttgtaccatcactgaacgccgtttcgttcccataattagaaattctccattccagaatctctaaaatcgatttgaagtctgtgagttttgtatggcttcgagtgtcaacagactcatctctgtaatcaacaccactgcattgtagggcaagttttggtttaacgggaccgccattacgatatgctggttcgatcatagcgtattcttcttgtaaagccatctttctcaattttgataaatgctcggataatatactctcattatagtacgctgaatggggcaaaaaatccaatatgacattatcgaattgaaactttacaaactgtgcactgagatcattgtttaaaaacttcttctctaccgtgctattggccaattccagagaacaatatctcctaggtaaagtatctctcggcacaactaaaatgcacattggttggattttatgaaaaatccaaagaattctaaaaatttggtcagttaaatcattcattttcgtttctaatttgttcctctgtgtttctgcaaatttcattaaggtagtatctgttgtttcgccatttttactctcttcttcggtttttgctagggagctttctaccaccataactaaaaagtgctcttctttatggtgttgtaattcaaatgcagcaacctcaaaaactgtatttactgtcctcacaactgtttcagtaatctgttgtagatagtgggattcaacaactcttttgtatcccgaagatgtttcgccacttaaactcgaaatatcaatagccttagtgctttctgctccagtgttacctttaggttgagcagattgattcccttttttggcataaagaaggtttgatgtgtgagcccagttaggtaatctgattaatctattctgtaaaaacatatcttctatgagtgaaagcacgtatatctttccgttatgaacaaaccccataagcttggttctcataaagtaggtatttgcaggacaaatattcagaatggtatccaattgttcagtaactgcttgcgatttttcgttagtaggcatttcatactttgcccaagaaaacatttcggagtaatttagttttgctttgaacacaaattcgttcactttatccatctggtaaaattcgtcggtgatgtggttagaagagatccatatttctccaacagtgaggtcttgcaccaacgtattcgtatctggattaaccacacataaagtgatatcaggaattgggaagccaaatgtttctaatttaagataatctttgaaggagcttgatgaattaatcatagcagttatgctacattcaacctcattaagcttcaatttctcgcggtttataaacaattcattttgaagccttagttttgaattatgtattggaaagttctctaggtttcctaattgatctcttatagatataaagataccaccaaagtccaataacgttaacatgggagaataacaaaatggtgcatcaatacatcctaaatttttcagccatttatgaacaaccatctcgcttacatcggtatctatagtggtacatgaggttaaacatgacttgatgcaactgaaatctattttgtgcttcttggaaaaagctgattcgggattttccaaataattaataactacctgcttcaattgtagctgatcattcagtaaaatgtcggctctaaatttatcaatgatattttcatagcccccaggtcgttgtaatatactactatcgatagatatcataagattaccagtaaaaagattgaaaagcacacccattatcaaaccagtagatctagtagggtccagactattcaagataacaaaccttgagttggttgccataatttttttgtgaaatggcttcctgatgctttgtgatttttgtttccagtgaggcattgatcgtgagtttagaatttttgtcatcgtttcaaattggtttattaagatgttatgcttcatgacgacgccagaaagacgacctagcggtgttctagtaaactctatatatgaaatattcggtatatcaaaggtaggcgaagttttttttgcctttgtgtacgtccctaagtcatcagtcttgacaaatttgatttgctggaaaacatcgttcttaaccagtttaacttttgaatgatttgatgacgaatacaagttatctaattgtctatgacatgcgttagaaatcagaacaaatttcgaatttgttactttaattatctcaaggatctcacgcagagaatacgtttcgaatgagactggtacagctgccatgccggatatgaaacagcctaataatgcaatagtaaattcgatgacatcatttttattgtaccatagtaaaatcttatccattttgtaaaggtgactcttattcaattcatgtgctaccctctccgctttcaaataaagtttatcccatgtgatgaacgtttctttgcctttagaatttatgctgatcatcgctgtttgaccatcataatgttcaaagcgtccccgtaaaattagcggtaaagaatccgtcattgctgagtctccactgctagtattttcggctccagtgtgtcttggtagtaatggtatcataggattataaacggcatccttcactgaaccgttttcatcactggaacctggcaatgacgattgcaaagaagctgtatatctcttgctccgccttctgggagtattgttcgcagaagtcgagtttatagttgtgacacgatagatagaatgacgtctgtcaattgaattaggtaacgacgtaatggatgatgcaagacttgtatttcttctgtgcaaatgtttcgactttctcgaattgggagatcgaagcggggtataaggcctcatttgggagatttcaaatttgtctagcaattgttttcttttggtctcataaccctttcttgttagattttcatccttatagtcttgaattaactcatttaaccgactttgcagatctagaggtaaggtaggaggaatagaaaaatccattggagtaactcaatgccacacgcttttacacagaactgaatcaccctaacaccaagtttacggaagcaaatgttaaatctgttgaagctcttttgactacattataaacagaaataaaacatactagaaagtaatcgggttttgacgatttcatccattacccgtccgaatgatggcacttataagataatgaagatgtacgcagcattaaaaccctatttgcagaagcatagtaagacgcaacgtacgctgaattagactgagacattacagttgctttgacattgggaagataattgggatttagaacggaaaaaaggaaaagacaagctaattgtagagatgggcaattcaatttcgaaggttctgggaaaactatttggctcgaaagaaatgaaaattttgatgctaggcctggataaggctggtaagacaacaatattgtacaaactaaaattaaataaaataaagacgtctactcccactgtcggttttaacgtggaaaccgttacttataaaaacgtaaaattcaacatgtgggatgtaggaggacaacaaagattgagacctctctggagacattattttccagccaccaccgcacttatctttgtgatagattctagtgctagaaaccgtatggaagaggccaaagaagagttatatagtatcataggtgagaaagagatggagaatgtagtactgctggtatgggcaaacaaacaagatttgaaagatgcaatgaaacctcaagaggtttccgattttttagaactggagaaaaatttgaaaaaccaaccttggtgtgtcatcggtagtaacgccttatccggacagggtcttgttgaaggattatcctggatttcgaacaacacaaacgttccaaagaaataaacattgcatttattggtgttgaatctgcatacaccgattgttcatccttcatttttactggattgtactttactaaaaagaaaacttctggaaaaaaaacagtatccaaataactaaatagctttaataatacaatataaaaaatggagacactgttgtgaaaagtcaacctttactacggtttctgtctttgcctttgatctgctcacttttcggtaacttcaacactaccgtcagaattaccgaagtaggcttttgaagcgttgtcgatgaataaacctgtttccaccacgcccactaacagtttgatttctctatgcaattttcttggatcggaaatttcaccgaaatccgcatcgataatgaagttattattgtcagttacaacaggacctgctttagcagaacctccttgtctgatgtcaactttttcagcatgcaattgttctaatagatcattcttgaccctcacgtatgaggaaggtacaatttcaatgggaacaccttgcctccagttcttacctaaatgttttggtgacttttttcttgaatcagcaacgacaatgaaggttttagcactagtactaaccaatttttcttgaaatagacaagcaccaccacctttaattaattgtaaattctcatccacttcatcagcaccgtcaaacgctatatcaatgcgaggatactgttcaatggagcctaattgcaacttgttatccaaaatcaagtttcttgattggaatcctgttggaatgcaaatgaatttagacgctacttcataaaatttagggtcatgcaaatattgtccaattctttcggcaacataaaccactgtgctaccactaccaattccaataattttgtgatcatcaaattttaaattttcatcaactgctctgtatgctgcagctctcttggcatcctccaaaggattgcccaaagattctaacgcatcaatttttgggacaccggcagccatttctttcctatgttgtatttatatgaggttgcagtatgcggtaaccaagtttatgtaacacgatgttgttaattttctacaagagaaaagaacgtcccagtacaaagagaataaattgcatgtaataaattgaaacagtttcacactgcaacgcaagccgtacatatattatattatccaaagcgtacgtaaactgacacccaattacgaaccagatgaaatttcaccgagttaatcgcttttccctcatcgcaaaaaaatttttcaactcatcgcgacttttcactgcctcggccacaagcaatctgggccatgccattactcccattagcccgaaaaaaagagggggtatgaagctagtacatcattataacaagtactaaactcaattaattcacttacgagacttataccaacgctggttgatataccacatttggcagcatccaaggtttctcgtaaaatagctatagtgtggcggacttaccggatgtcattgtataatcttttatagaaaaaggctttctgaaatttgaacatgactaattaacgcatatcaggtgggtaatctttccgcaatactataactttgctagaagttatgtaaacgttttagtttacaagagaaagttttgtgaacattatcagtgccaaaacagaagcggtattacgatcgaaaatgccaaataagaccgtccgatgcccctttcttctgctactcgtgatctcaccggcagataatgattgagtaatatcatgaatctctccaagaaacaatactcaacttaatgcgttcgcaaactgctattagaataaaaataatgtttcaaaaataacgatcttgatgtctataccaaccatgcatgatttcctattgtgcgtgccttatttacgcacgtttttcaacatacggctctatcaccgaaggcgctcaagagcagaataatatgaccgtcattcatttcaaacccatacacaatgaaccttatcacacccaaacatatgatatggtattaaaaaatgaaaaaaattcattattctttagcgtaattattgaagaaaaaacagtgcgcgcggtaattttttgtcactcagtaactagagagaagccgaatgtactcccccggctagctggagaccatggctctgcctaggatttctcttatgctttcctttcaccaatcactttgttccggcgaggcccgcgaagctcgctttctttcagcctagcaatcatgttcttgccagcgtcgtagactactgtatggcagttgctgcacttgccatgaatatcctagtgaagcctctatgcaataatccagttactgcgttagaatcctggtaaaatgtctaatcttattacattacagcaacgtattagattttgattgaaaattagtccttgcgacttggtatatatcttattttaagaaagctgaaaggaagaaagatcatcacgaacaacatgtctgctccacaagccaagattttgtctcaagctccaactgaattggaattacaagttgctcaagctttcgttgaattggaaaattcttctccagaattgaaagctgagttgagacctttgcaattcaagtccatcagagaagtatgttattaatttgaatctaaacttaagaataatggagagtaacaaaggaaaaaagtgtgaacgggacgataccagaatgtttcaatctagaaaagtataaaagataaggactaggactcaaatgtatttggctgactatcgcctgaaccttgatgctaagcaaataccatatcttcaagaaaaagcctactccagtgtttaagaagaagggaacgatttactagatcatgctatacgcagtaaggttctgatagttaattacaatcggtccaagttctaagcggtgtcgtccatgcatatatcatttacaagttactggcgtcaactcttcaaatattcaaaatatcacctaatcaaacttactaacattttccttttttgttttccttcttttatagatcgacgttgctggtggtaagaaggctttggccatttttgttccagtcccatctttggctggtttccacaaggttcaaactaagttgacccgtgaattggaaaagaaattccaagaccgtcatgtcatcttcttggctgaaagaagaatcttgccaaagccatctagaacatctagacaagtccaaaagagaccaagatccagaaccttgactgctgttcatgacaagatcttggaagacttagtcttcccaactgaaatcgttggtaagagagttagatatttggttggtggtaacaagatccaaaaggttttgttagactcaaaggatgtccaacaaatcgactacaaattggaatctttccaagctgtttacaacaaattgactggtaagcaaattgttttcgaaattccaagtgaaactcattagttaatataataatatctaaatctttattattagttagtaacaactttgtttattttatagcacaataagataataaaaactccaaattccaaaaaaaaatactttttgcaaagatctgaatcaaataaattttatgacaactatgcatagttacatactttttcaccgccgtatgattgccgctaaatcgacaggttgccatacaaacatttatttatgtcgtgccatgtttataaaattttcgtatctgttggagttagataagcctacgcttgatggaccgttgggtggctttctaagtgagctcgtgccatcacaattaatataaggaattgtagatgtttctttcgttataggtatttcaaaataattataagaacctacgccctcgtctttctccattggaacagttgccgttttcgcagttctttttggttcagtcctcatatcatgtgattcccctggctctcctgatctttttatacttactttgaaatcgtcatatgtgtatttctttgatgcaactccgataacgaagacaatgcttccaataataactaagaatttgcataccgttattaaacctaccaaaagtttacctataagcttctgtaatattggccccatcattgttgtgaatacgcaccctaccaaaaatgatgggaaatccagcacaatactgccaggcccactacctattgtaattttccatcgtaaccaatcccttttcaaatccatccgtgacttctatgtctcgttactttcacagcgtgtggagctactagaaaagtggcaaagctaaacagctgatcgaagtaaacagaaaagaacactaattgtagatcaggctgtgtactagaccttattttactgtattttttcggaaagaaaaaaggagcgctttgcagatcgaaagtttcgctcgtaaattatttgtaagatgctattcataatatgttaactgagagaaaccaggtcaaaacaaaacaattttgggctcttgcctccaaatttgcctaccctagaacaggtatccattatctcgcctgtacccgattaaaaaaaagaccaattatttaaaacttctcaagaagtttcatatgcagtgtataagttgaaggaatataggaatatatatccttcagaaaagcaacacaatacctaattacataaccgatatttaccttttagagtgcctcattcttgcaatctttctgttcgccataacaccaccgcccatgctcatgccattatttgttcccatccccatctgattaggggctgactgcggctgcccaaaagaagttgtcggcacaccacctgcccccccaaaaatggatgatggatttgttacgtttgaattggaaccagaggcagcattcgcaccaaatatatcacttggccttaatgcattggtcgcggtattagtaattccgccattcaatccgctaaaattaatattaggaactgttgatggcgtgaatgagctgtttgtattgaaagatggggtttgcgattgatgtggttggttattagagccggcaaacaccgtattagcattagtgttgccgttcatattaaatacagagccgccaccaggcgttgaattatttcccgtaaaattaaaagcagagggaacattgacattttgtgcattcgtggaaggaggtttattgaataaaccagcattagcattagttgacgaagttgctgatgtaaaaggattgagaccccctgcaccattgtttccaaaattaaatgaagattgattagaagctgcaccagttgctgctgttcctgagctcgaaaagccaaatgccgagcccgctccattcgtattgccactagcgatactttgatccggttttcctacgttaaatgtacccgctatattggttcctgaggtattggaagtagtagttgtgccgttaccagtagcaggggcgttaaacgagaatgatgtggagtttgctgaggcattggtaccattggtgttagcagtaccgaatgaaaatgcagatttagatgttgtattaccagtagcgtctgttggcttacccaagacaggaatcggcgttgaggaagcagaaccatcgaagaaagaagttggagagtttgacttttctttattgtgattgaactttgtaaaggaaaagccatttgatagcttctccgtatttgctgccgctgtacttgctgtcgacttcatcgactcgggagccccaaaactaaaagatggttttgtgctagtggttgttgtattatttgttgtggaaccgccaaaggtgaaagatggcggtgtaggtcttttatctgtctcattagcaggaggtttagtgaaagaaaatgaggtgttagagcctggtggttctttagctgcatctgacttaccaaatgaaaacaatggctttggttgtgaggtttttgaagacgcaaacgtaaaggagggctttttaggttccgaaacaacagatgaatctttttgagcaggttcagtaaaagaaaaagttggcttgagagtcttatcatccgtcggtgcttgaacatcaacaggcttgcccggaaacgaaaacgagggtttagctgcttcgtttgaaattggactactcttacgttcctcctctgacttagagaaagagaatgtaggtttcgcacttccctcagagatcttattttcacttgttgactgcccaaaagtaaaagtaggcttcttgactattgtggcaggtgtctcagatggtttggtgtgtgtttctttcgcggtggcggctttaccaaaggtaaattgtgcagaggagtcaatattgcttgttacatcagctttttttccgaatgtaaataatggtgtaccttcagcttgcttatcacttgcaccaaagacaaagcttggtttccctgatgcgtccttttctgactctccctttttggtctccttttgatcaccggtcttgccgaaatcgaataaaggcttggtgtttgtatcctcgctaacaggtaaacgcctttttcttttgggctcattttcatcatcaccttcatcaccattctcttcttgtttaccaaaagaaaatattggagcagttgattttggaggcgcgtctgattctgtatgattttcacttttttcggatgtctttccaaatttaaaaggttgactggcagaagtaacggtatctgatttaccaccaaaattgaataaagttgtggaagggacagtattgtcgacagccttagttttattagccttttggctaaaattgaatgataaggtaggcgcctcggcagttttcgttgacttatcggtttttcccatttctacactcgatttaaagactgcacctgcagaagaagttgccttaggagaagttttcttagatggagtctcattgtccttgataaagtcaaaacctacggtgggcaaaacaatactttctttgtcctttttgggctcaatatttttctttaacgtaggcgtaccagagcgctctgaattgggaacaaagctctcctgaataggggcagtttttgcaactgtggaagctggtccttttaaaagtagatttttttgaggattcgataacctattagagttgatgtctgcacgtaggtcttcaatttcgcttgtcaggttagggcctgtagccagattgccatttgaaatactactcttaatattatttctattctcgcttgtcttctgatcaccgccagcgttaccttccttatccttgttatcctttttttgtatagcgtcatattctgacaaatcatattcaaaatttgctgaccacacggtcccctttgactgactatgaaacctttttctattggatctatttttcaatgatttgagaatgggtagtccaacattggtgtcttcaccgctttttccggccaactgcctagtgcaagaaccgtttttaataggggaaggagtagatgatgtgcataggtacgatcctccctcatcgcttttactttgagagcccaatataaccgacgatgtaatagatggaaattcagttgattgaattaatccaagctcacgcatatttctcaccctctgcttctcccttaataacctcagtctttgaatgggcaaaattggcaaaagcggcggtctctcagtgttttcggttccatatattataattggcgcattattgttgttctgagttaagctgtcgctatgctgtgatgtaccggacaccctctttctcttattaacatgcagtgtgtcttcaacatctgattcctccaaatgattcgcgtatgagaggtttgaactgaaaactttcttgctcgatggccgttttttattggggtttgtgaagaatgattttaaagtggaagaaaacgatctcttttcgacacgtggagaagacatcacagaagaagtgtttgaagacatgaatgactaaaaattgtcgctcactctctgtccctataaccctttcgaggctaatatcctatcgtatttgcaccgctacgtagtgtccttattgagttcctcatcacttattttctttaagtgtttcttgacattacgaaatttcgtcaaagaaaaaaattaaaatgaaaaagcatttcaatgtcacataatacgaaccattgatcacgtgcaacgacaaaccctaaatataaaaactagggcgtaaaaaccggggcttgaaaattagggcataaaataggctttgcatacacgtgacttatatttggtgtcggcgttttctttacgcggtgtagtgtaaatctcttgtcgtacaagtggatatacgcactgtatacctccagtaacaccaaaaaaaaaaccgtggttgtcccatgtaaacgagtaccgcacacgtaggccaaagcactccagagagacttcgtgtcaaaggtctataataggtggtgccttcttgcttcttttttgcagattcttagtataatacgctagactattgtactttctaattttaagagatatctttttcctcacaaagatttcgttaagcaatcgaagtaaagtactccatcagaagagtttttaagggatagagtcaataaccaaaatggcgaagattatgatcccagctagcaagcagcctgtttacaaaaaattaggacttcttctggtcgccgtgtttactgtgtatgtgttctttcatggagctcagtatgcgagaggctctgccccaagcccaaagtacagtaccgtgctatcttccggctcgggctataaatactcgaaagtggaactaccaaagtataccggtcctcgggaaaaggccacttttgtcactctagtgcgtaatagagatctatattcgttggctgagtctattaaatccgtggaagatagatttaactccaagttcaactatgattgggtgtttttgaatgatgaagagttcactgatgaattcaaaaacgttacgtcagctttagttagtggtacaacaaaatacggtgtcatcccaaaggaacattggtccttccctgagtggattgatgaagaaaaggccgctcaagtcaggaaggagatgggtgagaagagaatcatctacggtgattctatctcttacagacacatgtgtcgttttgaatcaggcttcttttacagacatcctttgatggatgactacgattggtattggcgtgtggaacctgatatcaagttgcactgtgatatcgactacgatgtcttcaaattcatgaaagacaataagaaaaagtatgcctttgccatttccattaaggagtatgaagctactatccccactttatgggagactactcgtaaattcatggaagcccatcctgagcttatccatgaaaataatatgttagactttgttagcgacgatcagggactttcatacaatttgtgccatttttggtctaattttgaaattgctgctttggatttgtggagatctccagcatactccgcatattttgattatttagatcgtgaaggtggattcttttatgaaagatggggtgatgctccagttcattctattggtgctgcgctgttcttggaccgctctgaaatccatcacttcggtgatattggttattaccatgttccatttcactcctgtccaatagacacaagtatcagactggctaacaaatgtgactgtgatccaagcaaagatttcacatggcacagttattcatgtactactaaattctacaatataaacaagttgccaaagcctgctggttggcaaaaccatatcggttgattatactgtaatcagcccacgttgtctttgtattttccactttttttatttatactatttaaagaaacagaataaattataactcttttttttacatatcacatttatatttactccattgcgttacaaatatgaacgcttcgacaacaacgccaaggaaaccgggataacccaactgatattttctaccatacactgaacgaaattgcagaaccaaaaaataacaaaaagttcccaaaaggaatgccagaaaaaaatgggaggcaggtccacctaacaaaaatttaatcatatgccatacttcttgaacagtgaatgagtcatctccacacctaaaaatgtggccgcattggctgggaaagatcttagtaaagcaggacctaaaccagggaaaaatcccttgataccacctctttgtagataaatttcctttgtggcggaaagcatattctgcctcgtggaggaagcctgcaattttgtctttatagtgtctatggggaaaacagctagccacatcgacataccagcaataccaccagcaagacacacgttcaagatattgaccggttcatctttgcccgcatcttgacgaggttgcctactattcaagtaattttttgaaatttcataagatgcaaaatatagagctgagccaggcccatctcttgctaaagtggctaatgaacctttaaataaagaagctatgccaccttctttaacaatggttttagccgcctgaatgaaagagcccttagaagatgtttgcaggacaacctttactctttccgttggcgcagtcactaaagtggtaggaatagcgctgataaatcctgctgcagccatttgtcccatagttaactcgttactgcctccttgcttgttattaaaagtaaccagtttcttacccacatcgtaaccccagaaagaaacagcgaatatgggagtaacacctaataagggcgggataacacctttatagaacccctttacggaattggtaaataatgtgccctttacttgagtttttgcttcttttataatatttgtaatggcatgtaccgtggaattcgcttgtccattttgacatctcactttaatcaaatcgaagggatgacccgtaaacaccgcacataccccgccaactccaccggccacaaatgatttgatattttcgcgtacagggtttgattttataggtggacgagacttggtcaagctcccactctcttctttcaataatgaagattctgataatgaagtgtctgaagacattactgacacgatgacgtttgtggaggataagaaagtcgtacaatacgtagaatccaaggaaaacctggaataaaaacacacatagagcgcaattgaatatcggctatttctacagtacaagcgtctgcctatatatgcgcttgaaatatatctatttcgactaaaggaattataccatcatgcatctttactcttaaatctccatttgtccaccgacttattgcggcaagtggagatccagtcacgccggatgactgggtgtagataaatagccgcccaactgatccctgcataaagcttatatgcggatattaggagcagtaacccgatgacattaagcgtgtagccacaaggaacttcaccattactcatagcagaaaaagcagtgaccaaaaaatggcaggaatgactcttttctgtttcccctcatatacactgaaacatctcgatataaagcatgccctttattgtaccatcaatgcaatgtaacggcaaacgaggctaggaatatgtattacccgcactgaattgcttcttcacttagcacacccttgatcgctatgttctacgctgctacccgttcggtagggagtggcggggaaattcacattggcacaatgtaaacccgtaggaaaaaaaaaaagcacgaagaaaaaaaaagaaaccaaaaatatttactacatgtaagtctatggacatttgacaacaaactttttcaactcatcgcaagattatgaatttttcacggcttttcaggttttttcctccttttgttttacattgaaaggtttatattttatgtctttgtatggttctcttaatttggattctttcttgtacggtgtctctattatcatctgtcttgttctttcttgcaatgcttaattaactgctgccacaattgacttcggtttggctatttcacgattgaacaggtaaacaaaattttccctttttagaacgacatgcagggaaataaatcaactataagagagtataagatagtagttgtcggtggaggtggcgttggtaaatctgctttaacaattcaattcattcaatcatactttgtggacgaatatgaccctactatcgaagattcttacagaaaacaagttgtcatcgatgacaaagtatccattttggacattctagatactgctggacaagaagagtattctgcgatgagagaacagtacatgaggactggggaaggtttcctactggtctattccgtcacctctagaaattcctttgatgagttactgtcttattatcagcaaattcaaagagtaaaagattctgactacattcctgtagtcgtggtaggtaacaaattggaccttgaaaatgaaagacaagtctcttatgaagacgggttacgcctggccaagcagttgaatgcaccctttctagaaacgtctgcgaaacaagccatcaacgtagacgaggccttttatagccttattcgtttggtaagggacgacggtgggaaatacaatagcatgaatcgtcaactggataatacgaatgaaataagagattcggagctaacctcatctgcaacagcggatagagaaaaaaagaacaacgggtcttatgtactcgataattctttgaccaatgctggcactggctccagttcaaagtcagccgttaaccataacggtgaaactactaaacgaactgatgaaaagaattacgttaatcaaaacaataacaatgaaggaaataccaagtactccagtaacggcaacggaaatcgaagtgatattagtcgtggtaatcaaaataatgccttaaattcgagaagtaaacagtctgctgagccacaaaaaaattcaagcgccaacgctagaaaagaatctagtggtggttgttgtataatttgttgaaaatgatcctgctctcttgatatgacatggttttgattgcaagtctattcttacttgttcaattggtttcaccagcatctttttgtatccattttcctatgctgtgtatctagtaaaagagttgcttgccaccaaacattaatactaatggttaatctgccaccttttgtaagctttctataatgtacaattgtaatatgttcttttattctcgtacaaagtatatatactatacacatacaagcatgcatgcaagcacgccggcaaacccttcctcaatttataaaatgtaaacaaacgaaatgtaaaatcaaactagcaacaataaactcggcaaaagctctgtttttagaaatgcctggaaaactattacacaattgtaaccgcaaactcatcaataggacgaattgtcccacacaaataatgaatcccgctaaaaacgcattgaatggaaaattatcacggatcaagataatgaatgtacactggatcacccctaataataccaaaaagaagcagaatgtatcaattagtttcagtttaggatatttttcaatttgggcaaaatatgccctcttagaagtcttgaaagtttcttgaaaatctgttaagactgcagatgacgtgctggttacttttggtgtgtttgcctttggtgcttttgccatattagtcatgtattcctcgttacaattctttttgttgtgtgatagcgttatgaagtatagcgttcacgcagattctattgtatctttttcatcctttaaaacacgttattctctatttttgccctcaccgggattttttctaatagcgatatacacccaatcattgcacttacgacacaagtgcaaatagcagaggaccaagtactcgccaaatagaaccaacaagcttctatcgactcgttatttccagtgtgatgaattggttaggatcctcaattggctggcgtatacgcgtgtttttttcgtcatctaagtcttaatggctggtaaaaaagtccccgttgcgctgcccaaatgaaacagctttgataaattcttttactgtaaataattaaaatgaaaatcccagtttttcattcagtttcttgctacaaagtatcagtcttagcttttttttgctacgaacgtggccctttttatgcttatttttcgttgtaggaaaatgcctcttctcttataaccaaatggggaaaaatataaatgatgcatctcgaaaaagcttcaagatctactggaaccgcaacttctactctagaactggataaaagcctagaagaacttcaaaattaaaggggcgcaagaaagtttcaaatatattacatatttgctacttagatcaagaataaccacccccggtcgtgactttttagattttttttatcttgtttatttttagcaaaataaccgtttcaagaaaatactagaaatataatcaaagactcccaagcgtatacacagtaatgaacgtttgcaagttgaaagaaatagtaccactatttccgagatcgtcctttacagatggtgtagtaagtacaggaaaaagtttccgaagctgggacacctgcatggacaataaagcatgtaaaattattgcgattgttggtattgttttggcctgtattcttgtgatttggttgattgggggcttactgacatgtttcaggcaaggggtaacaggaataggtcagttcatttgttggtgttgtcgttgttctaatgacagaaatggaaacaatacaatgccggtaaatgagggttttagtagagttaatatgggcgtggctcctccttctactgtgatttatcagcctattcaacaacctgaaagtgcgtattatagaaacgatgcgaagaatgatacattttacgacgaagtcaaaactcccagtaatgaggtgtatgaattagaggaagatttcgatttggaaaaacaaaaagagaaaacaaggaaaaaacaacagaaggaaagaaataaagaaggacgcagccctagtagggtggcccctctagtgtatgaagaagaaaatttcgaaggtagcagccctcagccgcaatatgatgctagaaattcgtttatccaaaatgcggccaatactggtagcaacaacgctcatgttgcttcacaatctccaatttttgacatcagcgattatggcgagaactattattacgataataataacatcaataataacctccagggaaacagttacaatactccctcctctaatcatagaagtccatatccaaccgaaaattatcaatcatatcagggatataaaccaaaccaaagcgatagatattactaatgaggtaaatatatattcccccttcttttgaataatcagtcagacattttaagatcaagaggattcattggtagattttgcaagaaccaattaggaatttcttcaggaataactgtgagcttgcgtttacggaaaggaaagtaaaaaaaaatcttccaacgagtttttccttgtaccggttgctaaaaaggtgccttctaacaggtaacaccagaaaccgcaacttttaaaatgcaaataagggcagtcaatggtgaacttcctcttggtcagttagtatgtacaataaattaggttgttttcctcaggataaaagtgatctatttgtaacatatagtttacctaggtgctgacgaggacacaggaagagcaaaactaagatcatacaagtcaatacttattataatcaaatgataatattcgttcagcctcatattcgagtttcacatcacaactttttttttcgcgagatgcgcagtaaaaactctatatacatttttgtagtgaattttgattttgatgtaaagaaagcagccaggagattaaaggaaggaaaatagaacaataaaaaaccacgggatcagcattaacaaattggccaactaatatccactgcagaaagttgagattatgtcctttttcgacatcgaagcacaatcttcaaagggtaactcccagcaagaaccacaattctcaacaaatcaaaaaacgaaggaattaagcaatttaattgagacattcgctgaacaatcccgcgtgctggaaaaggaatgcaccaaaattggttccaaacgggactccaaagaactaagatacaaaattgaaacagagttaataccgaactgcaccagtgtaagggataaaattgagagcaacatcctcattcaccaaaatggaaagttgtctgctgatttcaagaacctgaaaacgaagtatcaatccctacaacaatcatacaatcaaaggaagagtctgttccctctaaaaacgcctatttcaccaggaacatctaaggaaagaaaagacatccatccgcgaactgaagccgtgcgacaagatccagagtctagttatatttctataaaagtaaacgagcagagtcctttactgcataacgaaggacaacaccaattacagctgcaagaagaacaagaacaacaacagcaaggattgtcccaagaagaactagattttcaaacaatcattcaccaggaaagatcccaacagataggacgcattcatacggcggtacaagaagtcaatgctattttccatcagctcggttcattagtgaaagaacagggagaacaagtaaccaccatagacgagaatatctcgcatttacatgataacatgcagaatgcaaacaaacaattaaccagagcagaccagcatcagagggaccgtaacaaatgcggtaaggtcaccctaatcattataatagttgtgtgcatggtggtattgcttgctgtattaagttagtaatctccttaaacgcgcattgagcacagactttctggtagacccaatcttatctatttacgaaaacaagagtgtataagagtgtataagttattttttgcatttattcttttgtggtaggggggtttcttagccgctctttttgactcaaaatttcctttgatgtctagtgatagtgcacttcccatgtgcgcaacctgtgttttttgtactccgtagtttaaatgcaagggctcgatatgccctttttcctttttctactttgtacgatctacactgaccttttttcagtagtccgtaaatccccacgaatttctactagcgactgccaataaaaaaaggattgtgctactgtatgtaaaaagtaagaaccctgttattttccgttaactgtcatttgccttactgttgcttaacggccgccaaccgttatcaagaaacaaaacattgtatgcgttgtcttctaaatgaaccttgtgggccctgataaacataagaacgtgtctggctcggaagtatttatcttatttcaattttcgcttttgcagaacatccttgcctgtcactaagataaggacagagcgtggattaataaaaatggcagaatttctcggcaaaaaaagaaatcatgcataattacctcgatgtgtacgttattgcgggcacgatcctgtcgctacggcctgatagtagcggctattctgctggcgaaaattttcagcagtttgaaatcttactgtggcgtcccggtccagccgagatgacatctaactaagaaatgtccgctgcggcacacccacgccgttgcagctaaagtcgcgcaccaagcacagacctgctggagaatgaggaacaaggttgcgttaaatgcttcgggaagaactgccgaaccgaaccgctagaaaagtgcgcaggtaccccgatcgaagcggctcggcgctcattttagcacaatcagaaaaaggaaattgaaagaagaaaaaaaaaacataatcattaacaattcttttcttgagatatacgtatatatgacgtcgtcatgtagtatctctttcgggataccctttgtaaacgtccctttgtggagatgaaaaaaaacttgctgaataaagatagttaaggcgcctagtaatcaaattaataacatattataccacatcacatctataccatttccgttgcacattgcttgaaccagttgccaaaattgactaaacggatttttacaaagtcaacggtgatcactaaaagcaaacaactcaagcgacgaggcaaggaaagagaagaaaaaaaaaatattacattggctatataaatatcaaaacatcttaggtaaggcacctttgatacataaaacgaagaaaattcagcacatgccagatggcgagtgtaccaagtctatgcgacatactgataccgctagaaaagaatagtcgcagcgacggcgatgctgaaagtagcaatacagtgctgattcaactgcgaaaagggcatcacgaacggatgcgttctccttacacaatacaaaagttttacaaatttctaaaaagagctcattgtgaggaaaatttagaatttttcgaaaaagctcatcagttcctccagcttaagcaaaacaggagtattagcgaggagaagctcttggaagtttggaacaagtcgttgtacataaaatacattgccgtggactcccccaaagaatgcaacttttcacaggatactagggagatatttgagaagtgctttgctaacaatgaagtacctgccgacgtagacgtcctgtgtgccattagccatgtgatgggcctattaatggacgggtatcaccgatttgtgagttctgttaatgagaaaaagtactccgccacatatgcccacaatgactctgctacggaacaagatctcaaaaacgagtctacaacttctttttcgtcattaggcgtggaggatatttctgaagatagaaattcgtatcttaagaagcctgatatcaatggtttgtcaactatcattcaagaaacgtctgcaaacacgaccaatgagtcgcaatgcagcgatcgcacttctcggccaagcgagtcctcttcctcactcaacactaccagctcgacctacaagaataccagcactagaaatctgcaaaaaccgcaaaatacaggaattctcaactcggggaaaggtttattgcaaaaacttaactttgttaaaaaacggaaatctttcaaacagccttcaggcgtcatttgtagccattataacagcaatgttcaaaaccgtttgaaaggacaaaacagtcatcaacaaagatagcctcttcatcatctgtggagacacaaatatcttcatcctcatcgccattacccaataaagcgatcggtaaaaatgaaaaaagcgttgaaaacggctttaaaaagctaaatttgcatgatatcagttaatcaagattagaactttgattaagtagaacaacgatagaaaatccgcttttctggctagttccctcgtttcatattaattcatttcacacaatttacttcatttcatcacgctcatattgtttgtaactttagtttttatttaattttacgtacatgacactgcatataattatttcacaggcatttaaaataagagcattgggcacagtcttcttttatatgttgtcatattcaaacactaaacatttatctgtatagtaattaatgttagctcttccttctgcatggcgcttgttatatacttcattcgtctattttggtgccgcgcgccatcatggtccggtaacggtcgtagtgaatgactcatatttttccatctctttcggccttgccaaaaaatgaaaaaaaaaaaaaaaaaaaaaaaaaaaattaaaaacgatgtccagaatcacaactacaacatagttttgcctcttactggcttgattggaagttagctgttaaatttcaataatgccttactttactccacgaaatcacaatccttgttttcggcttataagggtcttctccttaggataatactatcggcacattatcatttagccgcgtagccatggtaaaacattcgttcatagcgctagctgagcatgctagtaaactaagaaggtctatcccacccgtcaaactgacttataaaaatatgctacgggacccatcggtaaaatatagggcgtttgctccaccaaaaatggtcaagaggatttggcctgacaaaactattcaaaaggctccacgttggctgtctactgacttgagggacggtaatcaatctttaccggacccaatgtctgtggctcaaaagaaagaatatttccacaagttgatcaacatcggtttcaaagaaatcgaagtgtctttcccctctgcatctcaaacagatttcgacttcaccaggtatgctgtagaaaacgctccagatgatgttggtattcaatgtcttgtccaatctagagaacacttgattaaaagaaccgtggaagcattgactggtgctaaaagggctaccatacatacttacttggccacaagtgacatgttccgagaaattgtcttcaatatgtctagagaggaagctatttctaaagctgtagaagccaccaaactggttaggaaactaaccaaggatgacccttcccagcaagctactcgttggtcctatgagttttctcccgaatgtttcagtgatacgccaggtgaatttgctgtagaaatttgtgaagctgttaaaaaggcttgggaacctaccgaggaaaatccgatcattttcaacttaccagctactgtagaagttgcctctccaaatgtttacgctgatcaaattgagtacttctctacccacattactgagcgtgagaaggtctgtatttctacgcattgtcacaatgaccgtggttgcggtgtcgccgccacagaattaggtatgcttgcaggcgctgatcgtgtagaaggttgtctatttggtaatggtgaacgtacaggtaatgttgatttggttacagttgccatgaatatgtatacccaaggtgtttctcctaatttagatttctcagatttaacttcaatttctgaaattgtccatcgctgtaacaagattccaattcccccaagagccccatatggcggtgaattggttgtttctgccttttctggttctcatcaggatgcaattaagaagggatttgcaatccaaaacaagaaacaggctcaaggagaaactcggtggagaattccatacttaccattggatccaaaggatattggacgtgattacgaagccgtcatcagagtcaactctcaatccggtaagggtggtgctgcttgggttattatgagatctctaggattagatgtaccaagaccaatgcaagttgatttctccaatactctacagaaaaatgcagatgccttaggaagagagttaaaatccgaagagattacaaaattgttcaaagaaacttacaactacaacaacaatgaacatatatacgtcaccttgttgaattacgaagttaagaaattgaacccagagcgtagagctttagtgggccaggtagaaatcaacgataaggttgtcaacatcgaaggctacggaaatggtcctatctcttctttggtggatgcgctatccaatttactgaatgttaagttgagcgttcaaaactactctgaacattccttgggttctggttctgcaacccaagcggcatctttcataaatctttcctacataaaggacatcaataatcatgctactagtaatatgtggggtgttggtgtctccgaagacactggggatgcatctattaaggcggtatttgctactgtcaataatattattcattccggggatgttctactggcagagtaatagaaaggagtagcttatgattactcatgttatatatatatgtatttttatttataaatggcacagaaaagtaacttatttcacgttaaaaagacatctttcagcgaagtttccaaacacttcttcgatgtctgtgtggaaagtttctttcgtttatagttttattatttttttttgctttttttcccatggtaccatttcctttcgtgaaacattttacccaggcccacccaccgcataatcttaactgaatccgaatagggatttttcgagcactactgcaactgttgagtgagctaggagtagtgtaatttgagactttgtgaagggagaacagtcaatatccaatatcatattaagaaagctagcagtaccttaagaggaagaaagaaaataactggggcgaagaatatctagttatccactccttcatagaatgattatctttgtttcagaagaacctgaaaggaggctagccattgtatccaacttgtatgctcttgttcttaaaccggttgggaaaaagccatctgataaacccctttgtgccattgaacttcttcaaaaaaatgatttgaaaaaatatggcttcaaaagacttacatcacacgaaatttttggtgttatcggactcattgaggttaatggcctgctgtttgttggtgccatcactgggaaatcaaaagttgcacagccatgcccaggagagactgtgaacaaaatttttgctgtcgattttttttgtttaaatgacaacagttgggattttattgaaatcgactcctcaggttatcctgtgttgccggagactgcttcaactgaatatcaagacgccttgccaaaacatccatgctatgaattgaagaaactattatccaatggatctttttattatagttcagattttgatttgacctcaaccttacagcatcgtggatatggtcagcattctttgagtacagatacctacgaagaagaatatatgtggaactcttttctcatgcaagaaatgatcacatacagagatcatttggacacaaatttgaaacaaatcttggatgacgaggggtttttaacaacagttatccgtggatttgcggaaactttcgtctcgtacgttaagaagttgaaagttgctcttactatcatctcgaaacagagctggaaaagagcaggaacaagatttaatgcacgtggtgtggatgatgaggcaaacgttgccaatttcgtagaaacggaattcattatgtattctagccaatactgttatgcttttacacagattagaggcagtatacctgtattctgggagcaaggtacctctttaatcaatccaagagtacaaattacaagatcatttgaagccacccaaccggtatttgacaaacatatcatgaaatcagtggaaaagtacggacctgtgcatgtcgttaatttgttatcaacgaaatcttctgaaattgaactttcaaaacgatacaaggagcatttaactcattcaaaaaaattgaacttcaacaaagatatatttttgacagaattcgattttcataaagaaacttcgcaagaaggcttttccggtgtcagaaaactcattccattaatattggactctcttttatcttctggctattattcttacgatgttagagaaaaaaagaacatatctgaacaacatggcatatttaggaccaactgtttagattgtttggatagaacaaatttagctcagcaaattatttctttggctgcttttagaacttttctcgaagatttccgattgattagttcaaattcgttcatcgacgatgatgatttcgtttctaaacataacaccctgtgggctgatcacggtgatcaaatttcccaaatatatactggtactaatgctttgaagtcctcattttcaagaaaaggtaaaatgtcacttgctggggcattatcagacgccacaaaatcggtcagcagaatatatattaacaatttcatggataaagaaaagcaacaaaatatcgatactttgttgggaaggttaccgtatcagaaagcagtgcaactttatgatcccgtaaacgaatacgtaagtacgaaattacaaagcatgtctgataagttcacatcaacctccaacattaacttgttaataggatcattcaatgttaatggcgcaaccaaaaaagttgatttatcaaagtggttatttccaatcggtgaaaaatttaaacccgatattgttgttttaggtcttcaagaagttatagaactatctgcgggttcgattttgaacgctgattactcgaaaagctctttctgggaaaacttagtgggtgattgcttaaaccagtatgatgataaatatctgttgttaagagtagagcaaatgacttctttactaattttattttttgttaaagcagacaaagctaaatacgtcaaacaagtggagggtgctactaaaaaaactggctttaggggtatggctgggaataaaggtgcagtgtctataagatttgagtacggtgccacttcattttgttttgtcaattctcatctcgcagcaggagctacgaatgtcgaagaacgtcgaagtgattacgagagcatagttagaggtattactttcactagaactaagatgattcctcatcacgattcgattttctggttaggtgacatgaattatagaataaatctaccgaacgaagacgtcagaagagagttgctcaaccaagaagaaggatatatcgataaactgttgcattttgatcaacttaccctaggtattaattctggcagtgtatttgaaggcttcaaagaaccaactctcaagttccgtccaacatacaagtatgatcccgggacaggaacttatgattcttctgaaaaggaaaggacgccgtcatggacagatagaattatttataaaggggaaaacttacttcctttatcttattcagatgctccgataatgattagcgaccatcggccagtttacgcagcatatagagcaaaaataacttttgttgatgataaagagagactatctctcaagaaacgtttattcacagaatacaaacaagagcatcccgaagaaccgggttctctgatatcggatcttctcagccttgatctggataataagagcactgatggattcaaaagctcttctgaaagttctctacttgatattgatccgataatggcacaaccgacagcgtccagcgttgcttcttcgtcacctgtgtcttcagcatcggcttcactacaacctgtcagaactcaaaacagtagccagtcgcgtacccccataaagaaaccggtattgcgccccccacccccacctgctcataaatctgtatcagcacctgctccttcaacatcgaaggaaaaatcaccaacaccacagacctcaactgcatcgttgtcatctgtgactaaaaatatacaggaaaataaaccattggcgcaaaatagacgaattccaccaccaggttttagtcaaaatatattaactccaaaaagtaccagtaacttggcttcgcctatgtcttctaaggttgatttatataatagcgcgagtgaatctacacgttcagcccaagatgcaagacaacagacacctacagcatttgcagcatcaagagacgtcaatgggcagcccgaagctttgctaggtgatgaaaatccaattgagccagaggaaaaggccaaactaaaccatatgactttagactcatggcagccattgaccccaaaatgagaatatgttatctttgaagtgtggttgttgttccgtttgtatccctttaaatgaacgaagagaaacaagggggctaacctggccaggttgttttatgtgattttatttagataaatatttatataaatattcagtgagagaaaaggagtgcgttaataaggcgcgccgggtttaaagctgaaaaataggacacattaatatatatacgttaaatattggtgaatacttatgggcaaggtggaagagaatctctactatccataaatcctcagtaggctttcccctaattaccttcatttttctacctcaataacatattactccttttcaatacattttatggtggtgaacacgatatatatcgcaaggcatggatacagatccaactggcttccggagggtccatatcctgacccacttacaggaattgatagcgatgttcctttagcagaacacggagtccagcaagccaaagagttggcccattaccttttgtccttggataatcaaccagaggccgccttcgcttctccattttatagatgtcttgagactgtacaaccgatagctaagctgttagaaatacctgtttatctagaaaggggtatcggggaatggtatagacctgatagaaaacctgttattccagtacctgctggatatgagatactaagcaaattttttccaggtgtcattagccaagaatgggactctacattaacaccaaatgaaaagggtgagacagaacaggagatgtatatgagattcaaaaaattttggcccttatttattgaacgtgtagaaaaggaatatccaaatgttgagtgcatactgttggtcacacacgctgcatctaagattgcccttggaatgagcttgctgggatacgataatcctcggatgtctttgaatgaaaatggtgataaaataagaagtggtagttgctcattagacaaatacgaaattcttaaaaaaagctacgatactatagatgaaactgatgatcaaacatcctttacctatataccatttagtgacagaaaatgggttttaacgatgaatgggaataccgagtttttgagtagtggtgaagaaatgaattggaattttgattgtgtggcagaagctggttcagatgctgatatcaaaaagagacaaatgacaaaaaaaaccagctcaccaataccagaagcagatgatcaaacggaagtagaaaccgtttatatcagtgttgatattcccagcggcaattacaaagagaggaccgagatagcaaagagcgcaattttacaatattccggtttagaaacagatgctccgttgtttagaatcggaaatagattgtatgagggaagctgggagagacttgttggcacggagcttgctttcccaaatgctgcacatgtacataaaaagacagccggtctactatcaccgactgaagagaatgaaacaacaaatgctggtcaaagtaaaggctcatcgactgccaacgacccaaacatacaaatacaagaagaagacgttggactaccggattcaactaacacaagtagagatcacacgggagataaagaagaggttcaatcagaaaagatttatagaataaaagagaggatagtgctaagcaatgtccgccctatgtaatatgtattttgtagcagcagcaaccttatttaaagaacacaggtgcatctgcttgtttattacctttcgtgtattttaccagacgaaaagcgtgaagagacgtaagggcaaaataacccagttgaacacaagaaaggaacatctgaccgcatcaaaaaaagagcacattcaccaaacgtaatgtctggaaatagtcaactgccacccgacgtaatcgggtttatatgttctaagtatgatatcattttggccagcacctctccacggaggtatgaaattttacacgatataatgggaatcaccgatttaaaaacaatggtttctacttttgaagagaatcttgataaaatgaattattctaccgatccgattggatatgtgtgcgatactagctggcataaagcgcagaatataatcgagattttgacagattacgaagatgaaaacccaaatgaaattgataaacctaagcttatcatatgtgcagacacaattattatagataagagtgggagaatctacgagaagcctaaaacaaaagaggtccaaaagaagtttttaatgaagttttgctatgaagatgatgaaccagttaacgttgtcaccgctgtgactttaattaaatggtacggcagagaaaactttgaattggtaccattccgagatgaaaccaaggtatactttgataacaaaatacctttgagaatattggaagaatatgtagaaagcggagatgggctggaggttggcggtggatttaaaatacaagggcaaggtgctattctaattgaaaaaattgaaggtgattactataacgtagttggtttaccgctcaataaaacgttcaaaggactctatgctgaggctaattccatataaccttcgtttaggttttctttggtgttgctcagttaactatgttaatctttgcaacaccagaagaatgagtggaacggatattaaaggccacattggtgaatagatacatgcgctaaataacacggctattaacattctacgagacagtttttcgattgatggtaaagaaagtttaaagcaatacgcattttgaatttcacgctttcgcgcacatcttctatttttttcaccttcaaaaaggccctttctctttgtctgtttatattatgattatattaaatataagtatcttaaaaacaataatatcgtcaagttatttagtcgagagtttgacactgttactatcgttgcttttattggtgaacaagtatctgtaagtgatgaatttttccagcattttcaaatctatttcgaatttccagttcccatacaccatagaggaaactgcaatcactgaaaccgccctttggcaatgtttcgatggtacaaggaaggcagattccttgccagtaacagtttttaaggcaaaaagatctccagaaaatgaatctttaattttaaatgctgtacacaagagcaaaattttgaagattccaggactttgtacggtgctggagacatttgattccgacccccaatccacatttattgttaccgaacgagtagttccatttccttgggataatctaggctctttatctcaaaacaaatttggtgttgaattaggaatatcacaattattggcaactttaggatttttaaaaaactttgtccttggtacgctttctaaagattctgtttttatcaatattaagggagagtgggtactatttgggctagaactttgttcaagcaaagaaggattaagtgcgtttgaatttgccagtagagcgaggtcatattacaacataattggctcacagttgccctgtgaagatccgaatacaattgattcaatggggttaggattgttgataaagagccttatggctccttcttgtctgcccaaagattggattgtcaatgtaaatatgatttcagatggaaagataacaatcgaaaacttcagaaaaaggctagaaaatacagaaacttggcgttctaatcctttgataaacttttatcaagaattgagggagttgcatataaaggacccacagggaaaattggttgtgatgtcaaacttggaaaatttgtatttagagtcaagagagattttccgtaatttaacgcctggaatgatagaaaattttattattccagagctttgtgaaattataaaattattaatgacacaaagcatcagtagtgctgccagccctataggcatgaacttcaacgcatcacataaactagtaccattcttagcgattgttttagacctaacttctgaaacgaacacctttccagttggtttcaacgaccttatcacccaaagttttaaactgccagataggcaagtaagatttcttttactaatatacctacccaaattaataggtccattgagcaaatcagagatctccagtaggatatatccacattttatccaaggtctgaccgactctgatgccactcttagattacaaacactgaagacaattccatgcattgtgtcatgtttaacagagagacaactgaataatgagctactgaggtttctcgcaaaaacacaggttgattctgacgttgaaatccgaacatggacagtcatcataataagtaaaatctcaaccatattatcaacgtcagttggtaatcgctcgaatattttagctacggcgttcacaaaatctttgaaagatcctcaagtaaaaccaagattggctgctctttatgggcttgagaagtcgattgagctgtttgatgtgaacacaatcgccaacaaaattttaacagtcattgcccctggtttattagataaaagtcccatagtaagaggcagagccaaaatcctgttcgaagaatatctggaaaaattggaaaaagaagcccaacttattcaaacaaacgatagtactgcagattcggaagatgtgaaagatattgattttgagaattacggttgtgatgaagaggatatgaataaagaagacaatttgttagccgcacaatttttaaataatttacgtttaaattctccctcagcaacaacaccaagtaacattaccgagagcgaaattgattccgcccaggatggaagtggatgggacgacctcagcgataccgatggctttattacaaatggtaccacagaatccttcgatgaaacaacaaaccctgtaacaaccgcaagcaccccaaaattattcggaaaacctattaaaattaataaaagttggaatgatgagttgaatgatgatggctggattcaagatgaaagcggcccatcaaaggtgcctcaaaaacacacaaggccacaaaattcaacgttggcaaaatccatcgctcctagctcaaggctttctatcaagaagaagaaaacaacgatcctagcaccaagaaacattgctagtaactctactgttaccaccaaatcgtcactgtccaataaaactgcaagaagtaagcctataagtagtatccgcggctcggtaaccaagaaaggaaatgttgacggctgggatgatgatggggattcagactcctgggatacgaattggtgatcccaagacttatatagccctacgtattgtagaaggatatattcagtgttaatcgttatttagaaacattacgcccgtgccccgcgatttcgcttctttgagaagtggaggaaaagaagggtccctttaattccagtagaaatgaagcataagcaagaagagtcatcagaaaagggaaccttgtagtactatagatggtcccacagagaaattaattgggacaaaaacagctacacaagcgatatacttcaaaagattcagatattgaaaaattaccagccatgcctcctccaactgcacagttcatgggccctacgcaggcgggacaaaatgaaagccaaaatcaatcatcaggcgaagctggggagcaaaaccaggagcatgggcaaggccctactcctattcttaatcaaagtcaaccggcttcttctcaaccgcaacatcaacaacaaaggaatgagtcgatttcatattatacaaatttcaaccagccacgatattccacggacgcctctatcaactcattcttgaacatatctgataacgtaccagtaacaagtacaggaggacctagttctggcggcgcctattccaatcttccacgattatccacttcaagtacacatcaaccgccagacctgtcgcaaatcggacgcggcttttccattgtaaacaacctcttcccacaacaacagcagcttcaaaatcagcatcggcaacagcagcaacaacaacaacagcagtcgcaccagcagcctcccttcaagaccccttcattttcgacgggattaacgggaagttcttctcaatatcaatttttaccaagaaatgataatacttcgcagccaccttcaaaaagaaactctgtttatcttggacctaatgatgggcctgattttgaatttttcagtatgcagcagtcacagcaaccgcagttccagcctagcagtagaagagaatcaaactctatgagacctccactgttaatacctgcagcaactactaaaagccagtccaatggcaccaataatagtgggaatatgaacacaaatgcagattatgaatcattttttaatactggtacaaacaacagtaattctaatcagaacccgtactttttgagttcaagaaataattctttgaagtttaatcctgaagatttcgattttcaattcaaaaggcggaattcttttgttagaggtactttggaccatagcagccaaaatgcgtttatacctgaatcaagattaaactcactatccgttaacaacaaagctaatggtgatcctgtcgcggataatgttaccaataacatgaaaggaaaaagtaatgaagttgacaatgatgatggcaatgacagtagcaataacaataacaacaacaacaacaacaacaacaatgaaaacaacaatgacaacaataatgataataacgacaatagtattaattccgccaccagtactaatatcccaaaccaagaggaccatagccttgcttctaccgataccacaagcaatagtaggaaagatctaaaagaaatagaacaaagacttcgaaaacatttgaatgatgaggataattactctagtgctatatcaagaccattggataaaaacgacgtaattgaaggcagtgagggattgaacaaacatatagacgagtctggtatgcaacctaatattatcaagaaaaggaaaaaggatgattctactgtgtacgtcaagaatgagatgccccgtactgatcccccgatgagtaaagacaattctacttctgctgaaggagcagcaatggcaaacttttctggtaaagaacctcctatacctgacataagttcagtaagtgatgatgctactaacctgataggtgcaacaaaggtcgaccaactaatgttgattattcaagcaagaaagaaaggtttcacggagaaagtaaataccactcaagatggagacttactgtttaaccaaacgatggacattttaccacctaaaagcgaactagtaggtggtgtggagaaaccaaaaggcacacaaaatacacgagcagttaaaaaacatgaatgtccctattgtcatcggcttttttcgcaagcgactcatctggaggttcacgttcgttctcatatagggtacaaaccattcgtttgtgattattgtggcaaacgttttactcagggtgggaacttaagaactcatgaacgactacacacaggtgaaaaaccgtattcatgtgatatttgtgataaaaaattttctaggaaagggaacttagctgctcacttggttactcaccaaaaattgaaaccatttgtttgcaagcttgaaaactgcaacaagaccttcactcaactaggaaatatgaaggcccatcaaaatagatttcataaggaaacattaaatgccttaacggcaaaattagctgagatgaatccatctgagaatattccacttgaagagcggcaacttttggagtactttgcgtccatttataaaaattcaaacaggggaattaaaggtagaggaaaaggtgtaggaaccaaaaaatcaacaatttcctcaccagaaaaccatcctgcgagcacaattttgaatccaaatacaaatgcaaataatgctattgctaatgattctgaaaataacggcaaccctgaaggtaacattgacagcagtagtaacagcaatccgggctcacatagtatgatttcgccgacgcaaaaagacatgggtacgttgcaatcacaatttatccaaaataattttaacaattctgtgaacagttcgaatccgtccaaccaaccaatcataaactacaattacaccacacttcctcattctagattaggaagtagtagttccagcaataccaacaataataacagcaacttttcggtaggtgcagctccgggtgtattaatggcgccaaccaccaataatgacttcagtttcaacttggatcaatctaatgataatgaaagatctcaacaagaacaagtgagatttaagaacattaattacaaaagctagcaggccttagaggcactacctttttttttttttcgagtttctacaccgtagtatctgatttcatagtggtattcgtcaaacttaacccacaagtgtcacttttcctttctttttttctttttcttgaagaactgcatggttttctagctctttttcacttttttgaggttttatttatcttgtattctttttttctattattttaaaggttcaatttctatcgacggtttttttaattatatatatatatatatatatatatgtatataatgaatgtgtaatattccaagtatacgtaccttgggtttatattttttaacttgtatattcttttacgataaaatttcttccaattaacatcccaggccttgcttcaatttatcaattggtatattaactttcaacacattttgtttttgtttttatttttgttttttttatttttttttttttttcgcgtttcgtgctttaatgaaacatgtgaagtgtttcgcaatgactaagtagcctccacagatgatcagcaggtattgtactttatcacaccagttatactaccttctgtgttattgatctattgcagttttatagagtgatctgtccaaagattcttttcaagaatcaccatttttctaattaaattatcttggatatctcccggacgtaccccttgaggcctatcaaacccttttggctgatctgatcataaaggacctaacaacattaccacagaaaccataaaacattcgaatgaaggctactttactgttgaaggcccagctctcacctgttagctatacgacgaagaaatctttccaaaggcaactcaatcgcactccatacactgcttttcaatacttcttccaacttgaagtccaaaagttacataacgtctcgaagtatgaggatattataaatcacgtaagagggaatagcaattttaaaagatttgcaaggaatgaatgggatagcatgtcattgactaagaaaagactttactatgcatccttttgccagtcaatggatattgacattttgaatgtcagtaaaattgaacttgccaaaagattagaaattcccataccagcaatgagtgaatatttgttatttagaaataagttcaaggtaaaatttgactctcattgcagctccttggagcgtaaagatcgtaaaagtgttccacgaccctctattactaggaaggttgcaactacagaaatatgttcaaaaagccgtagcaacacacccgtcggtaaaatcaacccccggaaacgattagtggcattgaaaaggatttcccgttcagagaacactgcaaaaaatcattcccatgaggctcaaaattacctttatgattatatgaaaaggtttcaacaaatgtgcaaagaatgccggtatgcttggaacgaagaggttgactatgaccagaaactagaaattagaaaaaaattacaggtatggagggcaaaatttgaggaaatgatggataacgagatacaaatattacaaaaaaacatggatatcatgtcaaagtttggtctcagaagtgagtcctatcttacagcagcgaatcacgatacaaatacacaaccaaataatattcttcccatgacgtacctactaaaaaagaaatgacaatagacttttagggctttaagaagagtccacgaaagcacttcactatcataaagactatatgtaccttgatcaaagaaattattgtcaagattttatagtaagggtattattttgaaaacggagtcacctgttcttttatatacacacttatatctatctatatgtcgatgtacattcttagaacaaaaatctgtcggacctttactgcggcattgtgacttgaacatggaagctaactcccttgggaaaagctgttttaggcctatctgttggcctgtcgataaaagacgccaagcaaatgacctcttcagatgaataacctaaggaagacaacacgcctctaataattcccacaggtatctccaaaaacggttctatcatttttaactcctcgttttttgcatcttcctccaaagaaaatgattgaataggtcgatagtcataatcaagaaggtaaaaggttcctctgtggtttgtttttaaattatcgatctgtttaccaaatatttgtttccagacatccctacaaatgaacttcattattaatagaaggtccatttccttgaattttaaatttgggttgttagaaaatatcaataactctgacagcttcaatccgatttgaaacccaatattcctcagtcttgctaaaaccttttctttttcctcttcatccgccttatacagctcatgtatcaagttatgagaacgtatgatatctactgtatgatgttcctctatcttcagtctctttatcatattgttgatgttaccattttcggaagttacattgctatcagaactgataacatcgcctgatatttgcctctcaatgcccatagctagaggaaccatctcgttcaacagcatctgatacacagattgacttacttttggtaatgaattctcaaaaatttgatattgctgttgtgctctttgttgttccgttagtggaccttgtggagaagattggggatgtcctacattattactatgtgtagaggacataattgtttatcttccaactttataaccggtgtatgttttcttttatggcatgaggtcttcactctcagcttgtgagtgcataccagattccaaaatatttagcatttttggtctcaaaacgttgacgcgagtttttgaaaacgatacgctggttctactaatgtgaagaaagcaaatttcttataagtaaattttgtttcatggtttttatcatgtagttttatatgtataaatacgttaaatgactgtggtagaaaaataatacaaatgctataaaaaagtttaaaaacgactactttagttcgcttttaaagctgcctcatttgagagactttcaaatagacatcgcttaggaaccagatccttttcagatatattagtacctttaacaactttaaaggaaccggtaccgatcgacatcgtttgacccaaaataatacattcagaaacaccttcaacagcgtcctttttcatataaaaggccgcatcgaataaatggtcagttgtcttttcgaaggaggctagctgcaaaacagagtccctcattttactcaaaccaaatcttgtaatacccaacacttcacccttatatgtcatcacatcacctaatagttggatatgacgtggatcgacactcataccgtgattactcatggtatagttaatttctctaataatgctatatcttgcagcttcgatacccaaaacggaaaagacttctaaaacatggttagttgtagttctagaaccaatgacaccatctgtacacatcacatctcgcaggccgtaaccttcaaccaataattccctcttgccgtcatcgcgaatattaataaccgcacgagaaatatcaggtaaacctttaacaacaacatcaggaagcgcacgacgtaactgttgcattcggtaaaaaacatcattctcacttggttctttcgcagatgtagatatcgattttgctttgtacccttctgggaatacgttgattgcaattcgatctttaccaataatattgacatcagaggcttgtattttcaatttagaagccctggttatagcaaccgcgatatcttctatggtcaactccaattgtagtttatcaatcgtacctaaatcaatacgcacttgaatgaaagacaagttgtctttgtaaacatcttggacatagaaagctacgtcagatagcagtgtcttttccactctacctttaacaaccctagcagccctttcatcgttatcatttactaatacagcatttataataggtgtagaaatgaccttggaagcattgataatttctttgatacgaggaacacctaatgtaacattcatggaagccacacctgcaaaatgaaaggtcttcaatgtcatttgtgtacctggttcaccaatggattgagcaccaatagcaccaatagcagtacctggctccagtcttgccttacgatatttgaaaagagcaatttctaaaaactttctcaccgatttttcactgattctataaagttggcttacagatgttttaacattatcaggaacggtttcatctggatcaataccttgtaattcttttgcaggaggttctaataggcctaacattcccctggactttcttaaattagccaaagcagttgctttgccattaatatattctcttaaggaatggtaaaaatctctctcggcatcatactgatccacatattccgctttattcaagtcttcccttttcactaaacatccactattatcatatctgaccaacctttcctccaatggtcctaatatttcgtttgcagtttccataattgcatagggtagtaagcccttatcttggttattaaaagtaatattgtatgcatggtcccaacttctattgaaattgaccggttgtgcattaccttccatttccagaggatccaacccgtcaccaccatatgtgaattggacgataccgttggctgaagttctgaccgtattgtcatactgacaagaaagatcttctaaagacttcattaatctacgagacatgtaaccagtctctgcggttttaacagctgtgtcaactaaaccttcacgacccgaaatagcatggaacagaaattctgggggagataagcctgaaaagaaagaatttcttacaaaacctttggattggggtgttttcgaattcttggggaaatgcggtaacgaacgatcttgaaaaccatccggaacacgattaccagaaataatttgttgaccaacgacagccaccatctgtgaaacatttaatgtggaacctttagaaccacaagtagccataattaatggtgcattccaattatctaattcattaatacaaacatcaccaacttcttctctgactttagatagaagcccaccaatcttagcttccaatgtttgttcttcattgcaaccaggttgtgtttctaattcacctttattgaataatgtgatcaattcgtcacacttatggtatgcaatttcgactagttcttccttcttttgcttcaaatcatcagcaggtgtgacatcattaataccaatagaaaaccctctattacctaagaacctagcacatagttttgccattctattcatagcattagcggcttcttgtgggccgtaatctcttaatatcgtataaaacacagaatgcttcttaccatcacctagaacagacttgtccatcaccccacttaaaatttgagagcctctaataattacaaacccgtcgttttgtgacatttcatttggtagggattttgattttggagggacaaagactttgttcttcgcgtctaagtttatcacaactggggaattgtgatttggttttatcaaaagtgaaaaaacttgtttaccggtccataagtaatacggtttcatgatagcaggaggtggtatgtcaaagtgctcgataccgtcagacatcatagacaatagttgagttaatgtagcacgatcatagaaagaatccttatgtgatattaaatatgaaccagttatgaaatcttgagtagccgcaataataggttcacctgacttaggtgttaataagttatttttcacacccattaaattgatagcttctgcacgagcctcttcggtttgtggaacatgcaaattcatttcgtcaccgtcgaagtcagcgttataaggtgtgcaaacacattcatttaatctaaaggttctccaaggacgaatcttagcataatgcgataaaattgataatctatgcaaagatggttgacggttgaataggaccacatcaccgtcttctaaatgtctttcgacgacatcaccaatttgtaaatttttggctaacttcatacgatcaccatatcttaggtttcttcttgcatcttcgtttcttttcagtaaatagttcgccccaggatggacattgggtccatttacaattaattcttgtaatttatgtctattataccttgttaccttttcgggatacgtcaagacttttgcaacacgatctgggacagcaacctcgtcaatggacaagtttgggtccggagaaataacagttctaccagaaaaatcgacacgcttaccagacaaattacccctgaatcgaccttgtttaccctttagtctttggcagaaccctctaattggtttcacttttccgccgccattggatgaacctggtagcatcgcaggattgactgagtctgagttgatgtacattgcaacagtcagttgtaagtaatcccaatgttccatcatattgttaatggaaatacccttgtcaagaccggctttgattaaagacgaagtccaaactatttccgtaagctttactgtcaagtcatcttcgttagatgctggagagtcttgcatcataacggaaggccttatacaaaccggaggtgcgggtaaatatctccatatgtaagtctctggtctaccagagggaactgttgcatctataccaagcagctcacaatctgcagacttaatttgcttgaaaagatttaaagttttcagtggatttaaatcatccatacaacgtttcacataacgctctagttctggattatgagcaagaacttccttccattctcccacccaaatatccttttcaggagcggactttttacctacccaacgaaatgtatcatggataatcttcaacgcggctgaaccagcaccagcagcggcttttttcacgacaccattaagagcaccacaatgcagacaccttctttgctttttacattggtccaaaatcttcttcaatatacccatacgtcttaaattatctacgcctggacgacgaagttcatgcaaaaattgtcttttatctgtttctgataacaatatggcagaacagtttttacagataccttgcagtatttgaatggtggctttgaagtacccaatgtggaaaacaggcaaagctaattttaagtgaccaaaatggccatgacacgatgccaagttgccgtgacaggttgcacattcaagactggaggaagagacacccatcttggggtctaaagcaccgttcgccttaggagcacgatctttttctaaatcgaagagatctcttgtagacacttccacttcagactgggcgacaatatcggcagcgcttaaagcgctaaattccagccctttaatccttttcggggtttcacttacaacgacttccttcatcgaattcttcgaaattgcgggactcgcttacagttttggagaaagcagatagtattgaacacaataaaggaacaactatgtaaccaaccagtgatgagtttaaaaatttagtgcagatggaaaagaaaaaaatgatctagtatactgtctgcaatcaacaaaaactctagccacaacaaactaagcaatcttccccaaatcaacgatattgtacgattaatatatgcaaagaatagtaaggtaagctatagtaaaagggcaagtttaacctcttctgttatttgatctggtgatgagttctgccagaagagcctgtgcaataattttgcaaaaaaaatggcaaatttcgtgaaacacgatattcacgtatatagtgatgataataagcatgctatatatcagtagtatgtattttgcagcttctactttctgcaatgtgatgccgttggcattgagattccaacgaatatacacagatgcctgatttgtttgcgattagttactgtaatagagaaaaaaaaatttaaaaaagacgaaagcccaaaagagacgagtgcaattagtggctgatactttatactatgtttaatatatatacctggtttacctagtgagtatgttcgtaaaaaaataacgtcagtaatggttgttggtcggcagccttggcgaattccttttattagcaatggtttaatcatgtagttacccggccaatatgtggtggcaaaaatgaattaatgtatattttactgaaaaggaccccattaatgaactcttgggtaaaaagggcacatcaggagtttgtctaaaacgtttatacgagtgacttatttgtgcattatagaggtgagaacaaattggaaagttttgattttagtttaagatggccaccttggaagaattggatgctcaaactttaccaggagacgatgaattagatcaagagattttgaatctttcgacgcaggagcttcaaacaagagccaagctcttggacaatgaaattcgtatttttagatctgaattgcaaagactgtcccatgaaaacaacgttatgctcgagaagattaaggacaataaggaaaaaatcaagaataatagacagttaccgtaccttgtggctaacgttgtcgaggtcatggatatgaatgagattgaagacaaagaaaatagtgaatctactacacaaggtggtaatgtcaacttagataacaccgctgttggcaaagctgctgtagtcaagacttcttctagacagactgttttcttgcccatggtcggtttagtagatcctgataaacttaagccaaatgacctggtaggtgtgaataaagactcgtatttgattttggatactttaccctctgaatttgattctcgtgtaaaagctatggaggtagatgaaaaacccacagaaacttactcggacgtgggtgggttggataaacagattgaagagctggtggaggccattgtgttacctatgaaacgtgcagataaattcaaagatatgggaattagagcgcccaagggtgccctaatgtacgggcctccgggtacaggtaaaactttattagctcgtgcttgcgcggctcagacgaatgctacttttttgaagctggcagcacctcaattggtacaaatgtatatcggtgaaggtgctaaactagtccgcgatgcttttgcactggccaaggaaaaggcaccaactattattttcattgacgaattggatgccattggtactaagagatttgattctgaaaaatccggtgatagggaagtgcaaagaaccatgctggaattattgaatcaattggatggctttagctccgatgatcgtgtcaaagtcttggcggctaccaatagagttgatgttttagatcctgctttgttaagatcaggaagattggatagaaaaattgaattcccactcccatccgaagactcgagagctcaaattttacaaattcattcaagaaaaatgaccactgatgatgatattaactggcaagaacttgccaggtctactgatgagtttaatggtgcccagttaaaggcggtaactgtggaggcaggtatgattgccttaaggaatgggcaatcttccgttaaacacgaagatttcgttgagggtataagtgaagttcaagcaagaaaatcgaaatcggtatccttttatgcataaaaataataatattttgatttatcaagccgccattcacatatctacatattagaacaatccttttatttaaagtcgcgtaacttccttattattgatactgtatatggctaattgtatactacttattatttgatgaaaccgaaagcgtagcaacaggtatatattcattggcgtttgacttttttttttactgtatttttctttttcgttggcactttcgcaattttcaaggatgcattgaaggaaagagaaaagcgtaggagaacaagacgcatcgacggctacgggtgctttgagtatttaacttgcagagctccatatacagcacacatctgtagatgatttagtgacatattaataggctgcagaaagggagtaaaacaggtagaagtaagatatcggcaccattctacttttcatataacgattgattaatcttaccaaagcattaaatttaaacaggcttgcagactgaaggagtactactaaagcaaccggaccaggtaatatttgttgtagtattatgggacagtcttcttcaatcagttccagtaacgaagagggttcttcccactcaaaaaaattcacaaatagcaaagatattttggcatatttcaataacaaagcacagcaacaggtcactattccagaattagtcagttttaagggaaatttgcaaattgaagatctaaacactccaatttctcacaaagctttatgcaactcactttattttccgcagaatcatgccatgattgttgggatagtgactaacatgttgagggttttgagcaacttcccattaatgaaatcatcttacgaaccaattacgggatatgggttattaaaatgcattttgttgttaaacagggcacgatgtgccaaattcttgaaaaccaagtcctatgatcaactaaaactgctgtttatctctttatcacttcagaaaactgacaaagaagaactctccgaagaaagtgaaaacgacggaaacaaggagttgactataaaacaaataataactgggtttgatgatgttgatacagaaatgctgtgcattcctgctgattttatgcttcagtttttaacttggcttttaattttaacagttgattgtccaaccaccaattctaaattggataatacagagactcatgatcaatggggcaatttcaaagtctcagcactcaatctccttagaactatgaatccagacgtggtgggcgatatagaatcacattccataacgtttcaacaattttcaactgcaataagaactgtaatgcccaatctattaaaaccattagagaatttaatggagcattttttttatttgcagcacgatttagttgatcatgacacaaacttatcgtctattcaggattctaaagttatgactccagcactgttggcacagttatcgacgggactaccaaaggaattatttattcataagctacaaagtttatacatcggcaggaaaagtggcttctcaatgaggtctttgcaagcaaaggtgttcaaatggatggcgccttcgattttagttgttagcggaatgaggataacaaattctgaagaatacgcagctgagaagaatccaagataccgccattttcttgaagaatttcctaaattgaaagagtcagatcaaatgatggatgcatcgcatttgaataaaaggaaaactactttcgctgtgtacatagacgatccgtggaaagtaacaaataaagattattttggcgatctgaatacgagaataatagaaatatcacccaggcaggatatttataaagtcaaccaaaaaggcacgatctatttcaatacaattggtggcggaattggaatcggggataaacaaccattaataaaaccagcatccaagagatacataccagggaacgtgtcgcttacttttgacagcacattagaatttgctgtgtttagaaatactggttacggaggttcattagaccctggtttattgtcgatggaaagaaaggaggaaaattccccttatgaattgcattttttgattcaagatgttgaggtatggggctgtggtggtgagaaagaactagaagagcaaatcaaacagttggaatgggaagaagcagaatctaaaagaagacagcaaattaacctgagaagcttgggagaagaccgtgccttactggaaatggcaggtttagttggccaacatcaaggtggcggttcaatgtgatgcctgccttttttgctgtttttagttattgggattgatttcactaaaaatcaagaccactaaataaggctattgtttattttaatatttattgcacttgtatgaaaagtaccaaacttttgatactgatattacacttttagtcttgaactttcttcgttaaattgctgacctactttctgttcttcgactccaaacaacgattcccaaatgtattttcacagggccgcattatttctttgatttcgtttttttcaccaattttttcttgatgtgcttcttgacttttgttttccttttttctctttttgcatctttagcttcctgcttgcgcaatttttttaaatccttgtcctcatgtttcttcccctttaaaacttttggttcatcatcgtcatagtactcgccctcctcctcgtcatcttcttcagatccgcttgagccgtcttcttcatcatctgagaattcctctgtgccagaactacattcgtggtcagcgttatcaaattcaaattgctcagaagcagcaaaattgcgttcattatcatgggcaatcaagcttttcagtaagtcaaacttaccatcagtatacctatcaaaatctctttcctctaatccacccaatgatctaactaaatgcagcgatctgaatatttcatcttctgcctcatcttgttctgtagattttattggtagattactagcaatgtatgcaaccaaggcgctaatattgttataatcacctttaaatttctccaaagtttctgatatgacaaattgaaaaataaccctttcagggaaaatacttatacccatcttctcgaaataaaggttaacgtttttgatatccatccttaaaaaatctaaactcattggatgttcaggttccacactttgggaaacatcgatcatatatagtttatcatcatgaactatggtgttatactctgacaaatcggcatgaaccaggcgacaaacttggtacagcaatctcatatatgccaccattgtgtgataataatggaaaatttcatcacgattcttgtacggataatcttttaatttaggtgaggcaaatccattacctcggcttaaaaattccataactaagacgttgttcttaacttctattggcttaggagctggaatgacgccactttgataaattcttttcaggttcctaaattccttttcagcccaaattttaatcattttccttggattatgttgagatctggaatttctaaatctaaattcaccatcaacatatctttcacgatctttgaagactaggatagaggtcttataaatcttaatggcatattctgcacgggatccgtctgtctctaaaacttcatactggcctgtttcctcatctattacgggtgccttaccggtacctgcaaaagcgtggtaaacattagcttctttcccagtacttaagcaaccgttcaaatctgcaatcacacctctggtgaccatagacttcaaaaatctcatagttctcggatctaagacattttccacagtcgccctatttgctttatcctttgatgttttcgctctgctgaatgataattcatcagtttttattttgtgactatacttctctaagagctgattattaatatggtccgaggcaccttgcgacacagacaatgaatcaaatttatcttccaaggacatgaccttctaaaaataacggagtttgaatctctaaatctgttttaacttctttttactattatttttagtcttagtatctcatctcatctcaatttctatattccactataaaatttttcactctttctgcgcgcgccaatgtccccgcaactactcaataggtaacatgagaatatttcagttcgtaagagagaagagatgaagttatttgggctctttgctcgaggttacagaagggccgcattagagtgaatgagctgatgatatttcgcccagttctacatttttttttttttggaagtatgacctctgttaaatttttttttttttaaatttcactttctaaagtcccagaaatccgcttgaatgtcttacatattgcaatggatatgcttgggtgatcatacttcctggctttagatatttgaaacttaactcttgtcaacaaacttcctatggagtgtataagaattgtaagttataacaccggcgaacaatcggggcagactattccggggaagaacaaggaagggcggtcttttctccctcattgtcatagcaaggtcatttcgccttctcagaaaggggtagaatcaatctagcacgcagattgcaaacacggcttaataatatgcctatcaggcattcacccgtgtgacgaatcgcacaccgctgctctccttaattccctagagtagaaaccgagctttcaggaaaagactacggcagtaaagaattgctttactgggcgtataaaaccgggagaatcaagacattctaatgacttgattcaggatgagagcttaataggtgcatcttagcaagctaaaatttggacagctctcattactaaattaagatagaaaaatgcctgctactttacatgattctacgaaaatcctttctctaaatactggagcccaaatccctcaaataggtttaggtacgtggcagtcgaaagagaacgatgcttataaggctgttttaaccgctttgaaagatggctaccgacacattgatactgctgctatttaccgtaatgaagaccaagtcggtcaagccatcaaggattcaggtgttcctcgggaagaaatctttgttactacaaagttatggtgtacacaacaccacgaacctgaagtagcgctggatcaatcactaaagaggttaggattggactacgtagacttatatttgatgcattggcctgccagattagatccagcctacatcaaaaatgaagacatcttgagtgtgccaacaaagaaggatggttctcgtgcagtggatatcaccaattggaatttcatcaaaacctgggaattaatgcaggaactaccaaagactggtaaaactaaggccgttggagtctccaacttttctataaataacctgaaagatctattagcatctcaaggtaataagcttacgccagctgctaaccaagtcgaaatacatccattactacctcaagacgaattgattaatttttgtaaaagtaaaggcattgtggttgaagcttattctccgttaggtagtaccgatgctccactattgaaggaaccggttatccttgaaattgcgaagaaaaataacgttcaacccggacacgttgttattagctggcacgtccaaagaggttatgttgtcttgccaaaatctgtgaatcccgatcgaatcaaaacgaacaggaaaatatttactttgtctactgaggactttgaagctatcaataacatatcgaaggaaaagggcgaaaaaagggttgtacatccaaattggtctcctttcgaagtattcaagtaattgtttttgcgtgtttctcgtatgattgtaatatgtagataaattaaacataagtatatcaaatgtcgatattcttaagactgtttcgtaaatatgttaaataccggatgtgactacatataaaaagtgcgccttttacagtgataattagcgtcaatcaataaaatatttgtaaaataggaagcgaaatcccgcagatgccagaataggtggtgtataaggcaagaaaactttacctgcataaattagtattgaacaccaatcaagtagtcagccaattgctcgacaatcttggtggcctcaccggcttgtacggttggtggataatgagcaataataacggtttgcttagttcttacacaaacaacaccctcagcatcatgtctaccgtagatacttctatcgtcagctctcaacaacatgaacttttggccttgaatatgcaaaccattgctttgcaaaccagctggattgtcgaagccttgaacaatttcaccaatttcgtttggttgcaaagataggccaccagaagtagcccaaacagcgtcacctgctctcgagtagatgacagctttgtcgactttaccggttcctattaagttatcagtgtatgctgtttaaaagtaggagaaaaaaacggaaagaaattcatgtttgaaatttcatatgttttttgatattccagttagtaatttactctgagtggttaatcttcgaaattacgcgcatcaacaaaaatcgggcattgccaaacattgtcacacaagctaacctccgactcatttctttcttaatcaattgataattgtctcgttcacataccttgccaagacataatttgcgatcgtagttgggtttatgttgtgtatgtaatttatcttttctcaaggatcacacagttgttttaagaagggaatgagaaagggtcaactgagctttaaaaagaaaaaaaatattaatgcgggtaatgagtttcgtacaaagacatttcatggcgtgttctcgccaaaaatcatggtaaaacctcccacacagtaacctcatactaaatactacaacatgtcatcactccatttctttgcgattgtacatactaatatatataaacaaagtaacgtctcctctaatcctcgtcttcgtcgtcctcgatgaccgcaacccttcttctttttgtctcgctcctatctttttcttcttcttcctcttctctgtacattgctgctccttctctttttaaatttcttagacgagaggcgttctcttcatccgcgtcctcttcttcttcttcttcctcattatcatcctcttcgtcgtcaaacgcagcctcctcttcctcatcgtcgtcgactaaaaagtcatcttcttcatattcatttcttctcgaggctccataggtagtgggtgaattttgctttctaaatcccgtctcaaaagcggcatctggggattcttgtttctccttttctttgagctgtcttctccttctgtctcttaaaatctggctttgctttctctctaactccttcttttccacttcaggatccatacttacaatgtatgttccaggacccttgctttgtctttggttccttcttataacagctttacttagtttttgatgtatttttgaattcgtcgaagttggaataaacatcaacgtcttttttatttcacccccttcgtaacactggatcaactcttgttggtcatgcgatactgtcaaaaaagtgttgctcgtatcgttgaccaatatatctgtacactcttcaccaacttttagcgaatatgtaccgtctgaccactgcactatttgtgtatttgattctttaaagacatgttggtctttgtcacgagagtatctccatctaacagtgttttcatcaatcaggcggtcgtccagttgatcctccctagaagctgaattgcttgccctttcgtttactttggcctcaaaacttggagggtcgaaaggaattggatcgatagttaaaaagttgggaattctagcatagaaaatttcgttgtgagacgccgtttcattcacattagctttacttggaataatatgtctgacaagctctacattttcctctttaaaagtgtgagtagtctcatcttgatcagaaaagttattagcatcctcaccataaaattttcgggtgtacatggcttgctcctctgcttcatcatcatctaacccgagactttctctatgacgacttctatggttgatattctctccctcgtcgtcttcatcactatcactatcacttttttcagtctccgattttttaacatcatcatcatcatcgtcatcattgtcatctccaaataaatcatctagttctgcgtcttcttcttgttcctcttctttagtatcatcatttccattgacttccttgacattatcatcttgagagcggcttgtttcctcattgcttgtactattggtggtaacgccgacgttattgctgatttgctccttctgtggttgatcctgtgggctttcagatgacatcttaattatagtccagtatatctaattggattactttgattggacgcacctagtttacgcaacctatctacttaacgactttcttcagctttcgtattcacttctatgagcttgttctttttttttttgttttttcgtttttctttacgtagcagatagtcacccgtaacgattgaatatggcaaagctttttacataataatggtacttatggcaatagtgacattttacataaactcttcattgactaagactactttagaattcttttcaatggctcaatatcaccttcttgtccttgtttgacatatactaggaaatatggagttgcagtgttaccctcattgaaattgaagacctcctcttcctggacctcactgatggtttcatcattgtacttcctccaaattccattgcgatttctgtccttgatatatatccaatagtgaccataactggcctcgccgcgatgaataaaaaccgaaaacagtgagtaaccatattccttgaaatcgtcaaattgatggcttattttctcttccaaactgttgatatcattgtataatttcatcaattcattatcgatattttgaacgttgtttctcagcgtctttatcacatcattagcagcctcaatttttaaaggagttttctttatggtatccgattccaatagcttgatactctccaaaaatgcatccttccttgtaagccctgaatcatcacgactcaaaagctctctttgtctatttttcattaccttcaacttttgcttcatttcttctgtttctttcttttttgccaacaataaagggttctctgtatccgcgtatctgtccatgtaaataacttctttgaatggtaagggctcaatggatttaaacggcattaatctttcacgatcgtaataaactctttggatttgtacctgcaaaatagtaggaaaagttgtaacagcaacggtacgtataacatcaccatactcttccattgtcagatattcgtctttaaaataagaatcaaacgcatcataaatatctttaggatgatcgccaatatttatcagtaacgataggaatctttcaactttcgtacggactttatttgttgcggacaaaggaacaatactttgtttagtagtaccataaaatagttgcttaaccaagtcatattgctcgttgtcttcatcatatcggataggctctgaaccgctttctatctgaaataacacgtttcctatgcattcagtaacatcttgttgcctacccatttccaaagcattttctaattgatcagaactgatttttgccacacgcgtaggtgaagttaatcctgttgtatcttcgttctcacttacttcagcatcattcgattcatttttttttctgttcgcatctgtaccaacatcgccattaaggccatcttccatttctaaatcaatcaggcttgtatcctttatttttgtagtaaatgcgtcatccgttgtttccttctttgaatccgaaagaactcctgtttgatcaactactttattgccttccacttcaaattctacttcaacattacttggagcaaatgccaaatatgctagctcttttgagggtgttacacatctttctcttgtatgaaccatcgcatagaaaaggttgcgaagttggtatatgaattgaatagatctttccacttcgcctctactaatttctcttccaccaattcttctaatatgcccactattagagaggtggtcattgaaattttctaccgttttttgatattccaatacatatcttcttagtggcgcaatggaaaagtaatattgtaataaagaatttaggtaacaggtgttcccgatattattaatgccagttggccaattttctggcggcaaggaatttggatctatcgtaccagttagtaagaagttggtgattaaagttgaatttctttctatactgattttggtcaatgctgccctcaaaataagaaattggtcaggctcataaacgttttcatcaaaccacttttgtttaaagattttcaaaatggtttcgtcagaggcattttcattcacttgaagaagcttcaatgcctcttggtaatcaagcttctctggaccataatagttggaaaactgtgggcattcctctgttaaaaaattgaacaaatcaaggcttcttttactgatagcaatggtgtaaagtgctctatcacaatccaactttaatccgggagagtcgttaatcttgaccgaatatgcagtttttataatgtcttcatcaacagactcgtcaattgaaagtgtgtcgtatgcctgggataaagctctgtagggctcatgatcgacgtaaaattttagtttgtcagatttggtatatttggccaacaatcttagagcatttttcaaatttgttaggtgattagaggttacttggctcttatttgatgtttcatatttgtaaatagatagcaaagtcgcctcatttaattcggagatgttacactctttagggttaattttaaacattaacaaagcattttctagagcttcttggcctataatgtcctgttttccacagtaagcaatcaattgatatgcccccttcctatttgcaatgtatgtcagtgcgtcaaaatacagcccaatattttcaggatccaaagaagacaaagattcgtagtttctgattatatctctatcggtataataatgcgaaacggaaagattaataaaatgaggttctgcgtccaaaggcgaatgagtttgctcattggaatttaatagaatccttgctctggattctcccaataaatggaaccaaggtagtgttgagaaagaagtttgtaatgaagacattccctttacgcttttcgtatttttcaagggagaattaggtgccagtaatgaggtagatagttgaccccaaaatatcagttgtaaacacttcctcacaaacgattctcgaatttttcttgtctccaaatcgtttacatagtccaccatatctggagggacgtattcagtaaatatctcattagtttcctcatcgatttctgagcttgcttgaaatccatacttggacgttaaccattcaggattcaggtgagtgttaagggccaaatttccagaatcaattgtctttgtaggttccgctttacttttcctcgtcaaaggccctttaaaaattttaaaaagtgtgtaaaaacagtcaacttgagatggcgtctcgcttttatctagtgattcattttttacacacatagcattgtatctcttcttaattgcgtcggcagtaaaactctcatgctcttcaggtgaattaaactcgggtttaaaaatttcaatcaagatcagtttgttagtatcatcagaaacgtaaataccgtaatccaacaaattaggatcggaagaatcaaaagtcgaaaggtctactcgatcgtattcgtgcaaatgatctagtgagtggaattgagtaacaccgacatgcttcttcaaccgctccagttcttggcggacttttacgctaaccttaagatgataaataggaattttaacaatatcatcaaaagttgaaatttgctgttctgccagtgatggattaaagatgaccgcctgaaatacatgtattttattatattttgggcatgaaatggaatcatactcggattttgtttgaaaaaccacttgatcagttaatgaacccaagcagttagggcgaatactacttctgaaagttgagtaagaaagcatagactcttttaaaatacccctcgattgcaggcccttttgcatgaccttcgggtctgtagaattgagaaaaatagtatcgcaaagtatatcgtccaaaagtctgtcagaagtcttcagtggtaggttggtggcaatatctggatacagtaagtgttttccatcgtcaacatctccaggggtagactgctggtttatacttgtcccgtataatgggaggtcttctataacagacccatttctgtcagcattttctttatcctggtttagtagttgattatgatggttctcaattgctttttgaagttcattatcttcgttcggcatttccttataccttcttaaccttgaacaaaagctttctttttaattaccactttattattagcagtggccccgtttttatgcaatgttcttccaatggcaagccgcttgtttttttcaagctatatgtactatagttttgctctaattaactgttactcttgttaaagatccagtttgtactcacccttagactatgaacccataccccatttacataattatagacagtgtatctattcctgtcatattggtcatatagcgttaaaatgcgtaaggatgatacataattttatacatgatagtttaattaggacatttatcaaaccgttttcctttcaattctccttttctggcataacgcgactgatgtatgccactttctggtggttaaattctttcggcactccatatagctactctgcaaatcgttttaataccttcagtgataactgtatatggaactgccatatacgaatcatgcttgatagcggtgtctagatgctctagctcgtcatccctgaactgttggatagtagaagttaaggatttgatttcctcacttggaccctttgttccatctgttctttctaaattgaattgattggccaagtttcgcaattggccattgtagtgccctccgattactgtctcgacagcttcagtacaagccatagctgcttctggagaaatcaatgcggtaccagcccccattgcaaaggctcctgccttccacaaaggcgttaataaggaaggcctgactctccttttcaattgcaaattgttaaaagtattatgatgatgtatctcctggtcccatatgtgctttagcacaggtttcaagtgagggtacctatgagccaacacgaagtactggccagcgtagatgtagtctgcacctaattcgccagcttgatctacacgaataacacggtccaaaaatgcagcctgagcatctgataaattctgacacttgggagcatgctcaggtttttcggtgtgttttgctgatgtatgttctgttatctttaaagatgataagacggaaaagcctctgctggcaggtttgaaaactgaaacacgggataacataatttctatgtatctctcccgtatacgtgatatctttattccttgaattggtttggaggagaagataacgacgttttcacaagaataaaactctcgtctgtaaaaataaggaaacatgttttatagatttctattgttttttttcctgaaaatcccgtatatgaaaaattatacagttgcttaaaagttagggaaatatagacagagtacgtacaaaggattactgcattcaagacattatgttagatccatcatctagcacatctctccaatctttcagtttgtactgcatgtttttgggatgatattgggggtagaatgtctcaatgaccttcaataattcgtcatgaaaaattttgtacccttttccggaaaagtgcagtccatctgttagcagttgttgccaagcatcaccaccttcctgttgaaacgccttattcaaagccacgaagggaactttttcctcattggctagttttgctaaggcatcggaataaatggcaaagttctcgttggtacggaagtatccgagagctatttcttcagatttttctttttcccacttctctctatctactagccccggtcctattataataggacggatatggtaagacttcatcaaagataccatttgacgaatattatcgataaattcggggagggggacactttggggacctgctgagcatgcatcgttggcacccaaaaatattgtggccatgacaatattggattcatgctttaaaatctcaggaagtattttcaacgcccatctagaagtgtaccctttgaaccctctttgaagaatatccatttttctcgtatattcgttgactaatgcggctccaagagcatactgatctttgccatcttcaatgggcctagtattaaaagcaaattcagtaatggaatccccaaataacagaaacttctcgtaatccatatttggtcacagtttaagcgtacgaacagatgataatgtagaggctagttcttggtttcgtatgtgttaccacgatgagaaggtgtaaagtgcccttattattgcgcgctttatgccgtattaggaaaaatgaaaaaaaaaaaaaggcagttctcgagtttagatttgatataattaacgtgtgcttttctctattgacctttgatgagattgtatcagccaactggctaattcattgaacgttttccaagggtaggactgctcaaacagactaaatttctttgccaaatagggtgttttgagttttgatcagtcaacattcttgatcaattcacagttgcttaaaatagaaaaaaaaattgatcggtatcactaaaatttttaagaaactgaaaagcaccacggttttgacatttatctctattatagctttttgtacaagacaaggatagctgattcaggtactagtggtggagagagcggcatattaaaatggcatcaactgctcccaatgaacaatttccatcctgcgtacgatgcaaagaatttattaccacggggcatgcatatgagttgggttgtgatagatggcacacacattgtttcgcttgttacaaatgtgagaaaccattaagctgcgaatctgattttttagtccttggaacaggtgctttgatctgctttgattgttccgattcttgtaaaaattgcggtaaaaagattgatgatttggccataatactgtcctcttcaaatgaggcctattgttcagattgttttaaatgctgtaaatgtggtgaaaatattgctgacctacggtacgcgaaaaccaagcgaggtttattctgtttaagctgtcacgaaaagctattagccaaacgaaaatactacgaagagaagaaaaggcgactcaaaaagaatttaccaagtttacccacacctgtgattgataatggccatactgatgaggtctcagcttctgcagtcctcccagaaaaaacatttagcagacctgcatcactagttaatgagattccttcaggttctgaaccttccaaggacatagaaaccaattcgagtgatattgttccgcattttatcactgggtataacgatagcgatgacaactctggaagttcaaaattcggttcaaatgtgtccatagatgttataggaccggaagaaaatagcacggagcatgtaaatgatgatgttaaagaggaagcagaagcaccttcagcgaatatgtcactcaatgttgctacggatccaaccctaagttgtaaagaacctcctagccattcgaggaatttgttaaataaaacaccgttgagaaattcttcgggtcagtatctcgcaaaatctccaagctcctatagacagggaataattgttaacgatagtctggaagagagcgatcaaattgatcctccaaataacagttcacgaaatgcaagtgaattgttgacctcggtattgcatagcccagtttctgttaatatgaaaaatccgaagggttcaaatacggatattttcaacaccggtgaaatatcccaaatggatccttcgctatcaaggaaagtattgaataatattgtcgaagaaacaaacgcacttcaaaggccagttgttgaagttgtcaaggaagacagaagtgttcctgacctagcaggtgttcagcaagagcaagcagagaaatattcctattcaaacaatagtggaaaaggcagaaaaatttcaagatcattgtcacgaaggtccaaagatttgatgattaatctaaaatccagagccacaggcaaacaggatagtaacgttaaactttcacctgcttctaaagtgacatctagacgctcacaagatttaatgagggataatgattcacataccggccttgacacaccaaattctaacagcacttctttagatattttggtgaataatcaaaaaagcctaaactataaaagatttaccgataatggcactcttagggtgactagtggaaaggaaaccgcccttgaagaacagaagaatcacagttttaaatctccgtcaccaattgatcatttgttacaatcgccagctacaccaagtaatgtatccatgtatcgaactccgcctttagatagctcattgacatttgataggcggaatgggtcttcatacagtaaccaaaattatagcatacctagttggcagaaaactccaaagacccaattggagaatagcgacaattttgaggaacagaaggaaacactttacgaaaatagcgaatctagaaacgatccctcgcttgataaagaaattgtcacggcagagcactatctgaagcaattaaaaataaatttgaaagaacttgaatctcaaagggaagaattaatgaaagagatcactgaaatgaagtctatgaaagaggctctacgccgacatattgaatcctataatagcgagaaaaataaactatatcttgactccaatgaattatcaaataatccaccgatgataaatgaaatcagcttaggtgagtcgccacccgtgaaacatgttgcaactgcaagttctgtagcgcgaagttctgttaaaccaaaattttggaagtttttttcatctgcaaagccacagaccgagcaatctatacaaggtgtcagtacaaataatacaaattccatcgttaaaagtgccccagttttgctttctgctccctcatctggtagtaattccggccgtttagaaatttcaccacctgtgctacaaaatcctaatgaatttagtgacgttagattagtacctatcgagaacgatgcaaatatgggacaaagtaaagatggagaagaatatttggatggaagcaatttgtatggttcaagtctcgttgctaggtgcaattatgaaaacaatgaaataccgatgatactatctgtctgcatagattttattgaatcagacgaagaaaatatgagatcggagggcatttatagaaaatcaggttcccagctagtcatagaagaaatagaaaagcaattttctgcatggaaagtacaacaaaataccgaaacgccaaatattttaacggaacaagatctcaacgttgttactggtgtgttgaagcgatacttaagaaagctccccaaccctatctttacctttcaaatatacgagccgttgatgaggttagttaaatctaaaaaaatgatggaaaacttgccatttgttggaggaaagttgtccttagaagcaaagaattcggacacttatatgtcgagcaagagcgctttaaaaaacatattggaagaccttccaagggaacattatagggtgttaagagtactgagtgaacatatagaaaaggttacacggtacagtcactggaatcgaatgacgctttataatttggctttagtttttgctccaggtttgattcgtgatttcagtggagaaaaggatattattgatatgaaagaaagaaactatattgtcgcatttatatttgggaactacaaagatatcctgacgtagcgctatcctcggttctgcattgagccgccttatatgaactgtatcgaaacgttatttttttaatcgcagacttaagcaggtaattattccttgcttcttgttactggatatgtatgtatgtataataagtgatcttatgtatgaaattcttaaaaaaggacacctgtaagcgttgatttctatgtatgaagtccacatttgatgtaatcataacaaagcctaaaaaataggtatatcattttataattatttgctgtacaagtatatcaataaacttatatattacttgttttctagataagcttcgtaaccgacagtttctaacttttgtgctttgacaagaacttcttcttcttgctttaataaaaactgttccattttcgttgtataacttgaatcataagcgccaagcagtctgacagccaacagcgcagcgttcgtactattattaatagcgacggtagctactggaacacctctaggcatttgcacaattgaatgtaaagaatctactccatctagacaagaaccttttacgggcacaccgatgacaggaagtggtgtcattgcagccaccatacctggcaagtgagcagccccaccagctccagcgataattgttttaattccacgcttgcttgcggaaatagcatatgctgacatcctatgtggagttctatgagcagagactattgtcacttcaaatggaacgccaaaatcttttaaaaccgcacatgcggcagacattaccggcaagtcagagtctgatcccatgatgattccaaccaatggtttgaccattgcttccaagtccaacttttgagcgacagagattttgattggaatatcagttctacctgtaatgtagttcagcctttgttcacattccgccatactggaggcaataatatttatgtgacctacttttctgttaggtctagactcttttccatataagtacactgaggaacctggagtcgccaatgctctttcgcaagtttctagctctttatcttttgtatgtttgtctccaagaacatttagcataatggcgttcgttgtaatggtggagaaagatgtgaaattctttggcattggcaaatccaatattgatctcaaatgagcttcaaattgagaagtgacgcaagcatcaatggtataatgtccagagttgtgaggccttggggcaatttcgttaataagcaattcccctgtttctaaatagaacatttccacaccaaatataccacaaccgggaaaagatttgattgcattttctgccaacaacttcgccttaagttgaacggagtccggaactctagcaggcgcataacataagtcacaaatattgtccttgtggatagtctctacaattgggtaagaaaacactaaaccgttaacagatctcacaatcatgactgctaattctttagtaaatggtgcccatttttcggcgtacaaaggacgatccttcagtacttccaaagcttccggaatcatttccttattctttacaacgaagttacctcttccatcgtatgccaaagtcctcgacttcaagacgaatggaaaacccaaatctcttccaacattcaatagggacgtctcactggcttgttccacaggaacactttgggtaactgctataccatttttgattaaatgctctttttgaatatatttgtcttgtatcaatctgattgtttctggagaagggtaaatttttaatttgggatgttttacttgaagattctttagtgtaggaacatcaacatgctcaatctcaatcgttagcacatcacatttttcagctagtttttcgatatcaagaggattggaaaaggagccattaacgtggtcattggagttgcttatttgtttggcaggagaattttcagcatctagtattaccgtcttaatgttgagcctgtttgctgcctcaacaatcatacgtcccaattgtccccctcctaatataccaactgttctagaatccatacttgattgttttgtccgattttcttgtttttcttgattgttatagtaggatgtacttagaagagagatccaacgattttacgcaccaatttatacatgaaatgctccataatattgtccatttagttcttaataaaaggtcagcaagagtcaatcacttagtattacccggttcgtagccatgcaacaagagtcatttgtcagcatagctgtaataatcaatcatgacgtaagaaatgtatcataattaaaagttgttaaagatgtcagtgttatgttggtgttacaaaattctcggcttctcactaatatttaatatctcttaaattttatctgtctttgattcttttaagaaaagttatgtattattcaagaaaaagtcaattccgcatcaaaaggtaaaatttatataaactgctttaaaatttcatgaaactaggcaacttttcgaaatgatctttttcgagcatgaagtttcttttataataacctggtcaaaagctttcaatatataatacatttggtatttacggaaatgagatgatatactggtagtgcgctagtcaagttctaattaaattaaaatgcaaaatagtaatgtcagatggacacattgggcgaaatagctaacccataagcatgaatcctgtaacttatgtaatacgttaatcacgatacggcgttactagtcttccttttgagtggtttctaatgtagattcttgttgttcgttaatttgcttcaagccgtttagcattcctgattcgtttgaagatagaggaacagatgcgccagcgaaagatgatgatgcaatggtagaggaagtgttggtcgaatctccctttttggaaataaagtgtcgttttgattctagataggcttctcgcaattgattgtggagatacttctttaaaagggccatacctatgggatgacattctaacctatagagtaatttcgtaatagcatagcagatttttgacgcccttctttctagtagaggagaagcccttagcttgggtgagatgactgaggatgcgtttgtaaattcgggataattggaatttccagtaccctgcccattacctcccagaatccttatattagggcgtgtactcagttgtaaaaactgtctcaatgaagaagattgagcaattctggtcaaatacgttcttctcctggacagagattttgtgaagggcaaatcctgcccactttcttttgtaataaatgtgaggaaaaacgccaagatatcaaaactgtaaatttgagtaaaaagatctattgctgatactataacaccgtggggatctttttcgatgcccatatagctgttaaaattatcgaaaccctgacgcacttcgctttcaaaactccacctagaaatattatcaccgtgtaactgagctgtgggtaatattttgaacggagaatagttcaaacaagcgtttaaaaacttctcaatgtttgtcctgcttaccgataccatgcgaaacagctctttaacaatgtccaatatttggcttaattgggaatatatttgctctgtggaaaataactggcatgtgtttcctaagctaaataaacaattatccaagttagacaatagttcaatactatgcagtgtaaaataatcaaagaactccgggaaaatgaaaaaatctttataaaacatgatatattcatcttttagtgctatattaggtggaatttctcgtcttttcaaagcgtccagaaggttttccaactgaagaacattcagccttctcaaaacgctcatgatagtatcactatcatgatattcgtcgataagaagagaaaagagcttctggcccaagtttacctgactttcgttgactgcgttggttgagaaatgaggcctattgaatatctttctcaaagggttaggcccaatcttcacttctgccactgtatctggcttttctttttctggactattattttcataaaacactccctcatccacatcgtagtaataatcccagatatctaactggtatcggaaaattggattggcagttccgataattgcaaagcatccgacaaaatcactattcgatgctacatacgcccgcaaaccgtcaacaagagaaatgtccatatagggaaaaatcaacgcagcatttcctttgaagtatgattgtggatcgctagcataagttgccgttatgttggctaatgacaaaataaaagcgcataggtcttctttactcagtttagttgaattgatgactaacttccatgcattaactttttgtccggctttaagaaggtaagggacaaatttatccaaaaattttaaaactagttcattataatcattttcaatataaataggctctcttctaatcatattaaattgcaatgggatttttaacaaaaatggcgggagcgtctttggctgaaatcttgtaaaatgatattgaatgagttggtcatgaaaagtcacaatgttaccatacttgtccttagtgtcaaatccattgatgcaaaagagtttctttaaagtggaatccgggtctaaaaatactttggtaatgatagattcgtcatggatagagtgtagcacttcttgtatactacttttggaatgtatgtcattaatcaatgtaaggtcaatactgtttagcatattaaagcaatcaagcagtatgtctgtagcagcagcttgagtgggagctttcatatacaagtctaacactaatacaataatatttttgaatgcaaagaaggtttttaatggtgttccgatggcaatcgacttgattactgcccctctatcgttcgtggtgtctaatactgtgttggcgacatttatgaaaaataaaggttcgttgtcgatggctttctgattattctgaacttcctggcattcgagctcatcatcttccaagacaatagtgtatctattattttttgcatcttgatgattttcggcatcgtaatatatgctattggtaacactaccatctgactgttcacgatgatgcagattgaaactgaaacgagggtcttttggcacaggaaagagttgatagttttgagtaaacttattgtaataaagggtaaacactgtaatatcttgtttgccgggatttctctctatgctactcggtatcattaaacttgccaagttcatagacaccgacgtattgccgttgcgttgctcatgtgagaactgattgaaacctggaatatctttcgggtattggtgcttcaaaataggacctaatttattatcaaattctgcggatattatatagctgacattcggcctttcaaaaggaaaggattcattttctatcgacctgttgctgatagagttatttagttctcttcgcaacatccggtagccaaaaatgtttgcgtaccaaagactctaacagtgggcggtactatgcttgatcttgattttatagagcttgcacttttatagaagaaccattgctacctagacagttttttttgtttacattcgaatcatttttttttttgcatttagttaaatccgaagtcctgactagataatttactgtcagagaatagtagcatctatgcaagaaactggtatacaatagtcgagaggttgttgtaaaaaacacaaaatactaacacaaagcctggctgttgagattgtgcgacattcttgatcagtaaatggtattacagactgtctatcaatgttacatacttgcttattacacgatttattgtatttaaagtgcagaaagagtctcaaagatgtaaaaaactgcagcgtttgctggtactgccctaaaaagggttatacccagtcctcgataaaaaccctttagtccaaatttgccaaatatcttcttcaccgcattggtgaggcttatatgttcagtttgcattactgatttcacagtatccgcaggaaaaatactggcgttgaatgccaatccagcgctccctccactaataagtagttcccatatcttactttcatctctttttgggtcatcaagggagtgcctatctttcaacgacttcttaactatttcgtaggttgcaaaccaggcaacaccaccgaagctttctcgaataaaagtgcccgattgcccttgccacaatcctgccaatcctctctcagttataattgcttttattgtaggcaacacctttgtatgtttcgttttagctgatgcaacttgtaagttcgcaacctgcaacttacacttcaccagctccacgggtgtcaaaactaaactagcacatgaacccgctactccaccagagatcaggatttgccccaacgggaaaacgtttgtatgtttttctaaaaatttagaacattggttataagacacaaataatgtcgcgttctccagacatgctccaactaaaggtgaagcaatgccttgaaaaaaccctcgtgctattccttcattttggtaagtaaattttatacaagaccatgttgttgggaacacgttggatgcttgtgtttgcaacctgactttcacagtatcgaaaggaaactcgatcaccttaccacaggcgcctgcaatggaaccgtttattatatcgagtatagcgccttctattaatcctttctttttactgtcctccattatacgttgaccttccagaatttgagttccctataggttaaagaaaagtttctacgacaaagcatctacgctttaacaattaactatacccgtgcttcgataatttcacacttttctgaatctatcgacgccaggagcagagaacttatcattggcgattcttgacgctgcggccacagcggccacagcggaaaacgtatatgtcacatttttcgagctcaaggtgagtcacgatgcagaactggaacgtactaggactaagttgcaacgatgaaactacaatgctacgctttcttcgtgctaagtactcattgtatccattaatatggtccacaaaaagggtaggctgctgttgtgcttcattaagactggtcaaaaacacggatccagcagcaacagcacctgcatggatggaataggattggtgctaaatcacttggaattaaacacaaggattttggtcggcaatattatataaatatagtcagatgagtgcttcatttttgttgataagtattaatgaagattaagtgtggataatactgtctttgatactatacatttaatgtgacgaattgtatgactcgtatacataactaccaaagcgtagatctttaacttattttcagcactgtccgaaatgctcagttagcagtttagtacattcacgttaaaacgtgtatgttcgaataaaaatcaactcactcatcgactgatattcatactactggtatattgtcatacggtgtaagaagatgacataaaatcgaaaaacaatggtaaagtataatggcaactgaaatgcaaggatttgataacgtcataaaatgatgaaaaatataaaatggagggagaagtaacaggtacgtagaaatattggttccctttatggatccctatatcatcgtgcagaacttctcgtatattcgatatacctaaattatagcccttaacaataatgaaatcctaacgattatcccgaaaattcacctatttctcagtatatgaaatgtacattaacgtaaacactcatcttgctaccatcattatttatattgacattaatgatcacttgctgcaacatttttttattttttcaaatcatatgaaacaagtattaataaaaacaccgttaacccaacaattaaaatccgtgatagtttaatggtcagaatgggcgcttgtcgcgtgccagatcggggttcaattccccgtcgcggagatttttttgctgatttgatgtgttctcgaactttgtgatgccgaaaaaatcaaggtaattccgccatagctactatattagctctaaaaaacatctaagaataaaatggtatttcaatcatatgtacatatctaagtaaagtttttttttttttagaaactttctttattcatattttgaatcaattcaattatttcggaaagatcctctactgaaacgtctactagttctttatgttcgagcagtaaatgtccattcacatgattcttgagtaataccgtgaaacatccagcagatctaccggatttcatgtcgtcaaatgaatctcctaccatgatcatttccaagggccttatatttagcttcgaggcgatgtgtaataatgggtctggttgcggttttgtaggcctaaactcccttgtcacaatatagtcaaacctcgaaagctcggatggaataaatcttttaacaaaagtctctaccggggctccgacatttctagtacatatgttcttgctaataccatttttcgtcaaatacctcattatgtcaaccagaccaggctgcggttgcatctccttcatggcttttgcctcaactaattctattctatcatgcgcttcttttttttctttttctgtgggcaatgtatcaatgaaatgaaggatatcaatcgatttgtcctccaatcctatggcgtttctcattgctggaaacatccaaggctggggtaggcataatgtgccatccatatcaaatacaaccgctttgatgtgttttaatccctgtagtccttgtagctttgtcattattctgtgatacactttcagtgactattgaaccgtatatattgcccgactatcctaatgattgtgttagcggcacctggcgattgagtcgaacaccctgatatttcgttataagatatatatgacttttctggttttttcgttttctttacacttttttccatagcacgcgttcaaagcctaattttgtagaaaggggacgttttcaagagtgattgaactagttgaatatactgttttggttttggtaaacgccaaaatagtttgttttgaaaagctgatctaatttttttttgccgtactgtacccttagtcaatccatctatcctctgaacaatgacttcggctgtaccttatgatccatatgatgatctggataacaatccatttgctgagccccaggaggaagattctgaacctgctgcaacaaccacagatggatcatcttctatgtcagaggagcgtgtaggtactgagcaaactgcagcttccgttcaggacaacggaactgcaaataacattcaaaatggtcttggtgaagaaggaaacgcaacacgatcaaaaacttcaaacgaacacaatgaaaaccaacaaccatctcaaccatcagaacgtgttatacttcctgaaagaagtgatgagaaaaaaaaatacactctacttgcaaaagtaacaggattggaacgatttggatctgcaaccggtaagaaagagaatccgactattatatttgattgctccacaaatttgccaacatttcgcaaacaacaatacaagaatgtcaaaaaatcatacgaagaattccaccaattgttcaaatatctgaatgttgccattcaggaatcttttgttcctactcttccctctgcgtatactacattcggaattaatagcgaagaagataggatgaaagtaacgcgaaatttccaactttggtttaacaggctatcgcaagaccccttaattattcggaatgaagaagtggcctttttcattgaaagtgactttaatacgtacacacccatcaacaagtccaaatcactcgcatctgggttgaaaagaaaaacattgaaacaattagcacctccatatgatgaaatcacagaattagcagaattccggccattagtcaagtctatatatgttgtttctcagagcttgcaagaaaaactgctaagagtttccagaaatcgcaagatgatggttcaagaagaaaatgccttcggccaggatttcgttaatctagatgagcacaataaactttacagaagatacggtaaaatattgactgctgtgggtgatattgatagcattatagcaaccatggacatggcgacattgtacgatggtttagagtggattgtcagagatgcttatgccgtgaaggaagcattgaccaacaggcattttatcatgcgaaatctagtacaggcacagcagaattcaaaggcgaaacaggaacaagcacgcaggttccggtcaagaagagatattaaccctatgaaaatcgatgaagcactacgtcagttgaaagctgcagctaaaaacgaacaagttttgacccttaagcttcaacgaatcacgtccaacatgattatcgagagaaaacagtggattagctggtatgaagaatggataagaagctcgatcaaagaatttacactaagaaagatagagtatgaaagaaagaagctgacgttactagaacgagtacgttctgatatcagaaaagctgatgaaaacggaggtttgtcacgtctaggacgccatgctgtctcaaacaacaactccgatacttctcaaacccttaaaggggacagttggacgggagagagcaaccgcaaaagtcaaatccccatcaacaagatcgctcataccgaatttgatgatgaactattcactgaagacgatgggtacaactctcaggactcagacactacatcactgaatgcgcgccatgctgcttcacttttgggcatgtccactaaataatacgtatataaagtagaaaattcatacctttgaacaaggtgatctttttcctttagttgatattaatcccgggtaaacttccgtgttgcacttttaaaattttttttcaaatctcacctagaaaatttttttttgccatgagccttcctttaattaatctcaattgcatactactgttgtattaaacgcttcactggtttttttacttaaccccatttgccagaaagccagacctacgcacccaagaatttttaataacagataaaaatggttgctttcactgttgaccaaatgcgttctttaatggacaaagttaccaatgtgcgtaacatgtccgttattgctcacgtcgatcatggtaagtccactttgaccgattccttggtccaaagagccggtattatttccgctgctaaggctggtgaagctcgtttcaccgataccagaaaggatgaacaagaaagaggtatcactatcaagtctaccgctatttctctatactctgaaatgtctgacgaagatgtcaaggaaatcaagcaaaagaccgacggtaactccttcttgatcaacttgatcgactctccaggtcacgttgacttctcctctgaagttactgccgctttacgtgtcactgacggtgctttggttgtcgtcgacaccattgaaggtgtctgtgtccaaaccgaaactgttttgagacaagctttgggtgaaagaatcaagcctgttgttgttatcaacaaggtcgacagagctttgttggaattgcaagtttctaaggaagatttataccaaacctttgccagaactgttgaatccgttaacgtcatcgtttccacctacgccgatgaagttttgggtgatgtccaagtttacccagccagaggtaccgttgccttcggttccggtttgcacggttgggctttcactatccgtcaattcgccaccagatatgctaagaaattcggtgtcgacaaggccaagatgatggacagattatggggtgactctttcttcaacccaaagaccaagaagtggaccaacaaggacactgatgctgaaggtaagccattggaaagagctttcaacatgttcatcttggacccaatcttcagattattcactgctatcatgaacttcaagaaagacgaaattccagttttgctagaaaagttggaaattgtcttgaagggtgacgaaaaggacttggaaggtaaggccttgttgaaggttgttatgagaaagttcttgccagctgccgatgccttattggaaatgattgtcttgcacttgccatctccagtcactgctcaagcctacagagctgaacaattatacgaaggtccagctgacgatgccaactgtattgctatcaagaactgtgatccaaaggctgatttgatgttgtacgtctccaagatggtgccaacctctgataagggtagattctacgccttcggtagagtttttgccggtactgttaagtccggtcaaaaggtcagaatccaaggtccaaactacgttccaggtaagaaggacgatttgttcatcaaggccattcaaagagttgttttgatgatgggtagatttgtcgaaccaatcgatgactgtccagccggtaacattatcggtttagtcggtatcgatcaattcttgttgaagactggtactttgaccaccagtgaaactgctcacaacatgaaggtcatgaaattctctgtctctccagttgtgcaagtcgctgtcgaagtcaagaacgctaacgacttaccaaaattggtcgaaggtttgaagagattgtccaagtctgatccatgtgtcttgacctatatgtctgaatccggtgaacatatcgttgctggtaccggtgaattgcatttggaaatttgtttgcaagatttggaacacgaccacgctggtgttccattgaagatctccccaccagttgtcgcttacagagaaactgttgaaagtgaatcttctcaaactgctttgtccaagtctccaaacaagcataacagaatctacttgaaggctgaaccaattgacgaagaagtctctttggctattgaaaacggtatcatcaacccaagagatgatttcaaggccagagctagaatcatggctgacgactacggttgggatgtcaccgatgccagaaagatctggtgtttcggtccagacggtaacggtccaaacttggttattgaccaaactaaggctgtccaatacttgcacgaaatcaaggattccgttgttgctgctttccaatgggctaccaaggaaggtccaattttcggtgaagaaatgagatctgtcagagttaacattttggatgttactttacatgccgatgctatccacagaggtggtggtcaaatcatcccaaccatgagaagagctacttacgccggtttcttgttggctgatccaaagatccaagaaccagttttcttggtcgaaattcaatgtccagaacaagccgtcggtggtatctactccgtcttaaacaagaagagaggtcaagtcgtttctgaagaacaaagaccaggtactccattgtttaccgtcaaggcctacttgccagttaacgaatctttcggtttcactggtgaattgagacaagctaccggtggtcaagctttcccacaaatggttttcgaccattggtccactttaggttctgacccattggacccaacctctaaggctggtgaaattgttcttgctgctcgtaagagacacggtatgaaggaagaagttccaggctggcaagaatattacgacaaattgtaagaagtctaaatgagaaaaggtggttctgtaagagcaaaccttaccgccttatgatctttttcatttattctctgctttaaaattttgtcgtaataaaaatagtatggtaatagacttatatattattttcttacacatttttgtcatatagttatattccgaatgtttacaatcgaacccatcataaaaatggaccttttcgtattaccgccccctttgtagagggggaggaacggcaacttcttgactattacgacgtatcaccaccccgttagatatactatggaaaaaactattaaaaaccattataattcattaatgacatcggtcctgaggtagtattacgtataacttacctggctcttggtcatagctttttatccgtttacgaaaaaaggagaagaagattgggcttccgcggctattgtttggtttataccccgccgtatgttggtgcttctataattagagcgaaataggaaatacaaaaaatccttggaggggaggaccagcctcatcgggctaaaactccctcaaaaccggaggggcaaccaaagtatatatctcattatggccgatacttctagaggcgcactaacagaagcacctcagcccctgcaggtgaaagaaagaggtaattaattttccggttacttactttctctcgctattggggaaagcgttggttcgaggcgttgaggtcgaagacaatcattgttttcttcttatttaagtacatctttagaagaaaattacacaactggaatgagtaaatcaatacttgctttgtgttcccattgttagatactcttgttttagcatgtgatagcagtatataatataacctgcaaaataatcgaaacgcgtacacaggaaagagtacataaataaccatagtatatttctggacatatcttattacacaacataaaatagaatgtttaacatgaatctactttctacaccttcttctgaagagggttctccacagaataggtcatcttcaatgtcttctgttgagggcaagaaggatagggacacctttactaatttgcaaaacgaatttgatggtaaagtatttggcgtctcactcgaggaatcactgaaagttgctcaagaggaagtaattatccaaaaaagtacaaatgaaattggttccataccggtggtaatagcaaaaagtgggaaatacctaaaagagaatgcattagacacaacaggaattttccgtattgcgggaagcaataaacgtgttagagagctacaagctgttttctctaaaccgcccgattatggtcgtaaatttgaaggatggtgtgatttcaatgttcatgacattgcaactttattaaaaagatatttgaactcattaagtgagcctttggttcccctagcattatacgacatttttagaaatccaatattagaaaacccaaaaataaatgagcacaaagaacaaatcattaaggactacgaagatatttatatgctcttaccacaacaaaatcgccatttaatactttatttagccgcgctcttgaatttatttgcaagaaatgaaaagaagaatttaatgtcagcaagcaatttagcggccatcgtacaaccctcacttttgtctcatcccaaggatgaaatgtgcccgaaagagtatgaggcttccagaactgtcatcgaattcctcatactacacgcttcagatataataccgaatacggaaaaagcgaataaggacaccatgccgcatgcaggaacagtagcaaagtttaacaacattaccgttcctgaaatggctattgactccgatgaagaagattttgtgcacccttcaatagatgaccatatgcttccaaggtcacgtgcactttctgactccaacaattttaccatacatcatcatcatcatcatcatcatgcactgtttcctagcccaatagattttgataacaatgggctttctgtaccgagatcctttaaaggtagaacattgagtgcagagtccctttctcccagacttagtaaattacttgggaacgttggaaacagcagcaatactggcatcaaagaccctacagaaagagttcctagaggtgaacataaaaccaaacacaaacaacgacagtcatggttgagaagactcactagcccttctagaacgcagccttagcttcctaagcactgtgatctgctagtcgattccgaggttcggcgaagaaattgtcgttgccccgccaggggccttttgcgatactcggcgcttctttcagcaatctcggtccgcatctcggcaagggggggcatgacacgggccgctctggttggtcagttcctattttctgtaacttccattgtttggttaaagaatatataagttattgaaaagctcataggtcccttattataggccctaaggttttagtttctcatcatagtcatatcagaaaaaccctccttctaaagttttcctcttttcttatttctttttcatttattattcatatttatataaatatatattccaagtgcatgacattattggatacactttttctgaacctgaattaccttggtagataataagatacagatcgggaacgaacaacaattataatattttttaataatgttgagaaatactttttttagaaacacctcgaggaggtttttggctactgtaaagcaaccttcaatcggaagatataccggcaaacctaacccttctaccggcaaatacacggtctcgttcattgaaggtgatggtatcggacctgaaatttccaagtctgtaaagaaaatctttagtgcagcaaacgtccccatagaatgggaatcttgtgatgttagccctatctttgtcaacggattaacgaccattcctgaccctgccgtacaatctatcacaaaaaacctggttgcactaaaaggtccactagctacacctattggtaaaggtcacagatctttgaatttgacattgagaaaaacatttgggttatttgccaacgttcgtcccgcaaagtctattgaaggttttaagaccacttacgaaaacgttgatttagttcttatcagagagaataccgaaggtgaatattctggtatcgaacacatagtttgccctggcgttgttcaatctattaaactgatcacaagagatgcctctgagcgagtcattagatacgcttttgaatatgcaagagccatcggcagaccaagagttattgtggtacataaatctactatccagagattagctgatggtttattcgttaatgttgccaaagaactatccaaagagtatcctgaccttactttagaaactgaacttattgataacagtgtgttaaaggtggtcaccaacccatctgcttacacagacgctgtttctgtttgtccaaatctatacggtgatatcttgtccgacttgaactctggtttgagcgccggttctttaggtttaactccatctgccaatattggtcataaaatctcgatctttgaagctgtccatggctctgcccctgatattgccggtcaagataaagcgaatccaactgccctacttttatcttcagtaatgatgttaaaccacatgggtctaacgaatcatgctgaccaaattcaaaatgcagtattgtctactatcgcatcaggtccagaaaacagaacaggtgacttggctggtactgctactacttcatcattcactgaagcagtcatcaagagattataaaagtcctattcttttccctctcaggttttttcacgccttgaaaacaaatgactatccgtttaatataatgatttctgaaagattatgaagtaaaaaaaagcaaaatgcttagatatataatatatacatacaataaaaattccgtatctactccaaacttctatggctttgtcctcaatgtgttctgatgtttatttaatagcctgaagtttttattaagtatgtatacttttcgatatttattcttttaataatgctacaggagaccataagtgataactcaaaatgtccctcagtggacttgtaaaccaaaaaaaaaaaaaaagaaaaagaattaaatatattatgtgtaaaaagaaaacaccaccgtgtgttatgtatattttgtttatgtctatctatcatctatcctgctggcagtcaatgttcaccttacaaaattaatcattgaaattattgcttccccttatagatgtactgataatcgtaaacctcgtcaacaagattgctattcctcttccacgaagttatttcgtccaaaatatcatccaagttaaataatctaacggttggatatataccttggattctcggcaagcctataccagcggacccaccgtaacataaccacatctcattttttgactgtaagcaacagtcattattatgttcatgtccgcaactgacaccctttatattccaaagactcaggatatcaaggaagcttttgtaatgtttgccattgatcgtcattgaaacttgtcctctagaccttggcgtatctactgttaaggtagacctctcattatactgcccaataataggaaataaaccatgaggcctatattccgataatggaaaatattgaaatgccaagccaaagtctattttcccaatcaggtcgttataatcttgtaggaaattattgacgggcgcaaatgaatcaaagacgaaaaataaagcctctgatgggtttgtttcgtcttcggtatcaatgtctctttccaaaagagtattcttcgtgagcttctttttaaatgagacttctatggccatatgaccctcttctgatgcaacgttgttaaatgtgtaaggtaaattcctgataaagtctctaatttgtgccgatgtggccaaattggattcgtcagaaacacccaatgaaattgcgtagggtattttattagaaatcattggttggacaactttcataatgcacgtttgatagtcgatagtattatgtgagtctaacaaatcacctgtgatcacaactaaatcagggttttctgatgcgagtaccctatcaataaaatttactgtttttatttcattgattacggtcatgctattatccgtacatttgaaatgaaaatcagttatttggagaattttgaatgatctttgtcccctcgaaaattgtatatggggagatgttattttgtaatctgcatcgacttggatattaatgtctttgctgggtgttctcaaagaacctagcaatccattagaaaatttgtgatgatggtttttggtttcaagctttcttgtaattgatatgggcagagaaggtatgttatttctatgaaattcatggataacttctttccaagaaggcctcgattcaataaacgatgatcctagatatatttccaaattagttataggagcgtcattatcatcatcattaaggatatacttacaccatatgccgctccccttgtatacccactcctcaccgaacacagctatgttatctgtatcaacggatatgccgaaaagcagcttccaccatgacgaagtaggcttttctcgtagatacacatgattgtgaaagacagaactgtcgctcgatttcaccaacttattaatgtctctcagcacttgtaggggtattagtgctgagtcccttgctatggctagttcttttattgtgttttttggattactttggaaatctttcagatgaacatataagtaactgttgtagaatggtccagactgaagtgaatacaatgtctctacagtaatattcttagaaactctggtccacagaatgctgtttttgtctttgatctttttagcagtattggaggggtgtaatttcggggcatacaaagaactacattgcctgtaccaatggtagcaccgcaggatttgaatatcgtctatcattccgccatgatattctgctacattatgatccattaatacattttttgcatgtagctttagtgaatctctcgataaatacaatgaagtaatgcataatataaaaagtattctccttaaaaaattaaatcttcttctataatgtaatctcatgcaaatatttgaagggtattgtttgcgaaggtcaatgaatgtgataagagctaattgttggaaagtaaaataatcgaaaggaatgagaaaaaggtaagttatttaaatctcttttggaaatgaaactaaagcaacttgaaagaaatttcaagaaataatgaaaacctcgaattaatcgacaaatgaagagtactgcagaaccgaaattgaaaaaaaaggtcgtaaagttgaaatgaattgaagtcagaattaaaatagaaggggtattgttgcggctaaagtaaaataaagaaaggagaagttagaaaaagcaactcaatgatcttgtgttcgaggctatattataataagtttaggacttggcattatttcagatcaaaagtataaaaattaaaactgtcctttatctgtcaacctttttatttttgtttgatccttagagtctaatttatgtccgtaaatagaagttttcggattgcgggcgcagttagcctccaagcggagtttctatagtattgaaaacgtaaactagtaacatatatgcggttcaaaattactagagaaaatgagatcatagtttaaagagacatacgttatttatctggcggaaagtgtatagaaatctatctaattatcagaatcgatgtcatcgtcattgtcattatcgttaccattgttaatattgttggtggcttgttcaggatctcccataccatcgaaaaattgcgaacgcaatgtttttaatgaattttggtcatcctcagcaaattttaagcacccgctattgcttttcaacgcttccgcgactacttcttccgtgggaattttaccctcttcacagtatatgaacatcagcggagtttcacttgcgtacttcgtgccatgcttgatggcttcttgaacgacagaaggcgacgaacattttttcaccttgaattctgttcccaacgtattactttgtatccatgaccatgcaccgtttctgcttctgataaagtatgaatatggcgatagtgctgccattgtgaggatgtagggattttcgatcagtcccaattgctttgcagtgttgattatgtgtgtctctggatgtgaaaggttccattctccatgcagtttggacgccaagtccttatattcctccattttagcggctctcgcagaatttaatgtatctttcaacgatgcgatctgctttgctgcttcattattagcatcgtcaggaattgtttgtagatacgccagcgtcgactctagaatagtggatatgtttttgccttggtaactctttaactcgttgatctcttgaagcaagcatctggatctggtccgcgcttgctttcgtttagaaataatatgtcttattagttggtctttgcactgtttggtgtaaagctgtgggtaaaactcaagcggtatatccacgccattgggtagagacactgattctgtatttgtttctagttcattgaacaggattgttaatacgggtgccacctccttcaaagtattctccggttccacatatctcgcctcttcttgctcgccaccacgaatcacgtcttcttcttcttcctcttcttcggggtacaataaaacgttgaacattttatatagattagaatcgtactcttcaggaagaaaatgaaacaaggacaaaaacgtctccattggaggttcattcttgttcggagtatgcaaagcagaagatataaagagacttcttgtttcccggtctctgatcccaggacacatttccaaatccactgccaatgatttgataaacgctgggagcacctcataaagatgctcggaatcggccagcttggacctcaattgcggttccaaggacgacgtaaacaccttggccgaaacaaaggctctttcacactttcgcgtgttaaccacggagatgagtttttgcaactgccagagcagatgcggttgcaacccttcattaggtccgctggccagcacgatctccgacgtagtggaaccatcttctgcctcgcaatatgcaagtctgtatttgggctccgtaaacgatgagcccttgaaccagtctgccctatagttcaaatccttaaagtccggtttcaagaacacgtgtgggaaatacacggccgtgagcaacgcaaacagcccaaaatagctctcaattagactattcaagggtagcggcaacacaaccgtaggatcgcccacgttcgacttgaactcgttgtgttgtactatactataagaggggggaggaatggatgtctccgatatagaataacgatcgtagttctgagcagtaaccctgcatccgctggtgctattagaaccgctgcgttcatccgtgatgtcttcatcgtcatcataatcaacatcgacaccactcacatccggcatatcaatgtcttggtccccgttgttcggaacatcgcagggcttggttccagccactattttgttctcagaaatcctaggctgactgccatcattctcctcacccatttccgcttgctccggcagctcgttcgaaaagatgaagttaactgctgcctccaaattaccgccagttctttggagggcgtccacagctacttcgtgtggaatacccatttctagcagtgactttacagcctgattatccatcatcgtagcttacttaacaaaaatcaattacttaagattccttttacaggtgacgactctccttttccggcttcttctcttctttcctctactccgacaggtccttaagccttgtagtgagaagtacctttcaacaatagtatcttttacttccgtgccgggtcgcccggacatcacccgcccggcacagatgccttggcagcaagcgcatccatcgctgcatctccgccggaaaaacagatgttcagtacatgaaaagacgtttttattcgacataaactttttcagctagcaagaaggatctctttttaaacactctatacaggtgcacacaaagggttgttgaaacagaaacacaaacgcacggcgaaataatattatttattcgacttacgaatttttcaaagaagtcgtactggtgtgaagtggaaagtttcaaagatagtttgaaaagcagggaaaaaagaacatagtgaaccttcatcgccacagtgacaggttcaaggaaaaaattcacacacacacacatacgcatacgcacacaaagcactcagctctatatacataacaaagaatattgtaattcgacactatttggtacattcagagggtcctaagacagcacaaatcagttatatagaaaaaaagaagaaaaaatcatgagtgaagaggaaacggtctcagccccagctccagcttctacaccggccccggctggaaccgatgtaggtagtggtggagcagcagctggaatagctaatgctggtgctgaaggcggcgacggtgccgaggatgttaagaaacatgggtcgaagatgctagtggggcccaggccgccacaaaatgcgatattcatccataagctataccagattctggaggacgaatcgctacacgacttgatatggtggaccccttcgggcttatccttcatgattaagcctgtggaacggtttagtaaggctttggctacatatttcaagcatactaatatcacgagctttgtaagacagttgaacatttacggctttcacaaggtgtcgcatgatcatagcagcaacgacgctaatagtggcgacgacgccaatactaatgatgacagcaatactcacgatgataatagtggcaacaaaaacagtagtggcgacgaaaataccggtggcggtgtccaagaaaaggagaaaagtaaccccactaaaatctgggaatttaagcatagttctggtattttcaagaaaggtgacattgagggactcaaacacattaagagaagagcttcttcccgtaataactcctcaattaacagtcgaaagaattctagtaatcaaaactacgatatagattccggtgcaagagtaagaccctcttcgattcaagacccgtccaccagttccaattcctttggtaatttcgttccgcaaattccgggcgccaataactctatccccgagtactttaataactctcatgtaacttacgaaaacgcaaaccatgccccgctggaatccaataacccggaaatgcaagagcaaaacagacctccgaactttcaagatgaaacactgaaacatttgaaagaaataaattttgatatggttaagattatagagtctatgcagcatttcatatctttgcaacacagtttttgttcacagagtttcaccttcaagaatgtgagcaagaaaaaatcggaaaatatcgtgaaggatcaccaaaagcaacttcaggcattcgaaagcgatatgttaactttcaaacagcacgtcatgtcgagggcccaccgtacaatagattctctttgtgctgtaaatgctgccgctaccgctgcctctgtcgcccctgcacccgcgcccacatccacatctgcatatgcacccaaatctcagtatgagatgatggttcctccagggaaccagtatgtcccgcagaaatcttcctcgaccacgaacatcccttcgagattcaacacggcttcagtgccgccctcgcaacttttgtacaataccaaccgcagtcgcaaccaacatgtgacttatgcgagcgaaccggcacatgtaccaaactttatcaatcagccgatacccatccaacaactacctccacaatatgcagacacttttagcactccacaaatgatgcacaatccttttgcctcgaaaaataacaacaaaccgggcaacacgaagaggaccaatagtgttctcatggacccgctgactcccgcagcgagtgttggagttcagggtccactaaactatcctatcatgaatattaatccttctgtccgtgactacaacaagcctgtccctcaaaatatggctccgagtccaatatatcctattaatgaaccaacaacgagattgtattctcaaccaaaaatgagaagtctcgggtctacaagctctttgcccaacgatagaagaaacagtcctctgaagctgacaccgagatcatcgttgaatgaagatagtctgtatcccaaacctagaaactctctcaaatccagtatttcgggcacgtctttatcctcctcttttacactagttgccaacaatccagccccaattcggtactctcagcagggattgcttcgctcattaaacaaagctgctaattgtgctccagattcggtaactccattagactcgtctgtcttgacgggccctcctccaaaaaacatggacaatcttcctgctgtttcttcaaatttaataaactcccccatgaacgtcgagcacagctcaagcctatcacaagcagaacctgcaccacaaatagaactaccgcagccatctttgcccacaacgagcaccactaagaatactggcgaggctgacaatagtaagagaaaagggagcggtgtttattctttactgaatcaagaggatagcagcacgtccagtgctgatcctaaaactgaagataaggccgctccggcactcaaaaaggttaagatgtgatctttgcctttttaatctctagttgtctaaaagttcaaagcacctcactgtatgtttattacctttgttccaattacttttgtttcaattacttttgtttcatttcattttaggtatcccaacgggtaatcattgttatttattttattcacttttttttcttttcctcctgatccttgtgattataactatatttttaccaactccggtagttgttttattaagttttcatcacactaaattgtattttccactttcatttccaccttcctttcccctacctcccttcaattcgtatcataataccgcccgttctttctagtatatcacagaatagctacggggtattgtctcataaacagaaaaatgcacctttcgataaacttcctgtacaataattctataagtatatatgtatgtttgctattaaacaaccatcacaaaaagacaccttattctttatggacgccttcaagttgtgctcctattctgtagttgttgcaccatgcatgttaccatcatagccgtctaagcgggactatttccttttgttaacacctatactaattaaacagctggggaaatttttattctatgcttcgttgatgtctgcaaagacctttcagaaaaaaagataacaaaaacttccatatgcatatcctagtacgtgaaaatacatttatattgtaagattctactcccgtgaacatcccaatcgctgttcgtaataaacagttcttcgacaagtttaatttgcgccaaaacgctcgcacctttccaaattattagagcgggattcatatcacgtggtggtgggataatgctcactggaaaaatgtgttcgttaccattttggtgctcaatattttgatgttgctcttccagctcttctacaatcttttccttgatttgggcttgcaaaatttgcttgttttcatcttcagtcttgtcaggggcatttacataatgaccttctaaatctttgatttctttagtcagttttttgtaaaattgcgggaacgatgccgaactcaacaaagagggcctccaaatgttgattctatcagttaaaataaaatctaaagcaggtattttggaactgccaccaacgataagaatattcgaataaaatgagttcattcttgttacatcagctgttatagatgcattggcgatactttgaacgatagccttttctaaaggtgcaaaattttcctttagagtatttccatagttttcaggcttatcctggagttgatcaattatgttatgggcatctaatattctgtttaagatcttgagatcgtcattcaaatcacaatacaaatttccctctttgctttcgaattgtgacaaggagttccagtcattcaattcgtttgtaaagaggtcacgagattcaggcaactgaaattctaggctggaattcttgtgagaggaagttcgtatcaacttgaaaatttgtgggaaaaataaggccaatggtgctaacataacttcgtcgaacagcttgaattcgtacttttcagtcggctgattgggtgagcggttcataaaattgtacaactgaacggcaacatcagcatcttggaaagtggtgaaatttttcttcagccgttcagcaagaagccatccatgtttagaatcgatcttccaatcctgtagggggaaatcactttgtagcaaaaatagagcgaagagccttgtaatatcatctccaccataatctaacgtaattgcactatgttccaaaactgttccttcatcaacacaggcgatcctggtttcagcagcgcctatatttactacgcatgtggaggtactgatcccggcaccgtaacaagtcgctaatgattcttgtataatagcgactgcttgaaattgtaactcggtgagtagaactctaatgaacgtctctacgtgacttttcttgaatatgtctggtatcaccaacacgaccttgtactgattaaatttggtaggcttaacgtttaaagtctctgagttaagtgcatgctccaaaagcttggtaacgtctgagattaattctgccaacgatttataatatggtgacttgacattaaaagagccacctctgaaaggctttctaataacaaatttttcgtccacgcacctcaatgcatctgaaccatagtataattttgagtcatcaaatatccattctataggagatggatcatttttctctgaaataatctcaggtttggaattttcattgaaagatactacctgttcgtgagcattacctggtacctttcttttataatacctcatacgttctctaaaattcttttccatctccgactttatgttgttaaactcttctgactgttctctttgaaggcaaacgttttcaacatgttcactattttcaagatccagccattttttaggtaccgctacacaatttggaactacgacaggatggtcatctttgggaaatcctatctttatagaatttgatccaggatgtatcacgatagttgctgttggatcatttagatctatctcgtcattaagtggtgctgcactcgcttctgagtggggcaaactctttaaatctataacatctggtgtgttggtactagatatttggctagtgttgttatttctcaaaaattttctatctctaagtgcaaatatttgatcgtcttttttcagataatctgatgagtagtttttttggttgattaacattaaaggttggaacaggccagtggcaggtaaagtagttgtctccactttctcaatgccaatttttttcaacgtcttggcaaattcttcagcagctttaatacgtcctagtctcctcttctccaaaagatgtagcgggactttcttcccgggaggtgcttttgcgggatctagcttcggatatttcttataacgtttactagtctgcacagcaggtggtgccctcttatctctagagctccctaattcattttcattttcgttggcattatcattatcattttcgtcctcattgtcaacatcattgtcgtcttcgtcttcatcttcgtcttccccttcttcatcttcatcttcttcgtctgcaacgtctcttgggtcaacagaaagacctgttacacttctgggtgtctcagatccaactacgttatcgacactatcgtctgactcattctccgcattttcttgatccgcctggctgcttaaaggtacgctattttcttcttccagttcatcctcatcgtcatcatcctctaacggaatatcaatgggttcctcataaataatactggattctgcttcttcttgcgacatgttaggtgcgattgtatccctgtatttatgtactattgactagtaatttacctgaaagtgtttgctacttcgtgggcgttcatcatctccatttattcatattgccattctcaaataagtcatcttgcacggcccaaccagcggctggataacggatctaccccaacctcggacccaaagttgctgctataaaaacagaaacaaaaaaggcgtttctcgagactgatatccagatggtaatagagcccttaagtgctttgcaattgtcaattaagtatccttgttcgagagttgttcacagcacactgcgtatatataggcttaccacagttggatttaatcaagcgatataaaagctggaaggagacaagtttcccctaattgttgttctgtttgttacttaccactctatatacgttcgatttcatagaaaatttcttttgcagaccatttattcttcagtttgataatgttaagatctaccgtttcaaaagcttctctcaaaatttgtcgtcactttcacagagaatctattccttacgataagacgatcaaaaatttgctgcttcccaaggacaccaaggtgatctttcaggggttcacaggtaaacaaggtacttttcatgccagcatctctcaagaatatggtacaaatgttgtgggtggtacgaacccaaaaaaggcgggtcaaacacatttaggccaacctgtctttgcctctgtgaaggacgcgattaaggagactggagccactgccagtgccatctttgttcctccaccgatcgcagctgctgccattaaagaatctattgaagctgaaattccgttagctgtatgtatcactgaaggtattcctcaacatgacatgttatacattgcagaaatgttgcagacacaagataaaacaagattagttgggcccaactgccctggtatcattaacccagcaacaaaggtaagaattggtatccagcccccaaaaatttttcaagctggtaaaatcggtattatttccagatcgggaactttgacatacgaagctgttcagcaaactacaaaaactgaccttggtcaatcactggttattggtatgggtggtgatgcttttcccggtactgattttattgacgccttgaaattatttctagaagatgaaactacagaaggtattattatgttaggtgaaataggtggtaaggccgaaatcgaagctgctcaatttctcaaagaatacaactttagcaggagtaagccgatgccggtggcatctttcatcgcaggaactgttgctggtcaaatgaaaggtgttagaatgggtcactccggtgcaattgtagaaggatctggaactgatgcagaatccaaaaaacaagctttgagagatgttggtgttgccgtcgttgaatctccaggttacttaggtcaagctttactggatcaatttgccaaatttaaatgattatattaggaagagaatgaactgctttcaaaagaggaagacttctatgtctcgattattgcttagacaagtatggagctgacatccgttttcttttcagagcttttactcaacattctatgttaatttttccctttgtatatattcatttatccttataaattctactaaaaatcttttaatagtgtttgtatttaatgttcttcttaacaagggtatacataaaggttgattaaagcttaataattgaaatggaaaaaaaaataacaaaacgtctgaatttcctagtctgttttgcaaaaacagatgcgcaagccgggaatcgaacccgggcctcatgcttgggaagcataaattctaaccactgaaccacttgcgcgtttcaatcaatttgggaagactcagcacgttatatactattaatgaaaaatttccttcttagtaatgacactgataaataggtaagtgttggaattaaaatcaactatcgtctaacaactagtagtcacactaccaatatattatcatacacggtgttagacgatgacataagatatgagaaactgtcatcgaagttagacgaagctgaaatgcaaggattgataacgtaataggataataaaacatatagaacagaaggagaaataatcatagtattattatgtagaaatatagattcctttttgaggactcctatatcctcgaggagaactacacataatattatatataacctttgccaaaaaaaggaatgccaaaaattatcaaactatttgttggaataaaaatccactatcgtctatcaactaatagttatattatcaatatattatcatatacggtgttaagatgatgacataagttatgagaagctgtcatcgaagttagaggaagctgaagtgcaaggattgataatgtaataggataatgaaacatataaaacggaatgaggaataatcgtaatattagtatgtagaaatatagattccattttgaggattcctatatcctcgaggagaacttctagtatattctgtatacctaatattatagcctttatcaacaatggaatcccaacaattatctaattacccacatatatctcatggtagcgcctgtgcttcggttacttctaaggaagtccacacaaatcaagatccgttagacgtttcagcttccaaaattcaagaatatgataaggcttccactaaggctaactctcaacagacaacaacacctgcttcatcagctgttccagagaacccccatcatgcctctcctcaacctgcttcagtaccacctccacagaatgggccgtacccacagcagtgcatgatgacccaaaaccaagccaatccatctggttggtcattttacggacacccatctatgattccgtatacaccttatcaaatgtcgcctatgtactttccacctgggccacaatcacagtttccgcagtatccatcatcagttggaacgcctctgagcactccatcacctgagtcaggtaatacatttactgattcatcctcagcggactctgatatgacatccactaaaaaatatgtcagaccaccaccaatgttaacctcacctaatgactttccaaattgggttaaaacatacatcaaatttttacaaaactcgaatctcggtggtattattccgacagtaaacggaaaacccgtacgtccgatcactgatgatgaactcaccttcttgtataacacttttcaaatatttgctccctctcaattcctacctacctgggtcaaagacatcctatccgttgattatacggatatcatgaaaattctttccaaaagtattgaaaaaatgcaatctgatacccaagaggcaaacgacattgtgaccctggcaaatttgcaatataatggcagtacacctgcagatgcatttgaaacaaaagtcacaaacattatcgacagactgaacaataatggcattcatatcaataacaaggtcgcatgtcaattaattatgagaggtctatctggcgaatataaatttttacgctacacacgtcatcgacatctaaatatgacagtcgctgaactgttcttagatatccatgctatttatgaagaacaacagggatcgagaaacagcaaacctaattacaggagaaatccgagtgatgagaagaatgattctcgcagctatacgaatacaaccaaacccaaagttatagctcggaatcctcaaaaaacaaataattcgaaatcgaaaacagccagggctcacaatgtatccacatctaataactctcccagcacggacaacgattccatcagtaaatcaactactgaaccgattcaattgaacaataagcacgaccttcatcttaggccagaaacttactgaatctacagtaaatcatactaatcattctgatgatgaactccctggacacctccttctcgattcaggagcatcacgaacccttataagatctgctcatcacatacactcagcatcatctaatcctgacataaacgtagttgatgctcaaaaaagaaatataccaattaacgctattggtgacctacaatttcacttccaggacaacaccaaaacatcaataaaggtattgcacactcctaacatagcctatgacttactcagtttgaatgaattggctgcagtagatatcacagcatgctttaccaaaaacgtcttagaacggtctgacggcactgtacttgcacctatcgtaaaatatggagacttttactgggtatctaaaaagtacttgcttccatcaaatatctccgtacccaccatcaataatgtccatacaagtgaaagtacacgcaaatatccttatcctttcattcatcgaatgcttgcgcatgccaatgcacagacaattcgatactcacttaaaaataacaccatcacgtattttaacgaatcagatgtcgactggtctagtgctattgactatcaatgtcctgattgtttaatcggcaaaagcaccaaacacagacatatcaaaggttcacgactaaaataccaaaattcatacgaaccctttcaatacctacatactgacatatttggtccagttcacaacctaccaaaaagtgcaccatcctatttcatctcatttactgatgagacaacaaaattccgttgggtttatccattacacgaccgtcgcgaggactctatcctcgatgtttttactacgatactagcttttattaaaaaccagtttcaggccagtgtcttagttatacaaatggaccgtggttctgagtatactaacagaactctccataaattccttgaaaaaaatggtataactccatgctatacaaccacagcggattcccgagcacatggagtcgctgaacggctgaaccgtaccttattagatgactgccgtactcaactgcaatgtagtggtttaccgaaccatttatggttctctgcaatcgaattttctactattgtgagaaattcactagcttcacctaaaagcaaaaaatctgcaagacaacatgctggcttggcaggacttgatatcagtactttgttacctttcggtcaacctgttatcgtcaatgatcacaaccctaactccaaaatacatcctcgtggcatcccaggctacgctctacatccgtctcgaaactcttatggatatatcatctatcttccatccttaaagaagacagtagatacaactaactatgttattcttcagggcaaggaatccagattagatcaattcaattacgacgcactcactttcgatgaagacttaaaccgtttaactgcttcatatcattcgttcattgcgtcaaatgagatccaagaatccaatgatcttaacatagaatctgaccatgacttccaatccgacattgaactacatcctgagcaaccgagaaatgtcctttcaaaagctgtgagtccaaccgattccacacctccgtcaactcatactgaagattcgaaacgtgtttctaaaaccaatattcgcgcacccagagaagttgaccccaacatatctgaatctaatattcttccatcaaagaagagatctagcaccccccaaatttccaatatcgagagtaccggttcgggtggtatgcataaattaaatgttcctttacttgctcccatgtcccaatctaacacacatgagtcgtcgcacgccagtaaatctaaagatttcagacactcagactcgtacagtgaaaatgagactaatcatacaaacgtaccaatatccagtacgggtggtaccaacaacaaaactgttccgcagataagtgaccaagagactgagaaaaggattatacaccgttcaccttcaatcgatgcttctccaccggaaaataattcatcgcacaatattgttcctatcaaaacgccaactactgtttctgaacagaataccgaggaatctatcatcgctgatctcccactccctgatctacctccagaatctcctaccgaattccctgacccatttaaagaactcccaccgataaattctcgtcaaactaattccagtttgggtggtattggtgactctaatgcctatactactatcaacagtaagaaaagatcattagaagataatgaaactgaaattaaggtatcacgagacacatggaatactaagaatatgcgtagtttagaacctccgagatcgaagaaacgaattcacctgattgcagctgtaaaagcagtaaaatcaatcaaaccaatacgaacaaccttacgatacgatgaggcaatcacctataataaagatattaaagaaaaagaaaaatatatcgaggcataccacaaagaagtcaatcaactgttgaagatgaaaacttgggacactgacaaatattatgacagaaaagaaatagaccctaaaagagtaataaattcaatgtttatcttcaacaggaaacgtgacggtactcataaagctagatttgttgcaagaggtgatattcagcatcctgacacttacgactcaggcatgcaatccaataccgtacatcactatgcattaatgacatccctgtcacttgcattagacaataactactatattacacaattagacatatcttcggcatatttgtatgcagacatcaaagaagaattatacataagacctccaccacatttaggaatgaatgataagttgatacgtttgaagaaatcactttatggattgaaacaaagtggagcgaactggtacgaaactatcaaatcatacctgataaaacagtgtggtatggaagaagttcgtggatggtcatgcgtatttaagaatagtcaagtaacaatttgcttattcgttgatgatatgatattgttcagcaaggacttaaattcgaataaaagaattatagcaaaactcaagatgcaatacgataccaagattataaatctaggtgaaagcgatgatgaaattcaatacgacatccttggcttagaaatcaaatatcaaagaggtaaatacatgaaattaggtatggaaaactcattaactgagaaaatacccaaattaaacgtacctttgaatccaaacggaagaaaacttggtgccccaggccaaccaggtctctatataaaccagcaagaactagagctagaagaagatgattacaaaatgaaggtacatgaaatgcaaaagctgataggtctagcatcatatgttggatataaatttagatttgacctattatactacatcaacacacttgcacaacatatactatttccgtccaagcaagtgttagatatgacatatgaattgatacagttcatatggaatacgagagataagcaattaatatggcacaaaagcaaacctgttaagccaacaaataaattagttgttataagcgatgcctcgtatggtaaccaaccgtattataaatcacaaattggcaacatatatttacttaatggaaaagtaattggaggaaagtccaccaaggcttcattaacatgtacttcaactacggaagcagaaatacacgcaataagtgaatctgtcccattattaaataatctaagttacctgatacaagaactcgacaagaaaccaattaccaaaggattactaaccgacagtaaatctacaatcagtataattatatccaataatgaagagaaatttagaaacagattttttggtactaaagcaatgagactgagagatgaagtatcaggaaatcatctgcacgtatgctatatcgaaaccaaaaagaatattgcagacgtaatgaccaaacctcttccgataaaaacattcaaactattaacaaacaaatggattcattagatctattacattatgggtggtatgttggaataaaaatccactatcgtctatcaactaatagttatattatcaatatattatcatatacggtgttaagatgatgacataagttatgagaagctgtcatcgaagttagaggaagctgaagtgcaaggattgataatgtaataggataatgaaacatataaaacggaatgaggaataatcgtaatattagtatgtagaaatatagattccattttgaggattcctatatcctcgaggagaacttctagtatattctgtatacctaatattatagcctttatcaacaatggaatcccaacaattatctaattacccacatatatctcactattcgtcaagttcttaaatccatattttaatattcatcagtactatcctctactctttagttaccaacacattactaattcttgcgctcaccctatcagtgaatttgattacttatatataatttttagttattgtttgacaaaacaaccgtaagaaatttttattttgaatttcatcaattggtgacaactcataaaaagaaagctaatgctcaaatgcatcgttgtactaactgccatagtgtaaaatccgtttaagcagatcgagtaaaacagctgttgtcgatcttatacttttctatggaaaacactatttaagcgctatgtgcccttactttagaatgatgactttactgtaatatgtcaacatttttattctcagcaaatctttggcagcgtatttacatagtcgtcttttttataatattaatgacacaaatataaggcttaattattaatataatgcagtctgtaaatgggtgcaaacactttattttgtcatatgttcaaatagaattcatgccgtttccatcataaactcctgattctcaccgattactgatagtttagcttcagaggtcgacatcccatagatgatgacgaaagcaagattacggtcgaatagttaaagaacacatgccttactttacaaaaaatctattaatttatcaacgaatatttctacattcaaaatgatgtcatctttggtatcaatgaaacaacaattatccccaacaaatctgttactactgctgactcttccggtgaccacgctagttggccagtttttaacatcccactttaaaccacgggtttccttaaccaaagtagcctctccaataggcaacaacccacaatttcctatacaagtgttcctaaattggggatcatactcaatcaaagttccattttttttgattaagaatattaagtctgttggagtcatgtaacaaagcttgaaatagcttgcattctcggataaggtatacaattgcgttattgagtgaaccgtctgatcaaatctaccaccaattcctcctagtgctaatagactaattggagtcactttcgagaaaaccaaggactcggtcatagtattgtataatgtgtgaatacccttttccagttcaattccatgatttgactgaagattgtctttattcgatattaaagaacgaaattctggtgaattgaagtgtagagagatcaaattaacgcacttcgtgaaatcagtcgaatattgtgtagtttgttttattatagttactttgtttttcctataatacttgtaaaccttttctgatagtgaatccagatcgccaataatataattgggaagatattttatccttagggtttcgtcatcatctaggtagtcatataatctattggctgcaccatctgcacagaccttcaagtcatgcagcttccaaattttgtaaaacaacggtctaggaatgtcaattttttgattaagtatgagtagggtagagttttcatcctcgtttggatggattagttcttttaagttcattttatttcggatgttgattaaatcagtaccaattttaatacgttcaggattttcaatacactcctcgctcatagcagtgatattcagctttttattgttctttgtgaccaattgtgatctacaaatttctagcttttatcaaaaccacagtacttaagaagctaaatcttttataaacgccttatcattcacgctttatttgtaattcccatcagccattttttttcaagttttcgcatattttgcatttttcgctgttttgaaatatgcactatgaggaaataaaggcaactattagaaggaatttaggattgtgctgcatttgcttaatgcaaggttgcagaatttattgatatataaagtagtagtatatttccccgcactaccatgctatatttattatacatacgtgttcctgtaacgatgcacgcaatttcatatcagtgttatttgttctttgaaaagcctgagtgcaaatgctcccattttctcacgactatgctcggatcagcgttgaaccatacgtttttcaagacaccctcttgtgacaactgatagaccaaatctttgtatcgtctttctgatacattttcactatgcaactcaaatatttgtttgttttcattcttgacattggcgtcacttttagcgatttcaaaaacgaagggattgatctccgctttaatttgttgagttgtggcgctcagcagatcaatctcggcattttcgttcagagtttcatcattataaattcctttgaattggttcaaaatatcagaaattttcttcgaatttctcgtccttcttgccgactgaagatggtcatacttcggtattcttgacgccaaaaaatttaatgtagattctgtcatttttttgaacctgttaacaaggtattcgttatcaagcctatggtttgcttctctaacataggaataccgagcttccaattgttcttggatgtgttggtaaatattcaattcaaacggtaataacggttgtctattggggtcatttaaatgcaatttataatctatcacgtaatcaaattttagtttcatttcatcatccagattttgatcctggaaagtattaactttttctggggtcattgtggtagaatctatttcttgtctaaccatggaacgattgagcgttgcttgaccaataacatcatttatggagagtagatcagttaattgcgatatatctttaacgcttgaaccaagagttgatgttaggaccggtagtctgttcttggatgaaatcaaatcagcctcagtatcaacgcaccaaaactgcaagtgcatcaagcacttcctaatatccgcattattttgttttacaacatcgcgaagccagtcgtcacaaacttcgatttcaagggactttaaatattttgttagaaacgcatagactgtggatgtactaattttcttagtatgaaacaaagagttttgttcacttgccaaggcaataagttcactaggaactagtgacaaatccttacaagtcaatacgaggggccttcgtgaaaattcacaaagcttgctgatcattgcccaatatcccctatcatgttctttaaataaaacatcaacatcattaaataaaacaagcccgtagtcacttttcctttttgaggaatctttgacatagtgtgtggtggtaaaatctagtaggatatcaagcaaatcttttttgctcctgttcatgtttgaattaacttcatatatctggtaagaattatcgtcgccagcaatctctctcatgattgtctgtatcagcgttttcttgcctattgaatttccgtgtaatatcattagtggaacaaattcgctcaagctgctatttgcttcgccatttctgtagaaatctggacgcaagttttcgtcttcttcgagatcaggtacaatgaagttggcaagctcatcaccagatccctgttgtttattgggatttattctgttcaatagacggttcctcaaggtaggcttttctagcgtatgaaaggatgtttcaatccaatttttgattcgaagtttcaatttgggttcaattaatacttgttttaaagtgacaggcttgaatagctgcggccatgtgagagttgtatttcttttaatatttgtgccaagtaataccggtgcttgatagcgaacaggaatacaagatgctgaattcttgtctttcaacgattcatagtcactaggaagaaaattatgatttaatggcggtattgtgcggaaaggaagcgggatatcaacactccgatctgacagctctttgtcacctactgggaaaatcgattgatgtaatggtaatggtggctctatttcatttagtttagagatgctatttaatcttttgaacgtgtcggttgtctcatgtttaaggaagtttttaatctttgatgctctttcattaagaagcgatgatttgattctcgatgtggaaattatagaaatatcatcttcatgctcctgcgaaagtgcaattttgctacaattagtctcacttttgggactcttatcactgattacaataagatcatcatcgtcgtcatcgcatttttcttttgtgcgtttcgtcatcaaaaactcctttgcagatttgtgattagtagaaacagcttcaattggcttcacaacagagtggtttaaaaatattactgaagaatcgtcatgtttggctgttctggcgtcaaaagtgcctgattcagtatcattttcgtcatcgatggtaatctgtagagcatcttgtcttctcacttttctcttatttcctgtcaatatatcagataaagacacgtgccttttcattggaaaaccttctctgattcaaaaagtttaatgctatggtaccatacgatttagtgcagcgaaggtggtcagtgaagacgttaaatacatgaagcaaatagccggataataatactaaactaatttatcaccgctaacgttacgcgtttggcgtcctaaaaaaaagaaggaaaaaaaaacctatttattcactctatttcgccataaaacgacatataaatattatacagatgatgaaagcccacaaattatgtttagtagcgttcttttaatctagatgcaacggtacgtaagttcccataaactttacctggaggggaacccaaaattaaactaaccacagattctcttgccattctgatgtgggtgaacccgcccaaaatgtggattttagagtcagctaagacaattcttgttcttgtagcgttttcaatcgcaaatttcgttttaccgtctttaccggcaatacgaccgatggctctcgacaaatggtcacctgttagagtcttgacatctttgacttcaaaagtctcaatatataaatcatctagcctcaatagtgcgatagaatcgtcaagatcaaaccctaaggtaaaggctttgataaaatcggcccctttttgcaacgcaccagggtctgtggtaaatttaggattcgttcttagttctacggatttggtctttaaattcattctgacttgcagcttcaagtgctcgaccaaaggaggataaatttttgtccaactgttcctcaagggtgtcattctgtgtggtggaaccatgatctttctcgattcaaattttattttgttaccctgtgttttgctagctgaagtgaagcgaggtttcccctggtcatcaaccactacggtcttagattcgtgcgttttccggctaccttcttcgccctctacctcttcttttgctgtgttattgtcggaatcatctaacagaacgtcgtcatcatcgtcctcatcgatgctttcggtattatttattcctataattctactactgcccccatcttgtccacttacaggtgtcacagtagcctttttcaaagcagtaggcgcaaccataatgtagtttattttcacttcaagtctttttcttaactaaacagaagaatattgaaaactgcctattattgatgcaatatgtatctttcattgtgatgagcatcggtatgataataaggaaagaagaaaaattttttcccgctcgcactttccgtaagaggtgataaaaaacagacctaatactgtagtaatcttaactgcatttagccctacatttattatttatgaccttactcttcatatgtaggttaaaaaattcgtataaagacacatttgactttttgtcacttttttttacttctcgttattggttctagctgatccttgacttactatggagggatgcatattaaagttgacagtagatttgcgtcaagaagtattaaaacaaaaggcacatacagattatcaggtggtgggaggtttataaaattcatgctaatcacacgtttacgggtccctacaataaagcggccactgcttccaattacaagtcatctcgtaagacactgtattcgaacttacgtcgcaactaatcatggaaatgtcagaccttttataacaccttacaagagttcgttacctgttagatgtttgatcgcccaaaggcacatccgaacatttccaagcaatgacaagttcactaccaaggcttccaatattgagactattttgctgagaaaaaataatgagcgagagttcaagcaatcgcttctagcagatgcaaagaattttcaagaaaggttcaaaatcaatctaaagtggattcttattaaaaacaacaggccgttctctctgaatgaaataagtattatagcgtcttggctgatattgtcacaaattctatggctcattctgagcaccaccactttcatttcgttctatctattcgtcattaactctgttttcagtcaggaatacatccatgagaagaaaatctatgaaaggcttctaaaatggttgttgaaagatcataagtgctccaatcaagatttggaaatcacattttctccggaagataaagcatcaatgcttgtgctctctccagactgggagtcaaattcaatacttataaaaaggctaaatgtcagggatgagattttggacttagacttaaaatttcaccacattaacctgaatgtttccctaaaaaattggttacttggcaggggactaattacaaatgtttcaatatacggtattagaggatgtttgaacttatccaatttcatcaatttagtaaactcttttcaaggagatcaaaagacggagaattttttgaaaactttaaataacgttgaaattactgactcagaaattcttttgaaacaatctctgagtgcccaggaaactccgagtctaaaattttccatttacaatctatctttaccacgactaagactgaaccattttatttctgatattctgagtgccaaaacattttctggttcaattaataattctcttttcaacttatttaagaggcaacaaaagttaacagcagttattgaaaataataacaaaaataggatggcaagctcgaagtttgatttcacggacaacaatcaggaaaattaccgcacagtgactcatcaggatgatccgaattatgtaacgacgttaagattgaactttatcaacattaatgatttaaaatttaatggcgatggtaagttcaactggttgaaagacggccaagttgaaatacttgctgacataatgctaacaaattctacttctcatctatcatcggagtcgaaatatgcagtggtggatttgaaggtaacttgtagggacttgaagacaactttccctcaggaacctccagtattatcgacaggtgacagtattgtttcattggatgaattgaaacctataataacatttattaactcatatgaagggatggctaatcctatattgaaagatttctcggaaaacgagagattgaccaattccataatctggaactcgccaaatgtatcgattaataggcaaaggaaatcttatcctttaactacaaaagtcacttccaattccacgaaggaaatcatcaagtttcataatcaaccaaatactaatgcaaacgaaattgttttacgctgtaagatggtcaaaaacttgtcagatttacagcttattaacattaatcaaatactagaccaaattaccatggagctatatgttgatttaaccaaaatagtagaagattgggagtttaaaaacaaaaatgattggatgaaacaatggggtactacctttgcatcccaattattgttgtttgggtttggtgccatggtttgactattgcttatataatatcaaactgaacttccttgcatttcatttatcaagtaaattgaagaaaaaataagaaaaaaaagccaaactaaaaatacctccttcggaacatgcataaaatataatgtgtatataccaagtactttaaattatatattcaaactttctcatgacttattttttttgtcgtcatcaactttagtgcccgttattttatcgatttttacgacgggcataaatgaagcctcctccacgtttattgccttatttaacttggcaccaattcccagtccatcaggatgtatctgtgaaacatttgaaacgtccttgtttcgactctgtgtcttgtcgcctttagaatcttgctcggagtcactttcccaccccataccccgaagtaaagcatctccaaattcctcgacaggtacctcattatattctttttcggtgacatattccaccagaggagcatcgttttttttggtatccgcattttcactcagcttgatcactaatttcttcttagaagatgattcttcatcaagatcgaatttatcaatactttgaatctttatcttactttgaggtttatgcgaaaggcttgcagtttccgcatcatcccaatcgaataagttggccttctgtaatgagtttttttttttcgtcttcttggaaatattttttttcaaggtcttactccccaacttaagtgaaaacttgctcattctacatcctagatatgcctctagacattttacctaccatcgctcgacgtgcattattaccttaataacttaaaacagctattcctatatttttacatttttttctacgcacggtcgggtaacaaatgatagcgccagatcattgagaacccaagtgttgcatgttgaacctgcaatgcataaatattagaagcattagaagcatagtagtatgaagtgactgtgacaaatgaagctctgtaattcttagtttgaataacttgcacatgtactatggtcagtatcatgtcaagcttgtagtacgtgtgaacacagatttggttatggagtaatataatacttaacagcaagagaacatcaatggagctttacttagacttcgggaggttttcatacagttgtgtactatacatagattaataagattgcatatcagaactaacaatcctatcttgagctgagtaccgagtttgtatcagcctacaattagagatttcaatgggaaaaaatgagtatgcaacaaatagttaaccattgctcgattaaagcactcttcttttttataagaatacctaggataagatcatttaaacttaaattcacagccataatatatgcataactcctcatatagctggtcttatagtagttcgatggagtacactgttagccctggcttaaaagtcgtgaaatcattgaaatcaagatgatccaaatccaaatggaacaagtaatttcttttgggtattaagttaatagtgccatctctcttcaactttttcaattctgatgtcatggaattgggagttactaaagttagtggagttatggacccgtttaaacgcagccgcctaattgtttctgttaaaagtggtaaatcacagcctttaaggtctattacatgatggttacctacactgaatgccacttcatctatcgactcaataccatcctgtgtattgataagagaagaaacggttaggttattgctcatatacatccaggtgggtggtgagtatgttttccaccatatgtgaacgcccatttgttcggtacgaaagtggaagtaatctcccaaaaattggataattcctgcttgatgtgaaattcccatgatgaacgccatgattatgttaaaaagaagccaagttcccttgaaaattttcttgtttactaacgtggaactcagaggtgtccagtttaagtttgtcacgagtagtggcactagcggtacaaggaatcttaattcttgatgttgaaagaatgaaagaaaaagcaggccagatatgattgcgtaagtagataatttatcgagtttgtaaccggaaaaaatcgctagcagcaatactgggccaactatttgaggtaaattgaccagcagatgggtgtatcttggatgtaatccatgtacttgcaaattttggacattgaggttgtatttcaggttattcaagggcgtaatgacaaatccctttccgttgttataaatatttgtatcaataagaacaaatagacacgaggaaaatgaaaatgaaagtaaaagtaaagaaaaggatttccaatggacccggtaaaacttccagaataatatcaaacatggtaagaaaataaatgcaggaaaagtaactctattaaaaacaccaaaactaaatataagtcccaatataaccgaatttttgaaattacttctttgaatatttttttcgtttaccatatcttccattacagttaaagttgagattaaagccagcgtttctatggaattggaaaacgtgtgtgtttggtacgtccaggttacgtaagaagttaaaagtagacttttttgcatgaattgtacagcctttctctcatcccttattaatttaggtattaaaaaatgatagcacaataggtacatcacatagttttgtagtctcatcgaatacagaattaacgctgggttgtcctgaatttcgggaaaagattctaaaatagtgaacaaaggcccgtaaaccaataatagggggccgtaactcctagcagcaaattttgatttaaattcccatgggatggtacctttgaccttcatgaactgcatagccaaaatctcgatgcattggaaatgttcatctggatgaatatacgacgggcctaggcatagcattaggccgatggcatatactaaataaagccaccattgatacctcatcatacacttccaagtacctgatgtgtgcttgcgagtaagaatactatgatatcttatcggacatatagattttcaggccttttgtattgtgttttcatctttatattacttcagattgtgcgcatctcgcgaaatcctcagagcttcagatttgaacttgttgccgacatagtaagtcctctcagcaccttactgtagaagcacctttataagttatattaaatcaatacatcttctatgagatacatagatcgataagttgactttttttcactatattagtgactggttttacttcttacaaacattacagtccgcacataaaaagctattacgatgtctatataatgttttgctctatattgcacgtaccaaacacgctactagtaagacatgagttccatctagcgaagaatcaccgcacgctatggttacttagacggttatggtttagttaattatcgttataatgttgattgttacccgcatggagccttccttgtagtttagagatctttaaaacgttctaaataagtaaaagagaaagaccttatgaatacactgatatcatatagaaaaagaaagcaataccagcatcaacaatagcctattcatgtcgcagaagattggacacagtggcttggcttttgcgcgcctttggcaccatgtcgacgttgcccgtgataagaggacattgggtagattggcttcagcaattgcaattaccttaattggtagacataagccggtctatcatccgtcacaagactgtggagactacgtagtagtgactaattgccaaaaaatccgtgtaacaggtaagaaatttgagcagaagacttactggtctcattcaggtagacctggtcagctaaagttacagacaatgaacaaggttgttgccgataaaggatttggagaaattttgaaaaaagcagttagcggtatgttgcctaaaaataaattgagaaagcaacggttagaccgcttaaaagttttcgatggaagtgaaaacccttataaacaaaatattactgcctttgcccatgagcaatcatcaataccagagcctcttaaagaatcaatttttaaccaattgaaatagcttattgaaattatttgtcatttttttatatatcctttttgcagtcttcaatccatgtatatatttatctgttatgtagttttaatcaaaacgcgtattaaaatcttctttcttttatgaatactaaatatatttaacagtgtgtaacagcaacattgttccaaaatgaacaccgtatatttttcttataactttttacataagtcattatttatgacttggatatttaaggttttccgctaaagttcattaatatgtcttgataaaattaaattttaatttggtaaaatgcgaaacaaggactataaataaacactgtgagtcccattttattcatcattatttttgtgttttttgaatgcttgaaagttctctctgcttattaaaagaaatgcttcattcttattttattactattgcctacttgtttaccctttttttggcaagatcagcacaaatgaaatgttttttattattttactttcttagagttacaacattatttcttaaaaatctctcgaacgatcggtatataaacgtggtgtaatgttcatagccataagttcttggaataataacttcgcggcgtatggaatatgaatttggtaaatatcaatcttattatcacatcccttacattcaaattggttatgatttaatttcgcgataactgtcatcagcccgcaaataccacaaatatggactctaaaggcatcggatgcttccattaatctctccttcaagaatgaggcagcaccatgagcaatcatacagtcacgttccatctcaccgaatcttaaaccaccgtctctcgatctaccctctacaggctgtctcgtcaatacttgcattggaccacgtgctctggcatgtatcttgtcatccaccatgtgtcttagtcgttgataatatgtaggaccaaagaaaatttgagccattagttttttacctgtgtgaccattatacataacttcaaacccacgagattgataaccatgctcacgcagtagtttggatataccttctacagtaatgtccgtgaaaggagaggcgtcaccttcattaccagatagtgccgcgactttactcaacaaacattcaattaaatgggcaacagtcatacgagatggaatagcatgagggttaataatcaaatctggaacaataccttctgcggtaaatggcatatcttctctacgatatgtgataccaatagtacccttttgaccgtgacgagaagcaaatttgtcaccaatttgaggaatctttgtagttcttacacgaactttgacaaactttaacccatcttggtttgttgtgactaaaacttgatcaacaataccgttttcagtacttctcaatggtgtggaagcatcacgtttggaatggtatgctgttctttgaccgagttcctcttcatctggtgagattggtgtggttttaccgataatcacatcttctcctgaaactctaacaccaggcgcaattagaccatcatcgtccaacttatcgtatgtaccatgtttcattcttaaggtgtttgtacgttgtggtttctcaaaagtctccgttatagacataccgtacttcttttcctgatccatataagatctgaaaaacagagatctgaatagaccacgatcaattgaagactggttcataatcatagaatcttcttgattataaccggagtaacatgcaatagcaacaattgcattttgaccagcgggtaattctctaaacttcaaatattccatcgcacgtgtagtacccaatggtttttgaggataatatagaatattggccatagtatccatacgcacattatagtttgttaaaaacacacccatagcttgcttacccatcgcagattggtaagtgttacgcggagattgattatggtcagggaatggaataatggatgctgcgacaccgagaatcatagaaggatgaatctcacaatgtgtaaatgttgtagcatgatgtgatactcttatacgtttggcaggatcaacatcgagatcgttttcctcatttgcctctgcaggctcgagatcttccggttgcattgcgatcaatatagattcttcttcttcagcatcaatgtattccactaaaccctcattcaataatgatgaccatgtatattcttctacatcttcaaatccaccttcaatatcttgatattcggtagccatcagtttggcaatatgaccctttcttacctttaattccttatggcctagtgattcatcgtcttcaacaataaataatggtctataaactctaccggcatctgtaaagatttttagctccttttcacgaatatctctaatcatagaaacttccggattgatatcaccctttcttctcaatgttctaagggtttccattaatcttgctgggtttctgtgaacaccgtgccaaacaccattgacgaagacccttgtcgcgtcaggtgattgatgtggtacgtaatcttccagtggttccataccccattcactcaaaaaagtgatgataggcatcggatctgtaccaacagaaatacaagacatcagtgacagattcttaactaaaccacacgcttggccttcaggagtttctgcaggacagaccaacccccaatgtgtattatgcaattgacgtggtttggctaatttaccatcacgaccaataggggtatttgttcttcttaaatgtgataaggtggatgaataagtgtaacggttcaaaacctgagaaacacctgccctagaagacatggcttttttttgttcaccccagttaccagtagccaaagcgtacttaagacccgatgttatggtttttgcgttaatcgctaatttcatgttaaagtcatgggcttcctctacagttctttgcatataacggaaaatatctttagttaattttttgaacaatgtcttgaaaagttgggccaataatggacctgccaaatctaatctttttttcccgaaatgatcacgatcatcttggtctttacgatctaaagcacacagtaataatctgtttatcatataacctaagaaaaatgcctttctactttcaaaaccttctaattgagtaatatgaggtaggaattctttttgtaaaatgtcttttgcatattggattcttttttctttcttaataccaagggcagtaccacgacgaccaataaagtctaatgcagtttcacgatcttgaataacaaacccgtcttcaacacaaggcttaagcatttccagcatttgccaatcatttacgtcgtagcagatatgttctaaaatttcaccgtctggaataatacctaaagctctgaatatgattacaataggaatatcctgtttgatatatggtaatgtggctttaatagtacgagctgaactaccctcacgaccataaagcttgacttgaagggtactgataaacctagaacctttttcaagggcagatctaatttctgctacatgagaaattggagatggggcggcttttttaaacacttgaacaatattacctgcagaacgctcctgtgcaatcaaaactttttcagaaccattaatgatgaaataaccacccatatcaaagggacattctttcagcttatataaatctgattctgtagcctcacttaggtaacaattctttgatcttaacataatcggtaaacggccaatgaaaacttttccgctttcgctgtcatcttcagattcttcggcaattaattcatatttcagttccctacctggaacatcaatagcttcatatgttctcttcttaacatcaacaaataaaccagacgaatatgtcaaattacgtaaacgtgcttcttgtggatacaacgcatgggtaacaccatcagattcatttaccattggctttgtaacatagattttaccaaaactaatctcatactttctactgatgttgtctgattcggtagtatgttgagccaactgctctaaaatcaaggtggaatcctcgcaaataatgtcttgtaaagtataatcaacgaattgattgaaagagtcaagttgttgtgaaactagccccttctcgcgaaaaaaagcggatataacagcccacgaatcttctgcagtaattggtgcactttcatcctcgaatccatatgggtcctcatcataatacttttctgagtttgcaaggtctgacatccttataattatttttctatacttgtttgtgttctttttctggtcctaatttttataatacggagcttctacagtgtcttattccgctgtcgtgttccttatgtttgttccttactgttgggttcttctttaagaaatatacgataagcaaaaattattcgaactatctgtaaacctgaggagaaggaatgagtgcaatatccaagtaccctaactttataaagctgctccctacttagacaaatcactagcttttatggttgctaaaagtagtggtcagttccttattgcatgaattacaactcacttcttgtttgttcgccactttttcaaaagctactacgaaagtgagaggatgaaaaaaaatagaaaagtgaaaaatcattttgaacgccaagcagggtaacaaattattttaagatggccgctattttgtcaactcagaattatttgggattatgcttttaaaacagagaaacctcaattatagtgcagttatgaaatgctatatgctatgttcagcctataaactcatagtagcagctcgaagtagcatttttttaaattcttcaccatttggacaactttatttcattcttttatgtatactttctttccttaatagccgatacagcatgtttaaccatgccgacgattatgcggcgggttggagaggaagtcacaagaaggaactatattatttatttttttctgtttcctagaatgcatacatatgcgtaaatatatatggcgatttttgtgtttcgtcgcctgaactttgttttgtgtctatgaaaaattaggtaccttcatagactaccattatggtaaaatggaaaaactattctaatccaattcagttgtctcatctagaatatcctccataaaatcataatcattcgggaactcagtgctggtaaaattttgttcgaaagacgatgattgttgtgaagacttctgataagcagctccattctttgtagattcacggtcaccgttttgatagcgatttttgtcgccttggggttgctccgttacaaagggtctcaatctcgttagaatgagattttgtaggaaatcagaaacttttgctaagtagaatgttcttggaaattcgtacctttttgttacagatattaaaatctgagttaatttaccgaataagaatttgtcattggtgtcatctgcaaaccaaatgttataaattgaagaaaacagtaaataactgttaaaattcggttctgttatcttattaaggaatccggtaagcttgttttgagattccataaaggcaatgaagtcatataccagctctcttgtcaagcaaatacttccaaacgacataagtaaagaggtaaatggtaagaaattcagaaaggcatcaataggagtatagaggtaaataaaatgtatgaactcgtaaagactccaatattttaacagtgatttataaatggtgatgacaactggggactgacccaaagaagtagcggttttagcagcacttgcctttgagaagtcaacggaagacgtcagatagaccacttctaatgtcagctgcaaaggaatggcaactgaggtaagcaaaaataagggccataaaattaaattaaacattagttttctatggtggagtgaagcacagcagaaagaacgttaggaaccttagctaaaagatagaaaaaaagagcactacaaaaatcttatcctcgatttgaaatactaatgtcgagccagatcaaattaaatgaaatcgaaatgatataacgttgctcttgcacgtgtatttcgctgcttaggaaagttgtttccacatattatcttttgtacgattttaaacagtaaaatcgatgcatattaagggaggcccaatacccgcgggcagtaaccgcatctttggaaataccgggtaataataaatgcccgggaaaaaagagcataaaacagagaggcgatataggaatgaatatgtgctatttacggaagggaaaaacacttattgtttttctgaaatgtgacacagtaaagtccgtcatatacggttctccgttgggcgctaccacacacatatatataagcctgaatgcagtagacaaatttcagatatcatacaaaggaagcgttctctgggacccctttctatgtttagatggttcactgaacttgttcgttaacgtaaatatgtcttcctctttgattccaacaatgatattataaggaaattatcgtcacaatctaatcaacaaggacaaagaaaagaaaaagttgagagagagaacaaaagttcaaatcaaagaaaaaaaagaacatcaaattacctattacaataaacaattaagccatactcgcaacaatttgccataatagaaagcagcacctcgttggcgcagtcccttacatagtacacaacatttatcacttcacacaatcaggagtggaactcaatggaaaacaacaccacacgtatgatcttactaataaaagaacatgaacgttcctcagcgcgaacgttcgcattctgcgccttcgagcacaggataagttgcaggaagccatcacatctatgcaacgattatcacgacacaaccttgccgccgagaaaacgtccgtggagaaccattcggtcgattgcttcccacggaacgagtggactgaaacttaagactgcccctctctttccgcggaatcgctcatgccgcggtgccacaacattttcagatttactaagactccggtgagtgtgggctcacccgcgggtcgtgatcacgattcagcaccctttggactcgtgattccgtggaaaggtcagatctgtattcctacttatggtaatgtgctaaaaaaagagaaatgtctccgcggaactcttctacgccgtggtacgatatctgttgaacgtaatctgagcaatacaaacaaggcctctcctatacatatataattgtgatgtgcataaccttatggctgttcgcttttattatcataccttagaatgaaatccaaaagaaaaaagtcacgcaaagttgcaaacatataacaactgtgttagttatcactcgactttgttattctaattataaataaattggcaactaggaactttcgaaaaagaaattaaagacccttttaagttttcgtatccgctcgttcgaaagactttagacaaaaatgcccgaggccaagcttaacaataacgtcaacgacgttactagctactcctccgcgtcttcttctactgaaaacgctgctgatctacacaattataatgggttcgatgagcatacagaagctcgaatccaaaaactggcaaggactctgaccgcacagagtatgcaaaactccactcaatcggcacccaacaaaagtgatgctcagtctatattttctagcggtgtggaaggtgtaaacccgatattctctgatcctgaagctccaggctatgacccaaaattggaccccaactccgaaaatttttctagtgccgcctgggttaagaatatggctcacctaagtgcggcagaccctgacttttataagccttattccttaggttgcgcttggaagaacttaagtgcttctggtgcttccgcagatgtcgcctatcagtcaactgtggttaatattccatacaaaatcctaaaaagtgggctgagaaagtttcaacgttctaaagaaaccaatactttccaaatcttgaaaccaatggatggttgcctaaacccaggtgaattgctagtcgttttaggtagaccaggctctggctgtactactttattaaaatccatctcttcaaatactcatggttttgatcttggtgcagatactaaaatttcttacagcggctactcaggtgatgatattaagaaacattttcgtggtgaagttgtttacaacgcagaagctgatgtacatctgcctcatttaacagtcttcgaaactttggttacagtagcgaggttgaaaaccccacagaaccgtatcaagggtgtcgatagggaaagttatgcgaatcatttggcggaagtagcaatggcaacgtacggtttatcgcatacaaggaatacaaaagttggtaacgacatcgtcagaggtgtttccggtggtgaaaggaagcgtgtctccattgctgaagtctccatctgtggatccaaatttcaatgctgggataatgctacaaggggtttggattccgctaccgctttggaatttattcgtgccttaaagactcaagctgatatttccaatacatctgccacagtggccatctatcaatgttctcaagatgcgtacgacttgttcaataaagtctgtgttttggatgatggttatcagatctactatggccccgccgataaggccaagaagtactttgaagatatggggtatgtttgtccaagcagacaaaccaccgcagattttttgacctcagttacaagtccctctgagagaaccctgaacaaagatatgctaaaaaaaggtattcatataccacagaccccgaaggaaatgaacgattactgggtaaaatctccaaattacaaagagctaatgaaagaagtcgaccaacgattattgaatgacgatgaagcaagccgtgaagctattaaggaagcccacattgctaagcagtccaagagagcaagaccttcctctccttatactgtcagctacatgatgcaagttaaatacctattaatcagaaatatgtggagactgcgaaataatatcgggtttacattatttatgattttgggtaactgtagtatggctttaatcttgggttcaatgtttttcaagatcatgaaaaagggtgatacttctacattctatttccgtggttctgctatgttttttgcaattctattcaatgcattttcttctctgttagaaatcttttcgttatatgaggccagaccaatcactgaaaaacatagaacatattcgttataccatccaagtgctgacgcttttgcatcagttctatcagaaataccctcaaagttaatcatcgctgtttgcttcaatataatcttctatttcttagtagactttagaagaaatggtggtgtattctttttctacttattaataaacattgtcgcggttttctccatgtctcacttgtttagatgtgttggttccttaacaaagacattgtcagaagctatggttcccgcttctatgttattgttggctctatccatgtataccggttttgctattcctaagaagaagatcctacgttggtctaaatggatttggtatatcaatccgttggcttacttattcgaatctttgttaattaacgagtttcatggtataaaattcccctgcgctgaatatgttcctcgtggtcctgcgtatgcaaacatttctagtacagaatctgtttgtaccgtggttggagctgttccaggccaagactatgttctgggtgatgatttcattagaggaacttatcaatactaccacaaagacaaatggcgtggtttcggtattggtatggcttatgtcgtcttctttttctttgtctatctattcttatgtgaatacaacgagggtgctaaacaaaaaggtgaaatattagttttcccacgcagtatagttaaaagaatgaagaaaagaggtgtactaactgaaaagaatgcaaatgaccccgaaaacgttggggaacgtagtgacttatccagcgataggaaaatgctacaagaaagctctgaagaggaatccgatacttacggagaaattggtttatccaagtcagaggctatatttcactggagaaacctttgttacgaagttcagattaaggccgaaacaagacgtattttgaacaatgttgatggttgggttaaaccaggtactttaacagctttaatgggtgcttcaggtgctggtaaaaccacacttctggattgtttggccgaaagggttaccatgggtgttataactggtgatatcttggtcaatggtattccccgtgataaatctttcccaagatccattggttattgtcagcaacaagatttgcatttgaaaactgccactgtgagggagtcattgagattttctgcttacctacgtcaaccagctgaagtttccattgaagaaaagaacagatatgttgaagaagttattaaaattcttgaaatggaaaaatatgctgatgctgttgttggtgttgctggtgaaggtttaaacgttgaacaaagaaaaagattaaccattggtgttgaattaactgccaaaccaaaactgttggtctttttagatgaacctacttctggtttggattctcaaactgcttggtctatttgtcagctaatgaaaaagttggcaaatcatggtcaagcaattctatgtactattcaccaaccctctgctattttgatgcaagaattcgatcgtttactatttatgcaacgtggtggtaagactgtctactttggcgacttgggcgaaggttgtaaaactatgatcgattattttgaaagccatggtgctcataaatgccctgctgacgccaacccagctgaatggatgctagaagttgttggtgcagctccaggctctcatgcaaatcaagattattacgaagtttggaggaattctgaagagtacagggccgttcaatctgaattagattggatggaaagagaattaccaaagaaaggttcgataactgcagctgaggacaaacacgaattttcacaatcaattatttatcaaacaaaattggtcagtattcgtctattccagcaatattggagatctccagattatttatggtcgaagtttattttaactattttcaatcaattgttcatcggtttcactttcttcaaagcaggaacctcgctacagggtttacaaaatcaaatgttggctgtgttcatgtttacggttattttcaatcctattctacaacaatacctaccatcttttgtccagcaaagagatttgtatgaggccagggaacgcccctcaaggactttttcttggatttcatttatcttcgctcaaatattcgtggaagttccatggaatatattggcaggtactattgcttattttatctactattatccaattggattttactccaacgcgtctgcagctggccagttgcatgaaaggggtgctttattttggttgttctcttgtgctttctacgtttatgttggttctatgggtctgcttgtcatttcattcaaccaagttgcagaaagtgcagctaacttagcctctttgttgtttacaatgtctttgtctttttgtggtgttatgactaccccaagtgccatgcctagattttggatattcatgtacagggtttcacctttgacttatttcattcaggctctgttggctgttggtgttgctaacgtagacgtcaaatgcgctgattacgaattgctagaattcacaccaccatccggtatgacatgtgggcagtacatggaaccatatttacaactagcaaagactggttacttaactgatgaaaatgccactgacacctgtagtttctgtcaaatatctacaaccaatgattacttagctaatgtcaattctttctacagtgagagatggagaaattatggtatcttcatctgttatattgcattcaattatatcgctggtgtctttttctactggttagcaagagtgcctaaaaagaacggtaaactctccaagaaataatagaattttgaatttggttaagaaaagaaacttaccaagatggacttttttaataaacatacataatcactacatataggtgcgtaataataagtttttattttttttttcttaattcagcgagctttctacatttcaattttcttgaatttaccagctctgataaatcaaagttcaatgtccgaaagaattccgagaattttattcctaggttatctcatcggtactttttttttataggcatcagcatttagtgtgaaaacattatttcttaactgtgccttacggttaaaaagaaaggacgcaatggatatagttaaaatataagatatattatatcattatctgtccgaatggcgaaccgtcttctcatatacggccttattttgtgggtaagtataatcggatcttttgcattagataggaacaaaactgctcaaaatgcgaagattggtctacatgataccactgtgatcacgactggaagtacaacgaacgtgcagaaagaacattcctcaccactatccaccggttctttaagaacccatgattttagacaggcctctaaagttgacatacggcaggctgacatacgggaaaacggtgagaggaaagagcaagatgcactaacacagcctgcaacaccaaggaatccgggcgattcgagtaattcatttttatcgttcgacgaatggaagaaggtcaagtcgaaggagcactcatcaggccctgaacgtcatcttagtcgagtgagggagccagtcgatccctcttgctataaagagaaagaatgcataggagaagagttggaaatcgatttggggtttttgacaaacaaaaacgagtggagtgaaagagaagaaaatcaaaaaggattcaatgaggaaaaggacatagagaaagtttacaaaaaaaaattcaactatgcatccttggattgcgctgcaacaattgtcaaaagcaatccagaagcgattggagcgacttctacgttaattgagagcaaagacaagtatttactgaatccctgttcagctccgcagcaattcattgttatagagctttgtgaagatatcctggtggaggaaattgaaattgctaattacgaattcttttcctcgaccttcaagagatttagggtgtcagtttctgatagaataccgatggttaaaaatgaatggacaatattaggagaattcgaggcaagaaattcaagagaactacaaaagtttcaaatacataatccccaaatctgggcaagttatttgaaaatcgaaattctatcccattatgaggacgaattttattgtcccatatccttaatcaaagtatatggtaaatcaatgatggatgagtttaagatcgatcaactaaaggctcaagaggataaagaacaatccataggaactaacaatataaacaatttgaatgaacaaaatatccaagacagatgtaacaatatagaaacgcgtttagagactccaaacacaagcaatctctcagacttagctggtgcattatcatgtacttcaaagctcatccctttgaagttcgatgaatttttcaaggtgcttaatgcatccttttgtccttccaagcaaatgatatcttcttcttcttcttcggctgttcctgtaattccagaagaatccatttttaagaacatcatgaaaaggctgtcacaactggagacaaattctagtttgacagtttcttacattgaggaacagagcaaactgctatctaaatcgtttgaacaacttgaaatggcgcacgaagcaaagttcagtcatcttgtcacgatattcaacgaaacaatgatgagtaatctagatctgctgaataactttgccaatcaattgaaagatcaatctttacgtatattagaagaacagaaactggagaatgacaaatttactaaccgtcatttattgcatttggaaagattggaaaaagaagtcagttttcaaagaagaattgtttatgcgtcatttttcgccttcgtagggttgatatcctatctattaataacgagagagctttactttgaagatttcgaagagagcaaaaatggcgctattgaaaaggcagacattgttcaacaagcaatcagatgaatcctagagggcccataatcataattctaagcataattcattcaagatgaaaaaatccaccgccatatatgaggtgtttctataggaaatatctatatacttttatagtcctaatttcattttacataaactgttttaatcagtttctaataatctatgaagataattcactgtttcttgaggggatgctatccagagggtacatccagctagccttgccttaaaatcatttgctgatcccaccggtgcaaactgatcgcctacgtgtaaggtttcagagggttggataggagattcagggttataaaattgttgcaatgaacgaacaccaagatctttccccccaatatcacaccagacatcactaccaccatcaaaacaactaaattgaattcttctagatggggcaaaagactctaaagtgttttgaagggttaaaactatttcctccagttgttccctatcaagcttaacaggaacttgtcttttagaagcttcatcgtaccgttcgcctgggacgatacccactgccctgactttacggataatagaaatctctgaaggtaggtttagtctttttcttaacctgttaagagttctctcggcaaagtccaaagtcttttccacgtcctcgagggaccaagccttcattctaggcaatagccattcctctttgtcaatttgtctaaagccaaagttatcttcctccgggtcttcatagtaacggaaaaggtaactcgactcaccacccattattgttaaattctgcttttgagaaactggtatatcagttgaatcatgtaatgcaacaattaatcctttcaatctgttctcataggttccagcttcatcatatccggccgcagtgactattcccacattgataccgcaccgcaacagcttgagaatataaggaattacaggattagtgtaaaccagggagccaccatcttcatacagcgtcacatctccatcaaaagtcactaatctcaaaaccttaccattatgtaagttctcctgtttcttaaagtgaaatatctgtgcagtattcaggatatgcctgatatcattaaaactgggtgctaccattctacgcgccgaaatggcccgttgtgagtcttcccatagaaaagcttgttccaatggaagttccgtaaagaatgttccaattgatggaaccaaaagatttaaacgcgattgtcctaatatattcagagattgagaagaggcgccatcttcaatttcgtcttggctcatgtttcttgagtcaaattctattttatctttaatcagcccttcaatgtctttaaagatatcagcatactgcgaccttacacgttgagttgttgctaagtcgtcattgtagtcaccttcatgagagacggcatgtagaacaaaaggtgaggccagtagcccctttacccaatctataaactcatccttgcggtggctcttcaaatgatattccactctatatcttgaggacattgctattataagttaactcacgatcttttgttactttctttgaatagttttcttttcttagtacattcctttaccttttaaattttgttaatttaagggcggcctgtcccgctaaacgtgggaagtgaaaggacatgaaatattatagtgtaatacaggaagtatacagagaaatctatagaaacctatcactgcagattcgcacactacacccatgaagtaaccacagtagtaaaaaaacataacaaaagtcgtaatatttatcaaaacaaaaacatcatttacgcccaaaagtggaagtcaatattaagagcgaaatgaaacaatagaaataaaaatagaatacaatcggaaaggaaagaaatcaaaagacggttaatcaatctgatgttaaatcgaccacttccgagttatcttgagccgatgtgttaaagtcattagtttgggccagagttttattcattatggcgtgatttgcctgtggtctccgtttcataagggtggcgtatggattcttcggaatgtagatagaaacattagaatgccttctcttcctaatttttccatcatccccatggccgctggtgctcacgtgtatatatggagggagatgtgccgccgatgtggtccttgttggtagttcagtttctgcttctgaatttgggtccacaggggggattggaggcaaatcaccttcgattcccaaaagattacgatcttgagctgtggtattgtaattaggtccgtaggggtttctctgcgcttccgtttgattagtcaaattttgtagaacagccggtaatagtggcgttgatggccctctattgtagaatattctgctgtcaccattcgtcgccgtaacgaaagaattaatactgctattgttcgtcggtgtgtcatttatatttgtagtagcgccttggttcaaaaatgacctcatttgaaaagcatcttgataattatcttggtccatagttggagaacctttcggcgttgatgtatgattggggttgtagtcactggatccttccgattctgagggaaatatatctgctcttaattggtcattacgggggttcacgtgcgttgggaagcttttactagccggaataaaggcttcatcatctgagctatccagagatattatttcgggttcgttgtggtttgaaccattacgcaaattagtatcgaaggcatttcggctgtcataatcttgctcttgtttgacagtgccttggttctcgtttttcacactgtgattttggttaacagtatccgttataacggccgaactattatgaatcggtttccatgagccatcaacagatatctcaacttgctcaacatcttcattgcaattttgaataatattatctacaaattcggaaatcttcaactggtcgaattttatagggtgttgacaaatcggacactgccatgtagggacttgtgactgagagtgaagaaaccagagagcatcaaaacattggatatgcttacattggtcagtcttcgccggatacttcatccttgtacaagatataggacattgcaaactcagcaccgtggaggttgtaataatatcgtcatcatcttgctcattcaaggttcttttgatgtatgctgtggtggcttgcttgataattttgggccttttcagaattttccccagaagagcttcaggtgaaaaaacttccactataaagcaacttatagagtactctttatcaatattgagataatgtaagtctaggtgattcatctcggtcggtactttaagataaggcgttaaatttgcaggattacctgtcccattttgtttctttaaacctttcacgttgtcctctagtttggtgccattaaacactagttcacagggatacgggaaatctattgcctcatggcccacagtttcatatataaacggtattgaaaagccagaaaacaaatacagtttataactcttgttagatttcaaaagatcatgattagatttacttaccttgaacttcatttttgtacaacctcttcctgcagattgcttcaattttttattggcatccggtatttgtactattggtttgtaaaacggtgaggtaaaagaatatgctaaggcctgttgttgggaataaggtggcaatgcagtactctggagagctgtcacgggtagttgccccgatgctacaggatgcttgaacgcacccgtctttaaagtttcccaaagggtagagtattttggtaatgatgagtttatccttactttcgcgataagaatcttaatagccttaggcctccacggatctatatgtccaatatcacaggattttcttaagaattgttttattcggtcttgtaagacagcctttttgcccgttatggataaatccagagatttgcatatttgctttaactctagaacctttaattgttccatttcatttattgcatcttttatttcatttatgagtccaccacctgtgttggacaaagggttcgtaaacatataactggcattattattattattattattattattatttgacatgacacttgccatcgtgctcttttcccttatacgtttcttgattatcagtgtatcgtttgtggtattcttagttccttgatatttgcctcagtaatagccctttaaagaccaacaaacggatgactatagaaatgttaattttagtgttatgttatatgtgtggtactgagctgtgtttgttatattatgctctgtgtgataaaatagctaaaatggatggataaattaacacgaaaattaacgaacaaaaatcaactaacacacttcaaagcataaaaaaaagaaaaaagaaaaagaatcaagaacaaataataagctctgctataagaaaatatattatgtaaatagttttgcggttagtttttgacttcctttatcacattttgttgaacaatgatttactatactaaaatatacttaagttctatgttttactttcaagccgttatatcgacttgttcttcttgtatgtcacaaatattgacaatactctccttcagcacagcagttgtacccctggggaatttgtagcttttctgcttttcttctctaacatttggagtcaagtaattcctcaagtattctgcatctttacctatttccatgacacacacatccacattagaaccagaccccaaatcattccagataccagcctggattgcatcagaggccaactttatggcttcctccttcgtaaggtcttgcttccagtgtgattccaacacagccattgccgctagagaaccagatcctagagaaaggtagtagcccacgtcagtagaaccatgcgcatgaatggagaacaaatgagatcccgtagggtctacacctgcaacaatcaaataagcaccaatatgaccttggtacttaaataggtgctgctttagcatttgtaaagctgagaccactcttggttctctcgaggtatataaggaatgtaattcaatgttagacccgatcaactgcgtaactgcctcagtatcggcggcggtaccggcaccagcacaccatattttgggggaaattctatgcaattttgcgcaattcttatctgcgacaattggaccttgtgttgatcttgtatctgctgcaatcaccactccgttattgaattttacgcctacaatggtggtacccgtggaagttgccttaggttgtgtgtgcgagttttccgctaagaaattatttctttgataattgtcgaacgataaacctgccatgctcactcaattctattttctacaatcaggtttatgtggggggagtattcctgaaaaaatttaacgctttactatacaaactctccacctcaactgatcacccttctgctgaattattagtttatccttttcatctttctttttggtattttgccactcggccgggttataaaatacgaaacatggccctaatttacccgcttttacaataaagggtttgtaatgagggtaaaaatattggccctaatgaaaaatcactagcaacggaagtgcaagtagaaccctgaagtcgccgagtaggaaagtgattcccaagaggagtagaataaagaagagaatctacatatggattatttaggtaatagtttcattgctgattgtcaacaacaataataacaaggataattgaagtatggggaaaggtgcggccaagtatggttttaaaagtggggttttccccacaacaaggtccattctgaagagccccactacaaagcagactgatattattaataaggtaaaatcacccaagcccaagggtgttcttggtattgggtatgccaaaggtgtaaaacatccaaaaggatcacatagattatcacccaaggtaaactttatcgacgtggataatctcattgcgaagaccgttgctgaaccccagagtataaaatccagtaacggttcagcacagaaagtgagattacaaaaagctgaattaagaagaaagtttttgattgaagcatttcgcaaggaagaggctaggctattacacaaacacgagtatttgcagaagaggacaaaggaactggaaaaagcaaaagaactggagctagaaaaactaaataaggaaaaatcttcagacttgactattatgactctagacaaaatgatgtctcaacctcttttaaggaacagatcaccagaagagagcgaattgttgaagttgaaaaggaattacaatcgatcgttgttgaactttcaggcgcacaagaaaaagctaaacgaattattaaacctctaccatgtcgctaatgaattcatcgttacagaatcccaactactaaagaaaattgataaggtttttaacgatgaaacggaggaattcactgatgcctatgatgtaacttctaacttcacgcaatttggaaatagaaaattattactttcaggtaacaccaccctacaaacccaaattaacaacgcaataatgggctctttgtcaaacgaaaagtttttcgatatttctttagtggattcatatctgaacaaggatttaaaaaacatttccaataaaattgattccaaattaaaccccacctctaatggagctggaaataatggtaataataataatacaaccaacttgtaaataactaatatatatactacttcaacatgtcatgtattcgaaagtgccttagacgcattacaactaaagaaaagaagaaaaaaaaatcaaatcgagaataaatatgcccatgtatatacgtcacttgcgaattgtctatttctctcgttcccctttttctttcagtccgctgatgttatcaatgtgatattatcgcctttcaacaggatcttccccaagggcgtgcccttctccacatcttctttaccatcggcactattcacaggaatttccacggcttcatcgatgacaacattcatgaactcatcaaatccaactattttacccttgattcttatgccgatttgctcgaataaccatatcgttactggtgtttgctgttgtaagaagttaaatatgcaatttattggtggcaccatggccttggttttaactttgttcgacattccaagcctcttgtttttcgctctatatccttcctgtgttccttaatctcctttccttagtattatctcttacctttaccatctattattgttatttcacttcaattttctatttctctgttagatgctcaggctttcggtataattgaaaaaaattttcgaacataagggatattgacaaaaaaataaatgaaggaaaaaggcatgaaaatactcgttgacagatcagtatcaaggatttattgaggatatactaaggattaacttgcgttatggacaacttacaggtatctgatatagaaactgctttacaatgcatatcgtctactgcatctcaagatgataaaaacaaagcgcttcaatttttagaacaattccaaagatcaactgttgcctggtctatttgcaatgaaatattgtctaaagaagatcctacaaacgctcttctagaattaaatatttttgctgcgcaaactttaaggaataaagtcacatatgatctatcacaattagaaaataatctaccacaattcaaggattctttgttgacgcttttattatcgcataaccaaaaattgattattacacaactgaatgtcgcgttagcacgtttggcgatccaatttttagaatggcagaatccaattttcgagatcatttcattgttgaattcttcaccatctatattattaaactttttaagaattttacctgaggaaaccttagacattgcatctacttccttgacagaagtggaattcaattccagaattcatgaactaattgatccgatagcagaagatgtattgaaattccttgtatcatgcatagacctattacaaaatacagacgggaattccagctcatctatttcattagaacaaattttacggtgtttgaactcttggtcgtatgaattccctgttgaacagttgctaaccgtacaacccttaataaatctcgtgtttgaaactatttccaatggtaatgaaagtgacatggaggcattcgattccgctattgattgtctctgcgttatcctcagagaaagcagagatactactaatgagcagttgatttctgctttatttcatcagttaatgcttttacaagaaaaactattgcctactctgttcacagaccatcctttgaacgatgaatatgatgacgatctcctagaaggtatgacacgattattcgtagaagctggcgaggcttggtcagttgtcatttctaaaaaccccgatttttttaaaccaatggttttggtattattgatgttgacctgcaaaaatgaagacttagatgtcgtttcctatactttccccttttggtttaacttcaaacaaagtttagttttgccaagatatcaagaatcaagaaaagcttactctgatatttttgttaaattaataaatggtataattactcatttacaatatccatcaggccagttttcatctaaagaggaagaagataaatttaaagatttcaggtatcatatgggcgatgtgttaaaagactgtactgcagtggtgggaacttctgaggctttatcgcaaccactaataagaattaagtccgcaatagaaaacaacaatagctggcaaataatggaagccccattattttccctgaggactatggctaaagaaatttcgttgactgaaaacactatattgccagaaatcattaaaatcatttgtaaccttccagagcaggccaagattaggtatgcatcaacattagttcttggtagatataccgaatggacagccaagcatccagaactactagaagttcaattgcaatatatttttaacggttttcaactgcatgagggttcatcggatatgcaaagtataatcactgcatcatcacatgcattaatgttcttctgttcggactgctctaaactattagttgggtatattgatcagttgattaatttcttcctcaacgtgcagagttcgattgatattgagtcacaatttgaactatgtcaaggattaagtgcagtaataaataatcagccagaggccaaagtttcagtaatatttcaaaagctcgtagatgataatttgcgacaaatcgaggctttgattcctcaatggaaagcaaatccaacgctcttggctccacagattgctgataagattgatttgctatatgcgctttttgaagaattgaaaccgagatacaattatcctcagcaaggatcggaacctttactccccaggatagaatttatttggaaggcattaagaactctgctagttgatgcaggtgcaatgactgatagtattatcgtagaaagagtagctaaattgctacgcagaatttttgagagatttcatgtattttgcgagccaatattaccttctgttgccgaatttctaatccaaggttatttaacgactggattcggttcctatctgtggtgttctggttcccttattgttatatttggtgacgatgaatcattccccatatccccgagtctgaaagatgctgtctggaaatttgccctctcccaatgcgagacgttcatactgaatttcaacaagtttgataaacttcaattaaacgattatcatgaggcaataatcgattttttctcattaatttcagacttgataatgttttatcctggcgcatttttgaattcaacagagcttctaggccccgtactgaatgttgccctcgagtgtgttaataagcttgataactacgatgcttacatatgtatcttgcgttgcttagatgatatcatatcctgggggttcaagactccaccgatctcaacagtgtccatcgagattgttccagatgaatggaggaagcaagttattaacgaagtcgtgatagcccacggtaaccaattgatattagtgttattcatcgggctggttactacttttgaaaacaccgctcattcagatgccatcagttgtattgtaaaatgtttaaggatattgacagaggcaaacaacaacgatgccactatttgcatcgattggatttacaaagtggtggaacaacttggccaagtaacccttaatgaaagagataatttggcgaaggccgtggttgaggggttgaattcaaaggattacagaaaggtgagggaaggaattagggcgtttgttggatggtattcaagaaagaatatcaattcgaggtttgaatagtcatttaataaatagcatattgttaatctgcacagaatgtataaaaacaaaataaacaatttaataaagatagaacttaaaggtaattgaagtagaaaaaattaagtattaaaatattgtaattaaatatagaattgttaagaagaacaaggagaaatagtgacatatgataaacatctcttcacacattctggtgactcaattttctgagtacatcaggatatgccctaaaaatctcatcaaacctatgagggtaagaatgatggaagacctccgggtcattaccaagagcaacaaagaaagttgcagtaccggatctaatggcttctgttgcaatgttgcaaatctgtaaagcaataacaaatgagaatgccattagggcgccgttgtaagcgccgttcgaattgtattgaggcgaggtaaaccttagatacaagaacgtgaacaaagcggtcatataactagcaaacattgaaaatagacccagtgcaatgttaattaaattatcattgattagggcgtccattcccttttctcttaacatataccaggtttctttggccgctcttaaatacggtttaccataaagagcgatgaacgagtatgcataatgattgaaatactcggcgagccacttcagaaagccgataatccagtcaaacaccataaacaaaatctggatggcaatttgaccgccaccgctggaggtaacatcgtgtctgatcatttgcaatatttgtctcaacaggtcgatcaaagcgactagcaaggacccaaagcaaatggaaccgaacgagtaagtcatggctctcttcaatgctccaaatgcgggccaccttggcattccttggtcagactttgacatataataccagctgccaaagacgccagaaataacacaatgtatgacgtttcttattacttcagagatataatagccgcagaaaaaaaccacaaccaaaacaccaatcaatttggaatgcgaacagctgccaccagaaacgtcacagccgccattcgagctattaggatcgtactttatgtacgtagccacaatgactgctgagaagagaaacccaaacgcactagcaactagcgctccaacaaatgaaacaaagaagatctgtgggcatttcttcatggcatcgacgacgactttcaataccgccacagaaaggggaattctagacctcataccccagtagcaccacgcggtcatgaacgtgaagactaaaaacacaatacctgcagaccagtacctcaaagacatgtacatgatggcagtcccaagagaagccactaggttgatgaccataccgcaatatataaactgcttcggaaaaattcgacaaagtgtgaggcccaaaacggagaatactagggcaataatgcacacgaaaactagcaggatggcagcattggtgttcagcgtaccagtattcacaccatcgtatattccggaacccgtactgctataggtttgggaccacgctcttaaggttatggcagcaatggcgatgaatccgcctaccgtgcataggaaaaaaatggtaaatggccaatcgttccacctgggcttgttgtcattttcagtaggaaaggcctcgtcgaagctccctataggagccccactcgttttggaatttagattgtaatattgatcctgtctaaaatggtacggcgtctggccatcgttgacattcgccgcggcagagttctcggaagaactgggcggcctatggttgggatcatatgctggaggaggttgcggaggcctctcgtatttttcattcaatggcatgacgtattaatgtaccgataattatggtcactattgatggccctaatcggaaatatgcaccttcaagttttttataatgcgcaattaaaaaaagtaagaaaggaatatagaagcattcaattgctatgattaccaataagtagcgattacgactgaactacattcaacgaatatccgcatatcaatatatatataagggcaagctacgtataaggatatatatgtgatgataatgttatatatagctggcaattacgccattacgcaaacagaaaaccccttaaacccctcaaggatctaccgaaggaagaatcctgttagaagggaacataccaaccacaaaaaaaaagaaaaaaaagcattctgcagtaattagccgtagtggactttgtttttctttctgcaaatggccgtgcggtgtcgggcggggtctctcactcagtaccattacgtgtgataactccgctggcgaggtgcgccgctccctgcaggctctccgagaggaaatctcttcgcgtatgcttatccttcatcaagacgtcttggtaaggacaacattgctctacaggatgtcgccgcgtatgtcgctcgaagggtagtgaatggctgcatgtagtacataatttgcgaaaaacagtgggcttgccaaaatctgcctcaggtgacaagccatttttccagtgggatgatctactcgtgtgtaagacatgtcgaaacgcacgctgttgcatgaaaagtagtcgtacggttgtatgtgtggtgtacgggtgtaaaagtagtcaagcgtatggcggtaagcagcgattcagcaattctatatctgaataaagtgaacttttgtaccatctttagtagccagttgattcatttttttctgtcaggtgcggcccatcatcgaagtgggttgataatctgggtaattatataaacattttgatcataaaaaagaactaaaaaaaggcttcaaagtagtcgcgccgcgagattgcctcgacttagcattaattgtctttgtaatcatcgaaaagagtggaaaattcagattgattaatcaactcttcccagcctgagttataatttgcccaaaattcatctgtcagcatctgaatgatctctgattgactctttgcatggttcttagtttcaccaggcgagggtaacattggaattattgagggcgtgggcgttggaactgcaaggctgagatcccgctgcctatcactcacaattttagcttctgatgatggattatcgctctgcggatctagttcttgtttgatttgtgctagccatgtttcctcggtcaactttctgaattcaataacgttgccaagaatagtcctataggtcctttcaatagctagctctatcacaaattgtgatgatctatgcattgtgcgtattaattctttatttccgaccgtgaacaagcgatcgaagattgacgagtacaagctcattgctgtacctaaagatagatccttgtctaaaggaacagtcaatttcgtcaaatccgaccatccaacttccatatcgttggatagacatagtccattttcgaaaagcgtcaacttaaagtagatcagagaacaaaaaaacaccaatgttttggaaaaaagccctgccgtgaggctcattgataacgccatatgtggcggtaagtgcgggttggaggcttcgaatttctctgggtaaagtgctttgtcgatacgatagcatcgaattgtggtattcacaatgatggaaaaattgatcaaaaccaattgaaacgtattatttttggattctatgtttctgactttcagcacagaatgtattagtgcataaaacgacaataatagtccgactgccatacttaaaattctactttcccttaatggaacttcttccgatatattttcacctgtgtaatgtccaagtggaccaagttcttcttctacaaaattgataattcgcttggaataagctttcaaatccgggaatttatctctatcataaagagttaacaacattggccttgtaagttttaaatatcttttcagcttcccctcatatgttttacttttactattcaatatgcaatgatcttggttttcgtctagataaaatttgttaatcaataagggtctaccaacgttacaagatatgttataatcgataaatattgccattaaccagacattttctaaactttcgatgctacccataaaaacctcatgttccttgaaagtttctctaatgtttaaatgcaaccctattgtagtaaccgtagtaactaaacattcatttatattaaccaaatcggagccatctccaccgaatgaatatgtttcacgatggtagtagaaaagtattaacatttgtgcacgctcaatgtagaacaccttagcggtggaggccccctttagtaaagtaaagaacttctcaattggggttgggacatctgtatggaagtatttcagacataggattaatagtatcacagcagctttgtaataatttttctttggattggataaaatataaactatggatctgtcaccttccgcctttacctctttttcgggcatgaaataatctaaaaagtctcttctaacttttgccttatcaagaatcacgttgatctcattgcatgctccatcattaaagaaatcatctaaaatagacaaagctttgttatatgatggtaggaaacgacatatctgtttgattaatggatctggctgccaatccgactcatccaaaaggcctagttccctgcacatcgttttttggttgttttgcttccatttatttctttctactttaaccttcgcccataattgtttatatttttcaatgaacccccaattactatttgcaatttgggttctcatagaagtggggccgtatagtgttgatcttccggaatgtttactttgtaggtagtaccggtcggcatatggatttattacaccatcgggtaatggagatgaagtttcagtagaacctctacctacactagtgcctaaaggagggaaatttggcgaagtgtacatggagctcgcagacgaattagtgtttttttcagcttctagaatacgtattttgttttctagttcttcaactttcttaagtaaatcggcgttaggatagggaccataggtagctttcttttcgatgtttttgttgaattcttcagcatattgacaggttgttaagtttctagaaatgcatgtagaacacataggtttttgctgatcacaacgaagttttctccttctgcaaaagccacaagattttataagcttgtttctcttcttaccgctagtagaagttggtgttcctgagttacttccattggctccaccggccgtactattactattatcgcttggcggcgtaacgttggtggcctggaaacttcccaacaaagcatcgcttcttcttttcattgtgacgctattcttattggcacggctgagggcaataaactttcccactttctcgttgatcttgttgttcctttgatctaacttttctcttgtaattccgaatttttggcgttttggtaattccaaggggaagttgtctattacatacgtctagtgatgtggaatactataaatgtcttggtattgttatccttttccccgtatatcagcctctaccccattagtaatatggcatggaaccttttaacgtttttctaatttccgcggatttaactccgttcactatgatttctgccagtatgatactggcagaaatctacattcgctatatataaagaggatatactggtaataactacagcttccatgtgagcttaaaacgatcatgctcatctttcttcatcttgatagagattggtaatgctgtcatactcccgtgattataaagcagaatgagaaatattgagacaaccgtaaaaacagctactgcccagaatttaaaccttcaaacttcatcatcagaaaggtatactgtgtaaataatgcgtaaatagtaggagcatggtgttctcttgtcgttgaaagaacatctgcggcgagcacgtgcggcttaattctcaaacgtctcgcggaggtaaatagtgtaaagggaagcctcaactttaagacatgaaatcacactgaaataacgcctgaaaggtcaggaacagtgagtacgtaggagtataagagcgtggggaaacacaaaatgggcaaaaccgcggataatcatggtccagtacgttctgagacagcacgtgaaggaagagaaaaccaggtttactcacccgttacaggtgcaagattagttgctggctgcatatgtttaacacccgacaagaagcaagttctcatgattacttcttctgcacacaagaaaagatggattgtccccaaaggtggcgttgagaaagacgagcctaattacgagacgactgcccaacgagaaacttgggaggaagctggttgcataggtaaaattgtcgccaatttgggtacagttgaagacatgagaccccctaaggactggaacaaagacattaagcaattcgagaactctcgaaaagattcagaagtagcaaagcacccgccaagaaccgaatttcatttttatgaattagagattgaaaatctccttgataaatttccggaatgtcacaaaagacatagaaagctatactcttatacagaagctaaacaaaacttgatagacgccaagaggcctgaattgttggaggcccttaataggtctgctatcattaaagacgacaaatagctagcacatacatatatatgtatatacgtcatggtcgtcaagccaccgcaaacatatttatctattccttcgcaaatatgctcttttcacttcgatccgcccaggaatcccgacatcatgtcttgtaggaaattcgtttgtttaggagcaacaatattgaaatattcctggcccaaaaattctaactcacttttgtaagcttgagaaaaatctaaataatggttctttaaattcaagaaatagctcttatccttagtctgacaggtaattagcaacaattgcaaaaaatttaggtcggaataatcttcaaaaaaaactatttcataaccatttttatcaattttctcgtacttggggtgaaatttctcaataaatctttccaaaaaaatgtcttttgattcatgtgcaaatgatatgttagagatgaataaatagttgaaaaccaatctgctgaagaactcagccaccgtgctatcttcgatatcatcaacttggcataaccagtcccatagtaaatcgacatatttgatcattgaatcatgtgtacctaacataaaatatctctcagcttcataaacgaaatctccctctaatagtttgctaccaatggtgttgtgcaagtaaggatctccaaatttgtattcactaaatttgatagaccaattgttcataccagtaataacgtcctttaaattgggctcgctaggatccaattcggctattaatctaaccaatctagcaactgagatgtcatcaactttaacttccgctaaatcataaacttctaaaagatagaagatcaaatccgtgcctgaaccgccctgcttcgcctttaaaaatgaaagggccccttgactaattagttctatggcatgctcgtatgatttacttctaacatatctattagcaatagttctcaacgtttgatgcgcttcgtaataatctccagctttgatcttattttcgaatctttgtaaggttttagcgagtttcgcttgtacagcattagattcagcaggaaccatagcttgttattattatttatgtccctttatgatgtttacttggttgttttaccgcacatgttattatttcatttttttgactttcctttcactttttttcccattgtttgttaccttaacgaagagcgacaaaacgaacaaaatactgaaaggtgtattttgatggtaaataattattgacttatttcaacaaacgggctactaactcactcgacggttgacatactttagtcatggctgatagacctgctattcagttgatagatgaagagaaggaatttcatcaaagtgcattacaatattttcaacaatgtattggaaatcgtgatgttggtctagattaccatgtcatctcagttttcggttctcaatcgagtggtaaatcgactttacttaacgtcttgtttaacaccaactttgataccatggatgctcaggtgaaaaggcagcagactactaaaggcatttggttggctcacactaaacaggttaatacaactattgaaatcgataatgatcgtccagatatttttgtgctagatgttgagggctccgatggttcagaaagaggtgaagaccaagattttgagagaaaagccgctttatttgccattgcagtatctgaagttcttatagttaatatgtgggagcagcaaattgggctatatcaaggtaataatatggctttattaaaaacagtttttgaggtcaacctttccctatttggcaagaatgataatgaccacaaggtgctgttactttttgtaattagagatcatgtaggtgtgactccactctcgagtttgagtgattccgttacgagagaattggaaaaaatatggacagagttaagtaaacctgctggttgtgagggttctagcctgtatgattatttcgatttaaagtttgtcgggctagctcataagttgttgcaagaagacaaatttacccaggatgtcaagaaattaggtgattcgtttgtgatgaaaggtacggaaaactattatttcaaacctcaatatcaccataggttgccattagatggttggactatgtacgcagaaaattgttgggatcaaattgaacgtaacaaggatttagatcttccaactcagcaaattctggttgctagatttaaaactgaagaaatatctaatgaagctctagaagagttcatttcaaaatatgatgaatcgattgctcctttaaagggtaacttgggatctttaacatctcagctagtgaagctaaaagaagaatgtctgacaaaatatgatgaacaagcatcgcgctatgcaagaaacgtttatatggagaaacgagaagctttaaatacaaagctgaattcacatatttcaggtacaattaatgagttcttggaatcattaatggaaaagttatgggacgatttaaaattggaggtgtcttctagagacaaagctactacctcttttgtagaaagtgtggcggcaggtaagagtaagattgagaaagaatttaacgaatcaatggagaccttcaaaaagttagggctactaatatcaaacgaagagattacctgcaaattttccgacgatattgaagaaagaatcaagcaactacgtgatgctgaattgaaagcaaaaatcggtcgtattaaaaaaaatctggttcccgaattaaaggatcatgtgattcatttactatcacatccatccaaaaaggtttgggatgatataatgaacgattttgaatctactatcaaagacaatatatctgcgtatcaagtggaaaaagataaatatgattttaaaattggactttcagagagcgaaaacgcgaagatttacaaaaatattagaatattggcgtggagaaccttggataccacagtacatgactacctgaaaatagatacgattgttagtatattgagagacaggtttgaagatgtattcagatatgatgctgaaggttctccaagattgtggaaaacagaagaagagattgatggggcattccgtgttgcaaaagaacatgccctggaagtttttgaggttctttcacttgctgtaacctcagataacgttgaaattattcctgatgtaccaatggctgaagaggaaagcggcgaggacaacgaaatatatcgggacaacgaaggtgtgtttcattcccgtcgtttcgcacacatcttgactgaattgcaaaaggagaatgttttagatcaattccgcaggcagattaacattactgttctggattcgaaaaggtctatcatcactactagaacgcatattccaccttggatttacgttttgctagccgtattagggtggaacgaattcgtggctgtcataagaaaccccttatttgtaacccttaccttgatcttaggtgcaaccttttttgttattcataagttcggcctctggggccctgttgttaatgttgttcaaagtgcagttggtgaaacaagaactgcaataaaggataaactaaggcaatttgtcgttgaagatcatgaagtgaaggaatcttttgaaatgaaagatttctcaaaaaacgagcaaaaagaaaaatgatatgaaaatattttttgatcgaataatttatttcaatttaccgtgtttacttttttgttattatagttattattataattactgttctcctaacgtgtctgtgtgtttgtatataactatagggaactatttatatgacattaaaaatatatgcaaatgcatatcgcaagcttatgagttgtgtgagtggcttcaataaatctgatagatttacactaagcaaaacatttcaggttgatatagcattgatagatgttttccattcatgaatctgtttctctaaagattgtttctcctcatttgtgaatttgctgaataaaaaatgcaatacagtctcccaaaattgttcaaatgttcttaagtcattcagatttgtcggttttgatttcaaaactgttggtaagctcttccactcattcttctttatctttgaacaagtgaaaagttccgaaaatacagacacccaaaacaaataaatgtaattcgaagcgttttctatggtagttaatttatctgggttgtaatctatgaatccaatatcttcaccatattcctttcttaaagtgtggtcaatagcaaagaaaatagtttcttttacttgctcaaacacattttgtgagactttatcgaattgcaaagggggcgtttctattccaggaatatgagcatatgatgtgacattctgatcgaaattatttactgtagagtcacgcagattagcaaatctcagttggttttcttcatatgctctcattgcaattattttcgcatccatgttcttcctaaatgaaacagttaatatatcttcagttaatgcctttgtacaaagattcttatcattcgaaagcaaaataacaaaacaatttaaaatctctttgaagtacaagcaacagtccaatatcgagtcatcctttaaactgcctggattcaagctttgtttcaatttttgacctattaaaccggaatctaaattggctagattcttataaatccagtcgttcccccatctggccaatgtgcctattgtcctatcatgttcctgattagttgtatcgtcattgtccctagcaatatcagggctcttttttagtccgtccagttcttggattacggtggttggtacaataatcaaatgatgataagtgctggacagtgatctcaatttttctaaagtgtttagatgcgaaataataaagttggtgtcgactacaaaggcagttttcaaagtaggtggatttaacagcggtaaatcgtcattgatttttggcatataattagcgacagattgtgcttccatctccctctggctagaaagatattcagaaatcatttcaacgtcgctttcatcattcaagtcacacatcggaatatcgccttcttcgtcgtgatttatacagccattactatcgcctgattggcctctattttcatgtgaagatgtggatgctatgatgttgtcgatgtcttgtaccgtatatttaccgtgtggtcttaagctagcgatatctttaatcgattcggagattttgtgagataccgaaccattgaaagtttctgatcttatatggttgttaccttttggaaaagctcgtttctcatcggtcatggatttggtaagcagctggagccactaatgttaggcctacgtatataaaattcttgtctaccatagaaggcccataacaactaacgcggaagaactcaatatacccaaaaagtatatcaatgcgggtatggtttttcgcacctaaataattagtgaatatatcacgagttacaatagagttattagtattattgtattatagtgatgtactatttaaagaagacatatataagaaacaaaaggcacaaatatataagatagattttgtatagctgcaaccttcaatctgcaaataagcttcctaacgcaaacgacgagcttcacgttcagattccattagaaccaaaatgtcgttttctctaactgggcccttcacgtttctgacaatagttctggaagtgtcttccaagaattcgacacggacttgggtgacaccaccacgagaaccggttcttcctaaaactttgatgaccttggctaaagtgactggggttttgttatccatgattgctagcttggttttctgcttttgagaagaatcgaaaacgaacacaactgtaatttacaataaatcatctattagactgaaatttcattttctttattccaagtagttcaacgaccaagaaaaaaaaaatttatcaaaaaagtgcgtggtcactctagacggccgcgtctgtacaaatgaaaaatttgacatcgcagggtataaagattgggattgatatgcttaaaagggatttgatgcttgttttaatgagaaaaaaatatcaggagtataataacgtcaatatattaaaatgtcttctgtagaagaattgactcagctgttttcacaggttgggtttgaagataaaaaggtgaaggagattgtcaagaataaaaaggtttctgattcactttacaaattgattaaggagactccttcggactatcaatggaacaaatctactagagcgctagtacacaacctggcatcttttgtcaaaggtacagatctacccaagtctgaattaattgttaacggcatcattaatggtgatttgaagacatctctgcaagtcgatgccgcatttaaatatgtaaaggctaatggcgaggcatccaccaaaatgggtatgaatgaaaactctggtgttggtattgagattacagaggatcaggttagaaattacgtcatgcagtacattcaagaaaacaaggaaagaattttaactgaacgctataaactggtgccaggtatttttgccgatgttaaaaacttaaaggagctgaagtgggccgatccacgtagtttcaagccaattatcgaccaagaagtcttaaaacttttgggtccaaaggatgagagagacttaatcaagaagaagaccaagaataatgaaaagaagaaaaccaattctgccaagaagagttctgataattctgcatcatccggtccaaagaggactatgttcaatgaaggtttcctaggtgatttgcataaagtgggtgaaaacccacaagcttacccagaattaatgaaggaacaccttgaggttactggtggcaaagttcgtacaaggttccctccggagcccaatggatatttgcatattggtcattctaaagctattatggttaattttggctatgctaaatatcacaatggtacctgttatttaagatttgacgataccaaccccgaaaaggaagctcctgaatattttgaatccattaagagaatggtttcttggttaggttttaaaccatggaaaattacttactcaagtgattattttgacgagctttatcgcctcgctgaagtgttgatcaaaaacggcaaagcttacgtttgtcattgtaccgccgaagaaattaaaagaggtcgtggtattaaagaagacggtactccaggtggggagagatatgcttgtaagcatcgtgatcagtcgatagaacaaaacctgcaagaattcagagatatgagagatggcaagtacaaacctggtgaagctatcttaagaatgaaacaggatctaaattcaccaagcccacaaatgtgggacttgattgcgtatagagttttaaatgctccacatccaagaacgggaacaaaatggagaatttatcctacttacgattttacacattgtttggtcgattcaatggaaaatattacacattctttatgtactactgaattctacctatctagagaaagctatgaatggttatgtgatcaggttcatgtgttcagacccgctcaaagagaatatggtcgtttgaatatcaccggtacagttttatccaaaagaaaaattgcgcaattggtggatgaaaaattcgttagaggctgggacgatcctagactattcacgcttgaagctatacgcagacgtggtgttcctcctggtgccattttatcctttatcaacacattaggtgttaccacaagtaccacaaacattcaagttgtgaggtttgagagcgctgttagaaagtacctagaagataccacaccgagattaatgtttgtgttggatcctgttgaagttgttgtcgataatttatctgacgattatgaagaattggcaactattccttacagacctggtactccagaatttggtgaaagaactgtaccatttacaaacaaattctacattgaaaggtcagatttctcagaaaacgttgatgataaggaatttttcagattaacaccaaaccaaccagttggtttaattaaagtctcacacacagtttctttcaaaagtttggaaaaagatgaagctggtaaaattataagaattcatgtcaactatgataacaaggttgaagaaggttcgaaaccaaagaaaccaaaaacttatattcaatgggttcctatctcttcaaaatataattctccattgagagttactgaaactagggtttacaaccaattgttcaaatctgaaaatccatcttctcatcctgaaggcttcttgaaggacatcaacccagaaagtgaagtcgtttataaagaatctgtcatggaacataacttcggggacgttgtcaagaacagtccatgggtcgttgattctgttaaaaactcggaattttatgttgaagaagataaggattccaaagaagtgtgtagattccaagctatgagagtaggttatttcactctggataaagagagtacgacttctaaggttattttgaatagaatagttagcttgaaggacgcaacttccaagtgaatgatttaatgtgcatatatgtatatatttatatatatatcctattggttgaaaatgatgtaatagtgtaaattttttaattatattagataataaagaccaactcataatattgttacgtattaatgatatataactggggatgtataattataatgaaaacaaaaatggaatataaaccatactccgatgatagaaacattatatcgccttttcttttcgatgtagtatttctttttacaaaaaaatcatttttgaaggaaaatataacgttaatctacatggattcaaactctgtatcgatatatctaccattccttagcaacgtcttgcataacatgggcattatttccacttgcaagggttccaaaggaaacttttcaccatccactgaaaataaacctgactccacttttggtataatcttataagccaatatttttgagtgaataacttctggctctaatacatgagaacctttatccaaggataataaaattggtgtcattcttgtcactgggattcttgcatccgttatgactaaatcaatggtaccatccgctggtaaagcagcgggaaaaaatttggtgtccttagcaatatacggcattttccctgtgtaaaagattgttaagttatcagttagctctgaatccattttctcccagtctctaggtactggttccgtcatcggatactttaatttaaagttgtcctcgttgagaaaattcggtgaaagttcatcttttgtactgttgttgatattgtttttagatagtaaatccggcgaagagtttgggctaggatttggttcgaaggttaaacatcctttgtttttatctttattttctaagaaatgaacttttaattcctttttagatttggcagcatatttgacgaaaacttcgcagggatatttcttaccttggataatgttgaatgctacacccaaattaaacctaacgggacccatccatctgatgaattcagtgttaatatcagattctgcaataacgccgtacgtctgactcaaaaaggataatcttggccattcgttcatataagaaggttgggaacaacacattaagtctattcttgtttcaatggatttgacaaggcacagagcggcgtacgatgggttatttgtccaatgacatgaaatgctcatagcatttcctgaaccgcaaggtagctgagttacggctagtttattgaacgcatccactctgtcgggtcttctataaagcccattaattacttcgtatggaataccatcacccgaggcacatgcaatggtatcgtatttgctgatatctaaatctttggcaatatcgatggcgtgacgggcatattttgtgtatgcaatttctattttgcagccactttccactagtattggccttgcttttgtcaggaataaatttttagcagtacctttaccaccgtggggattaataatgactaatatcgatctgtttctcttggaattttcataacttttttccaggatttcttccacagtaccagaagaaatgttctcctctccggtatttgctctcgatttcctagaaacgtgatctattaacaaggttaatttttgtggtataacatcatggcccttgggtacagcaaaagttaactcaattaactgttgattatcttttatccctaaagatggtgagttatcctgtgaatcatcgggagacaccttcacagtgttcgtttttgtatcccacttgtcttttttgggaaatgactgtgattcgcttacaggagccttatcattgctcaaactatgattctcaacgtcgtcattttcagacgaagaactcagattttccgtttgaaaaggattcgaagaaattttgccattattgaagcctttctgaccgacattcacatattttgcgttcaaaattctgttgaacggaatggtagtattaagaggcaacagttccagggaatcatcctcatcaaaagaacctccatcagagctcaaagttccatcatccagacaggacaagcagctcaacaaggataaagaatctccgcttctgagttgaccatgcttattgaacatatggtgtgattgcgatttgatcaatacaccttcatcggtcaagatagccctaagttttttctgcaccaccattatctatagtagattcttcgcgtacttttcgctgctagacttttgtgttcttgataacctccaggatcagtacgttagacaagggaaagtatcagatgggttaaacacgaattttcaccttcttgtatgcctttcttccgttaaatcatctttttgcttcaagacccttgcagcacgtttttttcaggctcggcagtagggtgacacccatggtttacaaggcgataaaatgacaaatgccaggtggtattgtaataataacggcaagagtatagaaagtcagaggggaaagcacattgaatggtcctggtaaagggagttgttaatgagtaagcggggtagtttacaggatagagcttccccatcggaggaaactgtaaagaaggcgcagaagagacggaaaccaataaagtcatgcgctttttgtaggaaaaggaaattacgttgcgaccagcagaagccaatgtgctcaacttgtaagacgaggggtcgttctggttgcctgtatacagagaaattcacccacaaaatagaaacaaaagagttatttggcagtactccgaacattgaactgttgaaaaggattgaggatttagagaaaagactagatgacaaagagttgacggagaaggatgtagcgcttagtacgagcccatttaggaacccttacgctaatttttactatttacaatgtaaaggctcgggaagaagaatagtatatggtcctacatctttgagaacgcatctctcaaacgatgataatcggtttgtaaacacgtataatcagctctggtccaaagtgaaaatcgagagaaacagatggaaggctaggcataaatggacaatgaagccagaaactcaactcctagagggaccgccgttagaaaagacaggctctgacatcttgcaacaggtttgtaacgttttgccatcttttgaacaatcgtcaaagattataacagactttttcaatactgaactggaaactaatgaagttagtgaagtattagataaaaccaaaataataaacgatttcacttcctcgtttcttccaagtgacgaactgttacccaacggtgaaaggcggattgaaaagttattaccatcgacaaagaaaaactattataagattggagttattttgatgatactgtgtattcgccatttctacaaaaatactccggaagagatagagaaatttctcatcatgctgacgggactgtcaacagctaaagtatatttcattgaacgcgctcaatttctcttattgaaatactatcatcgagaactaatttgggcgtgtggagacgattcgcatatgattagtctagttgacttattatgcagcacggcaattatgctgggtttacacttgaatataagagaaatatacaaaaatcaagaaaatattgtggggagtatggaaagtttggaaaatttgtgggtttggattatattatcagatttcaatgtttctttaaatattgggagatgtttggcgattaactcatcctattttcaagtcgatgaatgcgagaatggtgagaggttgcctaaaaatacaaacaattattcatcgacggtttttttcgatcagtcaaattcctgcatgggcaagcttaaaaggtttttaagattagctcgaccaatgctagatcaaatttatgatagaagcgcatttccagacttagccgaaaattgtaaaaaactaagaaactttgtagagactgaattccacccaatatcatattacactgacagtgagttaatatctaaagttcctttgtgcgagattaaagtgcttgcgcaggttttgaatttgttgttgacgttttattccttgaggtatttgatttacaaggaaaaaagcgttgttttagagaacaacatcctgcaaaccattttggtctctttttcccttgtcatcaatacgaccatactgtgttttaacctagatgagaagcattttcctgagttttttgatcataattgcgttcatttaccgccatttatggccttgtctttagtatacacaaatttcctttttcctagggcctctactggcttttgtgcgtttttgtatcataagttaactctttttgagaagggctattatctatcatccaacatcaaagatcaagaagtcacagattgggatttgtcaaccttgaatatcccgttggataaagctatgaacttacttactgctttcaaaatacattcagatatatttgctaaatggtctaatgataacaacaagcagttaagaattattatggctcgctcttatacatttgttatcaacatcgccctggaaagcatatatagagctgttttggaaaaagtaatcaaatatagaaccgaggtcgaaaacacatggttacaacaactccaagacgaattgaatgggtcctattcgctcactgacaatgtaaatactccaatcgatcccagtttaagtgacctgggcgtcacaagcgccagtccattggcgggaaattctccaggattacccccggaggaagtgcgaaataacagcgaaaacgcttcgcataacaatgaaactgggccaattgagactgaactggcacagacaatatccaacgaattttggacggcgtacaaccttggctgggaggaactaatgagtcagccagattataaatatttatttgatacgcagtagaggagaagttcttttacaaaaaaacatgcttgcgacagcagctagatagaaaacttgcatattgtaatggaagacagtcgagagcaagccattggcttggacttgcgcttggacctatctttcggaccaactatttaatgattagtaagacaaaaatgacatttaagcatctataaaataagaaaaataaaaaaatgaagggaaaaagctaaacactaacttcttgaccaaacaaacaaggaaaagccagtaattgcgtgaacaaaaggcacctgcaattgttctgatggatgtactttgtccaacctattctgcaagaaaaagaaatcaactccaaagaagtatggagcttactggcactctagcctccaaaagctgttaaagtgttcattcgattgtcaaaaatcttccccataataatcacccacctcaacaaaatacttccacttaattattgatcgattagagctagcgtcagtgattatatgctagtccgaaaggacagccccatgacagcggccgcgcagacgcctaggggggaaataaggggtgacaataccaatgagtataaaggcagaaagaagagaaacagaagcacgggggtttcgtttggtcttcaaatatatgttaggtcggtaccttttcattgcaaaattgaaaagatttgagcgtgtaaaagtaaaaaaatacatgatgggttcccaagatttagctagtttaattgggaggtttaaatacgtcagggtgttagattcgaaccctcatacaaaggtaatctcactactaggcagcatagatgggaaggatgccgtgttaactgctgaaaagacgcatttcatatttgatgaaacggtacgtagaccctctcaaagtggccgtagcactccgattttctttcatcgtgaaatagacgagtactcctttttaaacggtattactgatctgaaggaattaacttcgaatgacatctactactgggggttgtctgttttgaagcagcatattttgcataacccaactgcgaaggttaacttaatttggcccgcctcgcagttccacatcaagggatacgaccagcaggatttacatgtcgtcagagaaactcctgatatgtatagaaacatagttgtgccctttatccaagagatgtgtaccagcgaaagaatgaaatgggtaaacaacattctttacgagggcgccgaggatgatagagttgtttataaggaatacagtagcaggaataaagaggatggattcgtcatcttgcccgatatgaagtgggacggaatcaacattgattcgttatacctggtcgcgatcgtgtacagggacgacatcaaatctttgagagatttgaacccaaaccatagagattggttaattagactcaataagaagattaagaccatcatcccccagcactatgactataatgtaaacccggacgagctaagagttttcattcattatcaaccttcatattaccattttcatgtccatatagtgaatataaggcatccaggagtaggcgaggagagaggctccggaatgacaatactgttggaagatgttatagaagcgttgggtttcttaggtcctgaaggttatatgaagaagacgcttacttatgtcattggtgaaaatcatgatttatggaaaaagggctttaaggaagaagttgaaaagcaactgaagcatgatggtatcgcaaccagtcctgaaaaaggctctgggttcaataccaatttgggttgaaggtagaagagcagcactattttttcatgtgctgaacttcaggaagcgccggcttatataaatgtcttatttaaatgtttgtgtatacatctcaatggattttgaattttaacatagaatgcgaatgcacagtaacatagtacattcagttgctattttccgtataagctttctttcccttatagcatacatagcctttgacgtattgccagccttttcaaagaaatgcgaaaaaatagtgcattaccacctacgtaaggtaggctggagaaaaagataaacttttgcattctctgctcaccataccgcgaaggaaagtagttataacgtgtcccgttttcaacaaggttttctggtatattgttaacggtggagaaagcatctagtatcaattacttccagagtacacacaacgaatgttatgtctgtccaagatactaaagcggtagagttttctatgggtcacatcagatcatcctctgtatccctggtagcagaggctacttcaaacacgaatagtgaagacaaattatctaaggtccaactctacgaagatttgtgccggtacgaggatacattgagtaagttggtggaatctgtagatcgtttcaaaccaaaccttgatattgccaaggatttgatcagaactgatgaggccttgtttgaaaacgtcaaactgttagctgaatatgacaatatctaccgcaacttacagaagattgacaaagactctgaagaactagattctaaaaccaggaagatattggaaattctaaatgaatgtcatgacgagttaaaagcactaccgatgcttgaacaagtagagttcgagaaaaacacaattttacagcaaagatcgaaaatcaattcgacagagttgttggattatgccaccaaactctccaagtttaccaaaataccaccaacgttcgacaagggagctgtgggacccaacaattttatatggcccgcagaggatgccctacgaagaggaatgcttgctatggcctcattacatagtaaagagctaactagaatacccggtgaagaagtagaagaaacagaagtaccgaccgtaccgccatctcaaagtgaagaacaaaaagggcagatggccaagaaagaaggtacaccaaagacagactcgtttatatttgatggtactgctaaagaagttggtgatgaggcagacaataccaaagataaagaaaaggaagaaaataatgatgatgccctagatcttgatcttgatctgtttgatccggacgacttctagttgcagtgtcttgaatctcttcctcgttaggaatgaagaaaaaaaaaagttagacaataattcgtgtaggtaaaagcgtatataaaattacatatataatttactgcaatatgtcaaagtgtatgaaaaacatttgaaagtaagttcccacaggaactggaaaataagacaacaagactgtgacttccacacgcatctgtcgtttttggccatctactcttccttttttgaaataggctttggtgagtaaccactaaaactcatttttctcacacgttcacctgatccacttgcagcgttagaaaattcctgcttgaatctttcaaaagctttagaaaggttttcctcttctatttcaagaccatttttatttctccattctttgtaatctttgcagaaatcttcccaatcttccttagcattgtcccacttttctaactcaattggtggaatacctaagttcatttcttcttcttctgctgtctttcccttttcatgttcaatctttgccttcaatataccacccaagtttggagagcttgcagaaatatctttttccaacttcttttgttttctaatgaatatttctttaggttgtttggatttaaaaaattcagtaacttgtttagcatatggtcctctgaataggaaaaatgagaaagcaacaataatatgaacatagaaataaacagagccccataccattaaagatggcttcaaatcaaggataataaatggttgcaccatgtaaccaaatgctagtttaattgcatatatgccaactaaatcgtagatttttttagaaggcaaaggagtgacaccatcttctcgcaagaaaattggtctaaaattgcgtctgtagattttaccacatgtttggtacaaagcccctgtcgcaaaagtcagatagtacccaggtctggtaccatgccaaaatgcggaagttaggaaagtaaacaaagttgagcggaaaccaggttttttgcccttctttgtgacacgtaaataaacagagtattttagccacttgttagtattcatattccatgcttccaacatttcacgcgtattctgcgccgtttctacggtccaaatgtcaatatttctgacacgatcccatctgatcttttgtgtctttgaatcataaccattataacccaaaccgcacaaaatacaagatccttccgaaatagtccaggcagcgtagtacttgaatctatggatgaaaccaagcaagaataagtaatggattctgaatataaaagatctcgttgggaagccatctttgtccaaaacgtattttacggggaagtgcttcattcctagtgtacttaaaatcatccaagcaagaccttgaacaactttccataatgcaagtttaccattctttggaatctgtcttctttcaccagggtggtgtcttctcataggctttttgctttcaggcaagtcacggaacatctcacaattcaaccagctgtcaaaatcggcataatcgaaacttgggccagttagcaacgttgaatagaaaaatgcatatgccaggaactttaataagggtggatgacctctgacagcacgagatttttgatgctcagtcaaatctttgaaatcgctttcgctagtgcatgaaccatcatagtacgaccatgcaaaagaagttagtttcatggctaaaaccatttgtgaacttgtaatgtcaacggtagtttgagtctgttcgttaaggaattgggcgtgtatatgatttattgccaaatgacccataacaaacatgaaattcaagtgtggcataaacttggaacggtaaaatcttgagatcaagtaagtaaacatggtactaataaacagggtcctgaatccacttactagattcagcacaccgaataagtaaaacatcgacatagaaatgataaaacaacattttaaacctatacgcttctcgggaattctcttcaaaatagcattcagtgggaacgatcccaataagcagatagcatatcgcagtgtaaaactatcaatcccatagttggtaattatctttgttaaaacagcgtccacaggattgtacatgttggaagcgatcagcagcagaattaaatcaccacggtttgtcttggcgtatgcggtttgtcttcttgcttgacctgtgcctgtattttgtccttggctttaaatctgtttaataagaaccctttatttagatgaccattgttttcgacggtttgtggtttcgacgcgcaatgtgaaagatcttcaatgttttgttgaacagtaaagcaaaacagctcaacagcaggacaaaaaaagctaaaaaagaactcttcgcacttttaacaagcagttttactgaacaattttagaagtaaatttcaggaaggttcaacagctttacatgaaagaggatgctggccattttttttttttaaaaaagttttttatatacacaaactcagtaaaataattacaaatatgtagcatgtgtaggatgccttgaaacatctccgctggcaatagccgttagacatgcccaatcttcaatggtcaccgtaagccttatatgacgaaggagttgctgcccttcgttttctcatgctgctttttttcgtaggggatatgggattgaagaaggaggacgcgaaggaatacttttggtcggtcaaggtcactcttggcttgacaccaaacaagcgtaaattctcgtgttccacttgagtcggtttacaagaagtacagaaatatttaacacatacctgctatttggacaaatttagcagtaaaaaaaagaacgtttaaagaatgctttccagaacaatccgtacacaaggttccttcctaagaagatcacaactgaccattacaagatcattttcggttacattcaacatgcagaatgcacaaaagagatcacccacaggaattgttttgatgaacatgggtggcccctctaaagttgaggaaacatatgattttttgtatcaattatttgccgataatgacctaattcccattagtgctaagtatcagaagacaattgctaaatatattgctaagtttcgtacccccaagatagagaagcaatatagggaaattggtgggggctccccaatccggaaatggtctgagtatcaagccactgaggtctgtaaaatcttagataaaacctgtccagaaacggcgcctcataagccttacgtggcgtttcgttacgcaaagccgctaaccgcagaaacttataaacaaatgctaaaagatggcgtgaagaaggcagtggccttttctcaatatcctcatttctcttattccactaccgggtcatccatcaacgaattgtggagacagattaaggcattggactccgagagatctatatcttggtcggttattgatcgttggcctacaaatgaaggtctaatcaaggccttctccgaaaatatcaccaaaaaactacaagagtttccgcaacctgtcagagacaaggttgttttattgttttccgcacattctctacccatggatgttgttaacaccggtgatgcctacccagctgaggtagctgcgacggtttacaacatcatgcaaaaattaaagtttaaaaacccttataggttggtttggcaatcccaagttggaccaaaaccatggttgggagcgcagacagctgaaattgcggaatttttaggccccaaagttgatggcctaatgtttattcctatcgcctttacctctgatcatattgaaacattgcatgaaattgacttaggcgtcattggggaatcggaatataaggataaatttaagagatgcgaatctttaaatggcaaccagacctttattgaaggcatggcagatctcgtcaaaagccacttacagagtaaccaactctattctaatcaactacctcttgattttgcacttggcaagtccaatgatcctgtaaaggacctttcattggtatttggcaatcacgaatctacttgataagggccattcatcccacaatctcaatatcagtatattctcttatttattaattgaggttgcgtatttatgttttctttgtggtatataatatatcattatttattgcattttaaaactttttttttcattatttttctctgttgaatgcagtcaacatctcccttaatattcgatactcatctttaatactatcagcaaaaagtttaagataaaatattcttaaaaacgatttcgcccaggatcgaactggggacgttctgcgtgttaagcagatgccataaccgactagaccacgaaaccactatttgttgaaatctttaacaagcgaggaaactttagtgaaatattaaaaggactaaaccggaccggttcttctatttctacatatctaatcacccaatgtagtttttgaatatttgtgaatagttggataattgttgggatcccattgtgcacaaaggccataatattatgtctacagaatatactagatgtcctccctataggatatagtaatcctctaaatggaaccgatatttctacataataatattacgattattcctccttccgttttatatgtttcattatcctagcacactatcaatctttgcatttcagcttccattagatttgatgactatttctcaatctttatgttatctccttacgccgcatgtgataatatactgctagtatgactactagttgatagaagatagttgatttttactccaacaaaagtaacaatattatttagaactatagattccattttgtgcattcccatattctcgaggaaaacttttagtatattctgtagacataatattatcgcctttgtgaacaatagaatcccaacaattgtcgcaaatttaccaattttctagattgcagtcaccttttcaattaatcactagtgtttcacttgtaacattgtcgttgttgtttaacgtattctgtcccgtgccaactatgacaaaaatgcaatgatttcagcggttaaatacgaagcgcaacaagagttagcgaaaaataagtaccaccattctacgctaccattacttactgaaattagagacaactgttatctattggcagatgttcatacggggctttcaaatattgatgaaattatgtgatgtttagaagaagattcgaactgttttcagtagatttggtaactgtgcaaccataactcatgccatcttttgacgtcatacatagttgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggaccaatgaatattaacatataaaatgatgataataatatttatagaattgtgtagaattgcagattcccttttacggattcctaaatcctcgaggagaacttctagtacattctacatacctaatattattgccttattaaaaatggaatcccaacaattatctcaaaattcacccactcttcaatagtaattctataacaacatcaatactagtcaatatacagtagttgattcttatttcccaccagtgtaatcattttattttattaaatcgtccccaacaaaagtgggctctcaaaattcatcacatttaaatgcatataggaagagcaacagttggtttgcatctgatgttccttaaagatttcgacataatgtgcgaagtagataaaatgggtcatttattaatagttatttcattattaaccagttgtggtacaaatgcaactaaagaaaaaaactactaaactatccgggaaatgcgccttagattgcacttcttaattcttattttcgatttttatttttcctttgataatcataaagagaaacgacgatcatttctaaagccatttctgctagtataccgttaaataagaaaaataaagccaaatattataatttttctaatgtgaatccataaatatcaaagcatgcaaaaagggaaagaagtaatgtcttggatttatatagcgtatttgtctaaggggagccagctttaagaaaaaaaaaaagtaaaaaaaaattcttaaacataatgtctttttaatgtttgtaggttaggttataaaccttaattgtttggtaagtgaacgaaatgctcaatttgtaacgtgttcattttctttaagtcttggtgagtcagtaacatactttatgcacttttttgtcgcaattggataacatttactatttttgtccagtgttttcatactgctttcgattaagcaaagtacattatcaagtgcctctgcctcagaacaagaggggtcattaattttggaagtctgcaacttttgttccataaactctttgactttgtgatagcgatccttcaaatgggcatctttcgggccttcctcttggatcattgcagttgagaagctgttttgagcggtaaattgagtctgaagcgacctctccaaatgttctatttttttcatgctcttgtcaataataaagttcaattttttgcattcgtcctcttttctattatactcttccttgacatgattcatgtatttctctatataggtatatttttgaaaatattgtttctctttctgagagtaatgggccttctctgcctttaagttatcgttcatgtttaataaaactttaatttcattcttgagtttttgcacctcatattccttttgtttcatttgtttggaataatcatcttgcaactcctgaaactcgtgacataaacgccttccacgttcctggagtttataataatcccttcgcaaaatgttgtttgccgttttttcttcaagcaactgttgttgtaaactgttgatggaaatcttattatcgtcaacttcctctatttcctcaatgaaacttttgagtgcttctgtttctttcagtttgtttccatcgtcagcttgtctcaaattttgctttgtgaccttcagcaagtgatcgattgccatttgaaggcttttttcattaagttcttttttttctagctgttcatggtagtaaagtgaatctattgcattcttgctccgttcacactcagcttttctgttcgtttcatgggttatccctacagcaagcgtttcgaacgtctgcgccaaatcagaaatactatttatggatacatgcttagttggaatgttacaaagcgcatagcaacggttaaccgcgtcattgacctctttcagagtttcatttttcgattctaacttagtttcattatcaaaagaattcttcgaagccctttttccccttggtgactttaagctagacttgttgggggtaatagtggtgcttatcgatgatgggatcgaccttttgacggtgttattcttgttgatttcatttactttttttctttgatcaaaaatgttaacatcatcatcaccaaaccttacatttggcttagatggtgtcatttctttgtaaaatgaatccttgtaaggggaaatcgcgtgagaattgttgtaataatcctcgaaggagttgctatagcttgtatcttctggcatggccttatacgagaagttacagagactaacaacttatcttagtcagttcagtcgtaaaattagaataatgtttattaatttgaaaaaaaagcatttttatcactctttaaattggctgcttttatagtaagtttctcctctttcgacaacttatttactggcacaatatgatagagccgagggcggctagagatcaggcgaaaatgtgtggctgggcttacgtacacaaaaaatattggggccgctcaagagcccaaaagtaattacagtcatgtttttttatcaaaatagcatcgaaaaaaaatttaggtaaggctttacaaaacacaacacttgtaattgtagataatcaatgttatttattaatgatgaaatgtatatatagatatatatatatatatatatataagttaaacgccaaacttgcttcaatgtaatatagtaccgattcttggctgaactgaagtgtgtggtcggtaaaacaacagcgtagatgcttttaaaaaaattgtagtatcacagttatatgtatagcaaagaaaaagagtcgcctctaaaaaaaaaaaaaaactccataaaaacaacaaaaagagacggacgcggttaacgaagtagtaacttgatgaaaatgaataaaaaagaataaaattaacaaatagaaaagttgaatcttttaaaactcaaagtcgccatcgatcaacctcttgggaaaggatgggtggagatgaactgaaagtatttataaatgggttggtatttctgtgatgatcaatcaaagcgtcatcactgagacatgcagatttatcatcctcatctaagtaaaagtgaggaggaaacgaattattgtctatttctcccgcaatctgattactatcactatcttcgttttcatagtcaaaaatatcagaagcttgggaaattcccgagaaaggagctgcgctcgagaatgaagtagattgaagattcggcgacgagggatgattgtagaaacaatgggaatccaataatgattgatagttgacatatttgagatcactcttcccattcgaatgatcgtttagtattgtactggcccggttctgagatgaagatggtgcactggtgctgtttgcagatgatttattctccttaactgttccattttcttttgagggtttgattaacgtgtctgtggaattgttgatagtcgaagttttattattttcgtccatagtagtatctgtaataacactttgtttgtcctcatatgaatcctccaaagaggtaaccaaatttttactatcgttgttattaatagtattctcatttctaaagcctccgaagaatgatggagtagaaatctccggcattagggaatttaatgaatgattaaacaaattggccgttgtgaaggtatcattaggttcatataggttcgcataatcaaaattatcgagctcagtaagtgggaaactacaagaggcggaagaagaatttgtggaggaattgtttgaagaagcaaaggataatgaagaggaaatggaggaagatgatgaagaatatgacgatgaaccagaatatagtgattgatgttgagatcctaatattggtaggtcaatactattactggccgttggtggggcgagcacattgttcttatctttagttattttaccagttctggcggtgtcgttagccaaagcagaagaaggaggaggaggggtagcattttcaagtttatctaaaacaacgttcaatctcttgggcttaacccagcttgtcgtatcattatgataaagatgtttcaatggagatgtattatagtaatctgtatcctcgctgaactttcttgattgaggtaaaaaccttgaaagagtgggattcgaggagacgaaccttgctttcatttccttcggcgacatggctgcatctgtttgagaagcaggctcgacgacaactggaatcttttccttcgtttcaccgcccttcttgaaggtagtcatgaaaaggtgataatttttaccattattattatcataatatgtttcattattaacgtcatacctgcagcataattcaatgttgagtggacagctgcttgtattcttttccatagtaatgattcttttgatgagtaaaatgtacttcaaactattcaaatcaattgtaaatttaaactcatcaacattcgaatttatcgttctattaaagttggcggtaacgtaatgaatatctctccaagagttgaacgtaaatttaatttccaaatacttttcaaaactcaagtttttgacgtacactagacctgtaattttgcttgaatcatcgcctaattgagtgagagaatgcagttttacattttggccatttaagtactttgtgagctgaccttgcaaatcggaggccgataatgttttggtaaatagtggaggggctatcttgaagggaaccaagtctgtgcagtgaagtttccaatcacatatatttgttgcctgagtagccagtgaagaggtagcagatttattttcagaagtttttcctcgggtagataaagaattataggtatacccatactcggcctggctattgatgtgctcgtcaatatcatcctcatcttctgaatcataaaggtccaacttgaacatgttgtttaaggaattcatataacgaaacttcttttcatttttcagcaagtttgtgaccaacgaagaatcattgaaccagcagtcctcattgttgaaaagctggacgtcatcagcagcggtattgctatcaacaggggataatgtgggtgagttttcatttgagatagaacttggctccgcgtttttatcaaatctcttaacagttgttaattcaatagcaaaacgtacatttttctcaggtgatgtgcagaaaatttctgactttgatcttgaaataggttcagggtgtgatattttcaaggatgactttaatttcctaatcggagggtgagtggggcgacttataaggctgtctgacatacttttaatcaaatcgttatgagggaaagaaggtctcgccttagctggcgataacgtagtagcagtttgtattaccatggtttaagctcttgttctatagtaagttccagttccaacttgtttacaaaaatgaagttaaaatacaaaaataaaaaattctcaccatctactaagtaccagcctcttatagacagttaatgtgatgtattattatatcgatgattagctgtagcaataactgtgtttaatgccagaggagagaaaagaaaaaaaatatagttttggtaatggatcaaaaaagttacagaagtaatcttaaatctctctttttgttttatcgttatccgttccttaacaaaagtaagaaaaaagatgtaagatagactatggaaatagtatattatgcgttatgtaatggaaggaaactacagatacgtatatatatatatcaaatgcagtgaaactaaggatacaaaaggaggtgaatgatgcctgaaatagcaatcccttatataacaaatcacgtataagcatgagaaaagctttccccagattgcgagaaaaaaaaaaagatagggagggaagggaatctaagatatcaaagaaaaaaaaaaaaaaaaaaagtaaaattagagaggaaagactgcgacaaatagagaaaaactgttgattcgggttgtattcgtttcttttagcagtagttttctgttgatttgacgtacgttgattcaccccctgatgttttttaggccactgccccactctgctgcagataaccgcccataacccagtgagtatttttttcgccgcgtcctccttgattgtctgtctggtgttcttttagcttggctgttaccagcctgcagatccacgccacgccatctcacttacggacgaggacgctcttcatttgctgcattcataagaaggggcaaaaaaaagaggtttgtcgccgctttggagcagcgcgtctttccgcggaagaaatatagttttcggaccgagaagaagccaccacatcccactactcgctcaatacgatgtgtggagaatgcatggtctctacgcattttgtatgacggagcttacgtaagccgtttcctgcggggtgcgtcaatagaccttgacactgctgtggtactcccgcctttcctttgtttgcgtaacagatctcggaaattacatggtgcgtgctcgggctttttgtgataagagtactccagcaccgattattggtgtttacggaggcgcttcgtagcattgcagatacacacaaaactaagagtaataaaaatagctacgtaaaacaagattggttaaactttattgtgccgcttgtgtacattcgtattccgaaaaagtaaggtgaaatcaccgtcaccgatgctcatgcagctactcctcaccttttaaggttgaaatccgcttgtccttgagtaatattcctacgtattatggaaataatgtacgaatctgtgtctatgtatgcctcataattacaacagtgttgttgcttcttccttatttagccatagatacgctggtttgcgttctccgcccccgcacctaccatttccttggcgaagtagttatatggggaaaactcaacaacttgttacataatccaccaataattcagatgaaagcacatacaagaaaataaaaaggtaagtaatgacgttcagcacaatggagttgttaatttctggccaatgcttagtatgctctccactcttccctttagtgggttcgaattacaatcaatcagcttcatggtggagaaatcgatcgtggctttactcttgcctatggtgacgctaccattctttacattttctttttttcctattccttcatcgatgctaaaactgtctccaaattgttctcgaaacagattttgcaattcttggatcttccaaacgttatggtttctctctttcaattctgattcagatagcacgttcttgtcgcttgcacacaaaccgatgatcattattactatactatcggcaattgtttggcttatcattgacttctgtgtccactcaattgaaacgctgctcgcagatatttctacttcgacgtcacccagcattaacagtttcgtggcattttccgttgcagttgtttctatgcaaccgaacgtttggacaatatgaaggtacaaatcattagttcgatctgtcccactgttatttagattaattctttgatgagttctgtcacttttgtccttgggtaaatccattttacgttataatgcaaattacgtgagccgctcttgttcagtcatagtgcagacatgcaattttatctccgtttcctcttatttttttcttgtttttcttgctttcttcctttcccgaagaagaacatccgaagttaaaaaaaaaaatctcaaatttgagactattttattctatcgttgaatgagtgaattttgtaaagaagtaagtgaattgattagataaagcatgtttatcacataaagtcttttttcatagtagcaacgatgcttgataccattatgatttatatcttttatccccatcgtcggttatctaaaaattaaaatcaaaaaaaatacataatcattgtatactacgatatcgccttttcggctagatttcatatgcatccctctcggaaaacaacaacagcacatatgcataaaaccactacttttaaagactcgactttgagtggcctgggttacacaacttgcgatatttcgatgttttcttccctaagcgtcgcagttgaacaaaacatcggctaaattcttttctcttagcagaaacttcatagagttcattaatagtgatggctccttttaggctagggacctttttctgaagttctttctgtcactatcctccgcaaccgcctttaaactattgaatgattactttgctaggccaatttttttcgatcattaaaataaattctgaatataccatgaaaataaagttgcgcttgtgacctttttcgagaaacaccatttcacttgattttgcatagttattagcgaaaatagcacgattttttttttttcgatgcattttccctttgctctccttacctgcaaggttagcgcaagcaaaatgtcaaagatgcgtctaatataaacatgtatatatagtccaagtgcattcaaggaatactatcgtaacaacttttttatcctccttcgattatgcagtatcaattgtcgaagaaaaagcttaggtcacaatatggtcgaaggacggcatatcatgattctaagaatgcctttctttctaaaaagatgacgtttggttctatttcagttattcccagtttgctacccatttttcttttcattcctcgaatacttccaacaaacatataaaaattttcgtaatcgttgacctattttggggagttccttttttcttctttagaactccctttggttatatttattactacgcagatttcgagtagttgtcacatcaaacagaataaaaggggtattgtaaatttactgacttttccatcaatcccgtatgaatggatggcttacatatcttggaacgcagacttcgaaattaagtatttaggagtgagaatgtgcgttagcattttgtctcatatctaaatattcaagtttaacttgtattatttgtcctcagtacaagaggtgtacggcttttgaaagtccactcccccatttttatccggatctctgccgctggattctattttgtcacaaagtttgtgccttggagagcgccgtttgccagcccgtcatcagtaggacccttttgtgcggctgccaaattttctagagataccgccgcggccgcctcttgtctggaagaatttgcattgccaaggaaattgattcagttcattaagtacagttgtgaagcactttagttacttaacatgaatgacagttttattaggtgtaaaaaaaaatcctttttttcagagagctatttgtaaatattatatgaatattaaaaaacatcctttttgagtaagaattcctatgaaacaaaatggaacaatttcacttatattgtaagcggattttacaacagatataaaatattgtgcgccaacattaaagtattaaagaacccggaatttaacaattgcagaagtatgatcgtgtagtagattttttatgttaaaatcctatctctaaatgctatattattataacttgtggcgcctgtttccctcttgaagctgtttaaatcttttgaatggctcgccgcttgcccaaaaaggcaaggttccgttagtctccattgcttgtgctttgataagcttctgtttcatttcactgtgtaacaattctttcatacctagtacacttttcggataaagcccttctaaattctgctttatgtcctgaagaactttttcattgaatgtttcagtatttgtcaattgataattttttgtaataatagttcctatcaattctttaaatagaactggtgtgctgaaaatcatatgttcgtttgcagaatttatacccagtttttgagttaaggtaacagaagttcccacttctgcgacaaaaccgagattgctgaagggaaaaagaagaaatactgaatcgttttgcgagtaaacaatgtcacaaagagcaactagcgatgcgctaagtccgatggccggtccattcaaacagcacaccagaacctttttatggattgcaaatgcgttcgccacaaatatgttaggagagcttatagcagataccagctttgagactttctccacttcgcttgtaacgtctccatcgtttagcttgttaactgctgaaaacttacctcccgaggagaaatacttgcctgagctttgtagaacagtaaacaaaacagaatcaatatcgtttgccttatgcagtaatagtgcaatgtatacaaaatcctcgaaagttaaagagttcaaatgttttggatcaattaatttgattatgaaaaagggaccattaatatggtagcacacacgactgctcatagttagaagataactcactagacttaacaccagaaaatcctactctgtaataaaataatcccggggtaatggattggatttttctatcaggatcgtttacgtatatataatacactgtcggagtttagcgcgcttacagccgctacttgtggagtcctttttttttttttttttttggggtttcagacatccagtaaagaatagaaacaagcaacaaacttcagaactgaaacaatgcttttttaagttatcgcctaaatatattcaaaaaatatagatatgctagattttcaattataccaaagttcatattttcaaaatgaatgttaacaaaaagacaagttgatggccctttttcataaagtatgcgtttagtttcaagtaacgccggctgacgtggacgatttatcaaagaagtggttttggaatactcttcttttgcaattagaaaaaaggcaaaactaaatgcaatgcaagcagttgcccatggtacttgaaattgtgtctctggtttaaaagatctatgatataagtcttaactgatcttatagttgtttttttttgaattttccaaatagtttatatgatcattgaatacgtgcgagacgtccgaaaaggggccagtcaatacctatgaaaaaaaatcatgaatatgtaataataaatattgaatgtagaatatacatagtagaaaaggaagtgctgtagcgattgccatctccgctacaaattacagttcgttactttaagtgttgataggcgtgatttaatatgggactcctaaactcttcagataaggaaattatcaaaagggctctaccaaaagcgtcgaataagattattgatgttacggtggctcgactatacattgcataccctgataaaaatgaatggcagtacactggactttcaggagctcttgctctagtagacgatcttgtggggaatactttttttttgaaattagttgacatcaatggccatagaggagttatctgggaccaagaattgtatgtgaattttgaatactatcaagaccgtactttttttcatacatttgagatggaagaatgctttgcaggtttattgtttgtagatattaatgaagcatcgcactttttaaagagagttcaaaagcgtgaaagatatgctaacaggaaaactttgttgaacaaaaatgctgtagcattaaccaagaaagtaagagaagaacaaaaatctcaagtggtgcacggcccaagaggggagtcattgattgacaatcaaaggaaaagatataattatgaagatgtggacacaattccaactacaaagcataaggctcctccccctcctccgccaacggccgaaacatttgattcagaccaaacaagttcattttccgatatcaattcgacaacagcatccgcaccgactaccccagcccctgctcttcctcctgcatctcctgaagtaagaaaagaagaaacgcatccaaagcatagtttaccgcctttaccaaatcagtttgcgccattaccagaccctccacaacataactctccacctcaaaataacgcgccttcgcaaccccaaagcaatccatttccattcccaattcctgaaattccctcgacacagtctgcaacaaacccatttccatttccggtacctcagcagcagtttaatcaagctccttcaatgggcataccacagcagaataggccccttccacagttgcctaacagaaataatcggcctgtgccacctcctccgccaatgcgtaccactactgaaggttcaggtgttcgcctacctgctcctccacctccgccaaggcgtgggccagcaccaccgcctccaccacataggcacgtaaccagtaataccctgaattctgccggtggaaatagcctccttccacaggccactggaagaagagggccagcaccaccacctcctccaagagcatctcgccccacaccaaacgttacgatgcaacaaaatccacaacagtacaataattctaaccgcccctttggatatcagacaaatagcaacatgtcatctccaccccctcctccagtgacaactttcaataccctgacaccacaaatgactgcagcaactggacaacctgcagttccccttcctcagaatactcaagcaccttcgcaagccacaaatgtgccagtggcaccaccacctcctccggcatctttaggccagtcgcagatacctcagtcagcaccctcagcacctattccgccaacgttaccatcgacgacgagtgctgcaccacctccgccaccagcattcctaactcaacaacctcaatctggaggagctccagctccacccccacctcctcaaatgccagctacatcaacatccggaggcggttcattcgctgaaactactggagatgcaggtcgtgatgcacttttagcttcaattagaggggcaggtggcataggcgctttgagaaaagttgacaaatcgcagctagataagccctcagttttactgcaggaagcacgtggagaatctgcttcaccaccagcagcggctggaaatggaggcacacctggtggacctccggcttctttagcagatgcgttggcagcagctttaaacaaaagaaaaactaaagtgggagctcatgacgatatggacaatggtgatgattggtaatggaatgcaaacaaagatgaaactactgttatagaaaatatgtaattttatgtactcactattaatgatcaaagtaattgctctttttatgtatagtttctttaatcggaggaaattttgatataggttcaaaggcggtcagtgattgaatgatcaaggtaatagtcgggctacaatgatggccatccctatggccgtttcaaatgtttgagaaaatgatgtatagtaaatcctagattttagcagttcgaatcaaaaacccatgtaaaaagggtaaatatttcctaattataatatttttgtttaattacacatgtagaacaataaaagtatagaattttagatagtatctattggacagatggacctgggttcattcttctcttaccgttaaccaaggtaacgttaacgaatcttctggtgtacaataatctcttgtaagcacgaccctttggtttctttggcttttcagttttttcaacctttggagtttgagacttaactttaccagcacgagctagagaaccgtgaactttagcctaaggagaatttgaaaaaaaaaaaatttttcatttaatgttagtaatgagatattcagacttgtgttatggagttactgcaacgcagacgctaattttttaggaaaggtctatattcaacatgttgtgaatattaacgagaataatcgtcctttgaaattctcgtctttcttccttttttgtacatttacatctcaacataataatgatacaatattttattttcttttcatttttcagtcattatctacaggcatttgatggattattaatattatcatggggcaatctttcctattcaaaatattactttgatcgtagttttcccttttaatacaccttcttcctgtatggggacaagtttcctaaaaaaagcgtttcgtggagcattttaacacaatattaacgtaccattttgtataatttgtttatctagtatcttgaggaaggagtgctaattcagaatcttcatccttaatattgaagattgggatgagattacttcaccatggtgaatacgggacaaaactaattggaggaaaatgcagcatagatgggaaactcggtcacccttgcccgctaagcagaagacgcaaaaaacatctgcgcgaaaaagaaatgggtccacaatatgtacggatgtatggtcccaaaagaaaagccataataaggacaggaaacccggatgacggcattaatttacctgacaccggccgaggcaccttaactgcagccacaatttggtcacgagcttaccattcaaattattcttaccttgtacgcccaaaagtagtgactctttctaagcatcgcgaattaatgactacttttcttttatacgttttatatgtatgtatatatataagtgccttcataaaatagacaaagacattaaggagcctttgaaattacttaattgaacaacacaggtctaattagttgatcaatcatcgattaaccattagtgataagaaacaatgtctttggaaagagaggaaccacaacatttcggagcagggccagctcaaatgcctacaccagttttgcaacaagctgctaaagacttaatcaatttcaatgacataggtttgggtatcggtgaaatttctcaccgttcgaaggatgccaccaaagtgattgaagactctaagaagcacttaatcgaactgctaaatattcctgacactcatgaagtgttctacttgcaaggtggtggcactactggtttttcttccgttgctactaatttggcagctgcatatgtgggtaagcatgggaagattgcacctgccggttatttagtcaccggtagttggtctcagaaatcttttgaagaggcaaagagattgcacgttcctgctgaagttatcttcaacgctaaagattataacaatggcaaatttggtaaaattccggatgaatccctttgggaagataaaatcaaaggtaaggctttctcatacgtgtacctatgtgagaatgaaactgttcatggtgttgaatggccagaattaccaaaatgtttagtaaacgaccccaacatcgaaattgttgctgacttatccagcgacattttgtctcgtaagattgacgtttctcaatacggtgtcatcatggcaggcgcccaaaaaaacattggtttagcaggcttaaccctatacattatcaagaaatccatccttaagaatatttctggcgcttctgatgaaacattacatgaattgggagtaccaatcacccctattgcattcgactatccaacggtggtgaagaacaactcagcctataatacaattccaattttcactttacatgttatggatctcgtgttccaacatattttgaagaagggtggtgttgaagcgcaacaggctgaaaatgaagaaaaggccaagatattatatgaggcattggatgcaaattcagatttttacaacgttccagtggatccaaagtgtagatcaaaaatgaatgtcgttttcacccttaaaaaggacggccttgatgaccagtttctaaaagaggcagctgctcgtcatttaaccggtttgaaaggacatcgttcagttggtgggttcagagcctccatctataacgcgctttcagtgaaagctgtacaaaacttggtagattttatcaaggaatttgctgagaaaaacgcttaatatcagcggaatatgcctgtaatttggttcaaagaaaaactttttcaagtcatatgtaagttttaaataaatcagtttacgaacatgcacaagaataacttctcttctttttcttgaaataaaggccgaattatacgatatgatatgagacgttctaattacaatacgataccgtgagataaaaatagcgatatcctcgtactcaaagaagtctaattgttttagcccgttgatcaaaaaaataaaatgtatttttatttttttgtcatccagctcaagatcgtaatattggcaattaacaaccgagcgaggcacagggcaaagagaatgtgggtgagactgaactatctctcccaatatattatacttttttttgtcgcgtctaccaattaaatgaaaacataattgggaatactttcctcttcttatattttatcttaactcgtttccgatcttctgatattctatttgtatatgaataagaacattattgtaatcgaaagaagtatctcttttcaagaggattacttttcattgaaaacttttggacgggcaaaaaaaaaaaagcgccagcaggaagaaaaaaggaatctagtaaaaaataaaaattaggtttataaagtagtaagtgaagtgcaagagggagcgttattggacgatcatattgtgatcggatcccgtttattggtctttgattcaatttaaaagaaaagaaatgtacaggttaaacttcaacataccaaaaaaaaattacaatgtggcaattaaacagagaagaactaattctttaaaaatagactttcagaactatatattaaaaataaaagaaatttcaaaaaaaaatttttagattgatgtgagaagaagcagaatattttcgtatataaattttcatgtttttataaatcagcatcgtcttcatcaggtaatggtaaagcagtggcttggtccatttcttgctggtattggtgcattagttgctcgtcaacttgcacctcaggtggggccaatgcaggagacgcaacaaactccaattgtgggttaccggcaagttttctagccaaccacaagaaaggcttttcaaaattataattggattttgcagaaatgtcataatattgtaagttcttttttctatggaaagtgatagtcttggccttgacctttctctctttgacatcgactttattgccacatagcactatgggaatattttcacacacacggactaagtctctatgccaattagggacgttcttgtaagtgattctggatgtgacatcgaacataataattgcacattgagcattgatgtaataaccatcccttaacccgccaaatttttcttggcctgcggtatcccagacatcgaacttaatttcaccgaaattagtataaaaagatagaggatgaacttctactccgatagttgcaatgtattttttttcaaattcaccggtcagatgtctcttcacaaaggtagtcttaccagtacctccatcaccaacaagaactaacttgaaagtgggaacctcggcattgttttgagcaggtgctgacattacgaacttatataggtagtcacaggtttatatctttattgtgcttagccgaacacttactttctctcaaattccatcaagaattattgtttattcctccagaagagatcaagtaccatttacactattttttgtatttaaggggtggcagaattcaggatgccacatgcggcttttaatgatagcaagcttatacagcggaagacaaaaaaacgggtaactgacattgtatatattcaccttgaaaataagtgctaacgccatgtaagggtatggcccgcttaaagggcaagttcactccgctcaagatacaaaactgaaacgatgaagaaaaaaagagcatcttgacctcccgtgactcattaagaccacttgagaccacttgctctatgtgtatcaacctataaactgtatatcttttgcattttgcacctccttaaggaaagaaactcccttcgaaagtattatttccctgtggccccttacttctctaattgacaagacagaattttctcgataattccctggataaagtgtcagtttatagagtagatctcacttgccttttgactgcttccgcaagcagagggatcgtaagttgtacacaccattgccttggctattaccaccacaatgtcgtggcaatagcggaaccgtgcggatgtagccattgctgcaagcgaaagcgcggaggttagcggcaatggcgttcaaaacgggatggcttcttcgccaagtacacggaataatatccagatagaagtatttttgtgcggtaaagggtaccacatctgcagcagcgcaatgaaaattgcgtatcaacagcaaaagaaatacttaaatagcatgtttagcacttttgatataaaaaggggccgcaaatgttctggcgtattactgttttttcttgtcaaatgtgtcactaagcaagcaacttgtaatcaagacctcaattcaaggttagtttactccttctctcaaatactacgtaacagatcttattgatgactttggcttttacgaccttcgctatttccaagataaacaattcgtccacgaatgaagattctaaagtcatgatactgtgcgatgagcatcaccctttcgagaagggttactttaagtccgccatacgagccttcggcaacagcattaagctaggattaatgggtaactcgcgaccagaagacgcagcgtccatattccaagataaaaatattcctcacgatctgacgacggaagaattcaggttgcagctggtctgtatggctttttcctggttcatatttggtctcttcatcgcctgcttactactttgtatcacgcttgtgctaacatcgcgatatcctggagaaaatgaaaacaaagccacggaagttgtgccatccagtaatattgacgacgaagaaaagcaattatcgctttccgacatgatttagtactacgtggaagaaaggaaaagaagctgcttttctcatttaaaacatttagtttatatacttcgcctctggaggacttttcaatttatgcaatatgtgagcacttctctattctcgattaggtctctgatatatacatatacataaacataaagcagtaagttgggtctattatactgacaaccctgttacccgcattgaaattgacaggctgcccattgattggtcagtttcccactaacccgcgctggagctgatttttcatatttttaaggattttgttttagcacccatccgacctcagtcaatatatcctttcgcgaccaggctttcctcccttttgctgctaactggttacagattttcctatttttggtcatttttatctttgaaactgattaagctgaaaaaatttgagcttctttgttgtaaactattttgtgctttcagttttattctagctcgacaaaggtaacagacaaaaatgtcagctttattaccaagattactcacaagaacagcttttaaagcttctgggaaacttctgaggctctcttcagtaatttctaggaccttttctcaaactactacttcctatgcagctgcttttgatcgttccaaaccgcatgtaaatataggtacgatcggccatgttgatcatgggaagacaactttaaccgcagccattacgaaaacgttagccgcaaaaggtggtgccaacttcttggactatgctgccatcgataaggctccggaagaaagagctcgtggtattacaatttctactgcacacgtggaatacgaaacggccaagagacattattctcacgtcgactgtccaggccacgctgattacatcaagaatatgattaccggtgctgctcaaatggatggtgctatcattgttgtagctgctaccgatggacaaatgccccaaactagagaacatttacttttggccagacaagttggtgtccaacatattgtcgtttttgttaacaaggttgataccattgatgatccagaaatgttagagttagtcgaaatggaaatgagagaacttttaaacgaatatgggtttgacggtgataatgctccaattatcatgggttctgccctttgcgctttggaaggtcgccaacctgaaattggggagcaggccatcatgaaacttttggatgcagtggatgagtatattcctacacctgaaagagatttgaacaagcctttcttgatgcccgttgaagatatcttctctatctccggtagaggtactgtggtcactggtcgtgtggaaaggggtaatttaaagaaaggtgaggaattggaaattgttggtcacaactccaccccattgaaaacaacagttactggtattgaaatgtttagaaaggaattggactctgctatggcaggtgacaatgccggtgttttacttagaggtatcaggagagatcaattgaagagaggtatggtcttagctaagccaggtaccgttaaagcccatacaaagattctagcctctttgtacattttatccaaagaggaaggtggtagacattctgggtttggtgaaaactacagaccacaaatgtttataagaacagctgatgttacagttgtgatgagatttcctaaggaggttgaagatcattctatgcaagttatgccaggtgacaatgttgaaatggaatgtgatttgatccatcctaccccattagaagttggtcaacgtttcaatatcagagagggtggaagaactgttggtaccggtctaatcacacgtattattgaatagacttattgatgcaactggagtatatttctatatattctgttcatttcccctctcataatatatacttgtttcgttaaaattttatacgtgtaaataaagtgccataaatttttcagctttacttttggtagagtcctgctagcactagattttacaatttcatgtgcacacaccaaggacgtgttcttatgtatatgtaaaagatatcaaggcgtttttgaatgcgtttttgttgatttgtttactttccggcgtattcctacgaaaaaagcaaagaaaaatacaaaaaaacgaaacattcgcaaatgatgacaacttgaaaccgccaaaagtcatcgcttgggaattttgaggcaagaggctgcttctataaaagttttctttacatggcaaaagggtattcgtattaggatagtattggttatgaacgatatggcaaaacctctcccaactccaccgactgctgagatcaggaaaagtcgatccaattcaccaaaaaaagctcagaaaacaaatctaagtccaaacaaaaatcagaataatgagaaaaatgtacctagatcaaacggaagaaccaaaaacgaacacaatagtatggatgacgaagagtttgaattcttccatcaatttagtcgggagaaagttaaaggcgtcatacacgtaatcaccgctgaacttaaggaaaaaggtccagatgttgaatttttaatgataccgttcaggccggaacagacgaacgacaaattgctgacattactaaatcagctattcccactaggaaacggtcaaccagtcaacgaaaaaaaacagctcagaattgtttccaaggccgatgtctggactttatttcaatgcttaaaatacatttggtgcagacttccaaattcagaaatcataggctggaaatcttatttggagtttaaattcagggaagaagataaaaaatttcctcgaaaatcatttttggaaattatgcctcaatgtctagcttccccaaatcatgcatcaatcgtttacgatttttttgacttgattatttcaatttcatcaaattcaagagttaataaaatgagtgctagaaaaatatcgaagatgtgtgcaatctgggcgtttagtaaacagataccaaattctgatatccaagattacgattttgaatcagccgccatgaagtcttttgcccccaacaattccatacaagatgggctagatcagtggattccggcttcagatgccatgtttcacctactcttagcatttctaagaagttttgtccctcaagatcttgaatcggcaaagctgccgcgcacacttaagagtttactattcaataatcagtatcctccaagaaaatcaacagcgtacacatcagagacaatcctaaccattcctctggtaactttaaaaacagacgtcttttcgagaaaaccttggcaattattggagcgttgcaatgatcttcttgatttcagtgatcatgatgcattcgaagcaagagaggactacgctttattaaagtctttattcagaaagaaaaatacagtggagggaattagcaggaaaatgtcccaggagtcaagaaggttgatgaaagcaatgtctaccaaacattcaacatttcaaccaggttgggctcccagagaatgtattgaaaatatttctcatttaaaagaatgtattgaggttaaaagactagatatcgatgattattttatttggacttggttatcgtccctttctttcgaacaaacatccgaaaagaaaaaaatttttggaagatctattatattggaatttgaatttgatggatttaaaaaatgggtggttttccaagaatgtgatataacgttagattataataaaaagggtcaattgaagaaaaagacttctgcacagtcaccaacgaccgaaaaggaactacctcctgatgactttgaattagaagatccacctctctccaaatctcctacactatctcagacctacaaaaaattccaagctgaggtacctcagcaaagtactgttcgaagggattcagcacccgataaccaaggaatctatcacacagtcattagtaaaaatgcattgactaaaaataagcataatgtgaatttgcattcttttgaacataaaatctccaaatggaatcctctaaacaacctgcgaaagaaaagcggtagtaactctagtagttcatcatttgaggaaaaaagtaaagacgctcccatccgcgaagaataccataccaacaaaaatcacaaatcgaaaaaagaagagcgagtactatctcagtttagcacacttaatcctgatgaatatcagttaccagtaatagagaccggttcatcaaactttaagattgaaataccggaattaatgtacgaacacgatgatgacgacagtgacaaacttaaaaattcccagaaaagagctaccgactcagctattgaagaattaaacggtatggttgaagaaatgatgattaatgagccagacgatgtaaaaatctccataactgaggcagagactttcgaatcattgacaaagtttgatcaatataagccatccaatataactgacgatgacttacaaagcagccattcaagcgccgttcactcattgaagctaagtacaaatacaaatgattcttgcgctgatagttccaaatacaccgctgataggaaattagcggaacctagaaagatttctgaggaatccaaagtcaacgacgattcatcatcatattattctccaaatatcaacaacttgccggcatcaagaatgcctagtcaacccacttattcaaattcggattcgaaaaaggcatttacgaatgagtctcgcctgaacgtcttacaaggtgcagtcagtccatctcaacaggtaacaccaaaaccatataaaaatgcgcctggagactgtgtatctcctgttcagcaaaaatactatcagaacgatcgtagaaatgaaatgtcgcctgcaagtgcaccagttccaccttctgcatattcacctgcgaggtctccacaattctccaccaattcggctggattcaagcagaacacgattaatgtacccgttgggtataatgatcctgctcacgttttagcaaatcaaccacatatgacatatcgggaccagcataattatccatctcaccaacaaaaacaacgtcccttccaaaacaatattgtgcccccagaactaaagtccagaaatcaacgggcagatgcttcacctattccccaacatatggtgccagtaaaacaaggtgtgcccaatcttccatctaacgttccattatatcaacaaatggaacgaatgaaccctaaccaccagcaccctgtaaatacttacaaggtaactcagccgccgtatcataataacacaacaaatgcttatgggaacagccgggcaggcaatgctcatatgttagatggaaagtggagcaataatccgccgcaaatggtaccaaagggagttcgccccaatcaatatccacagcagcacgttaataggtattcaccgcaagctcaacctgtcgtacctgcggaatactacaatggacctccacctatgcgagcacctccaatgatgtcccatatggtaccagctcaggagccgatacgttacacagctggtgctaacaggcgtagttttccccaaggcatgcagcagaatgcctattccgtacccgctcagcctatgggggctgtaaatagtgaattttacctaccagaagctcctcagggaaacaaactgcatggaaatattaacaaaagacaggagagaaagaagctatatgataacattagaagcggaaatttcggcatatagaaacactttgtatctgaaattatcatctttatgaaatctcaacagttgtaaaatttcccgaatatttatacatatatatgtgtatgtaattacaagtatttaggacaataaggagagatttaagtctactacataatttttaactcctacaaatggcaggttacgttgagtaagaatataacattttattttccatattcaacatcatatgcattttatcatctcatcctcttagtcactaatttttctaacgctcataacaaaaggtgcgttacgccgtctagagcttttcttgaacgttaaaactttaccaagcagttgacgggtaatcattctcataatccaagtaattttaaagatatcaacaaaatgtactataatgccaacacattctttacttatattggccggaagataaatccaatttctcgagtaattgtggtatgtcccaagaaagtagtgttttatcagaatcgcaagaacaactagccaataaccctaaaatagaggatacaagccctccctctgccaattcgagagataatagcaaacctgtacttccgtgggattacaagaataaagccatagagatcaagagcttcagtggttataaggtaaatttcaccggctggataagaagagacgtaagagaagaacgtcaaaggggaagcgagtttactgcatctgacgttaaaggatcagatgacaaagctacaaggaaaaaagaaccagcagatgaggatcctgaagtaaaacaacttgaaaaagaaggagaggatggactggactcataaggtaatgtcaacagcttaaagttgttctcagggccccacactttctagtttggcacgtcatttatgaaattcacaaattggttacattaagtactaaatctggtagccgaccaaaaaagaacaacaaatatacaattgtatgagtaaatatgcaatataaatcaaatgtatttagttaaagggccagaagtaaggctacagactgtaaaagaaaattagatggaaaccctcttcaggaaaaaaggacattataaaagatacagccaagaagtgggcgtttataaaacaattatataacatgaccgtcgattatattctgacaggaatggcgacgattgcatcgttatatttcatttcattcccaactcaacgatactggtatcaaaaagcctctctgttcattatttgtcccactacaagcgactctcttatttttggcggtctctgccagcttaagaaaaagcggttaccaaacgacactaaaagaagcggcgcgtctggttcattagaaatttgtcagtaatgctgtcaatctttgtgtaaaaagtctttccatcagttgccaccccttttgtagcaacttccatgcgtagaacaacctcacattcattattttttttacccttctcttttaattgttcaattgcgaacagaccatccaaagattcgaaagaaagactgaggtgctccgcataaaatctttataaactttagaagtaaatggtttcgttcagagggctgactacactaacactactttttaccaaattagtaaactgtaatcctgtttccacaaaaaatagggactctatacagtttatttataaagaaaaggatagtatatactctgccatcaacaatcaagccatcaatgaaaaaattcatggagtcaatttgggtgggtggctagtattggagccgtatattacaccttctttattcgagactttccgtactaatccgtacaacgatgacggtattcctgttgatgaataccatttttgtgaaaaattaggctatgaaaaggcaaaggaacgcctttatagtcattggtcgacgttctataaagaggaagacttcgcgaaaattgcttctcaaggcttcaatttggttagaattcctattgggtattgggcctttacaacgttgagtcatgatccctatgttaccgccgagcaggaatattttctagaccgggctatcgattgggctaggaaatatggtttgaaagtatggattgatcttcatggagccgctggttcacaaaacggatttgataactcagggttgagggattcatataagtttctggaagatgaaaatttaagcgccaccatgaaagctttaacgtatattttaagcaaatactcaacagacgtatacctggacaccgttattggaatcgaattgctcaatgaaccgttaggtccagttattgacatggaaagattgaaaaatttgcttttgaagccggcttatgactatttgagaaataaaattaatagcaaccagatcattgtaatacatgatgcttttcaaccttaccattattgggatgggtttttgaatgatgaaaagaacgaatatggcgtcataattgaccatcatcattatcaggtgttctcgcaggtggaattaacaagaaaaatgaatgaacgtatcaaaatcgcctgccaatgggggaaagatgccgtaagcgagaagcattggtccgtagcaggcgaattttcagcggccttaacagattgtacaaagtggttaaatggggttggtctaggtgccagatatgatggaagttggaccaaagacaatgaaaaatctcattacataaatacgtgtgcaaacaacgagaatattgccttgtggcccgaagagagaaaacagaacactagaaagtttatcgaggctcaattagatgcttttgaaatgactggtggatggataatgtggtgttacaagacagagaatagtatcgaatgggatgttgaaaaattgattcaactcaacatttttccgcaacctatcaacgataggaaatatcctaaccaatgtcattgaaattttgtggcatatatttaaggtcttgggaatgtgatgattattattggagaaaaaattgccatctaaaactctttatataacatgatgaggtatacaaataaaaaatactttatatcttataattatgcaaataaaagtgcttccatcaaccgctacttcactttttatctgaactatgaatggggagctcatgatgattacctgttgatattacgtgaggcggaagagaagcacgagacacgggtcactctcgatattaccggacagtttacttagactatgtaacgaatatgagaggaagaaaaacaataaataaatacaaacctctccgcagttttatgaaagaacaggacagggcgtctataccgatttttacatctatcttttgagtgcttgaaaggagacgctggactatatctttaggttaaacatctgtcaaatggcagcagtacccaccatcgaccttacactagccgattcagataatgaagacatattccattctttttcgtcttcaacaagtgtggataagatagacattaggaaagaaaatgggaaattaagaatggcaggcttggaagtcgcccaatctaatgacgatgcagcacgtcaagcattccatgttttcaagacgaacatatcaaataatgaaaccttcgatactattctttcaaagagcaagacaatcacagacagtaccttcaacaatgaaaaatcttccaacgaagtaaaacagcagcaagtcttgaaggaagaaacgatgggatcttccaacgatgagaagaaaacacaagagagcagcccaagcgcagagatgataaaacttttttatgaaaacgatgatgtgccgttatccgatagttttaaacaaaaagaggaaggtaaaagaataaatcaggatgagcaagtgaaggaaaatatctgtggcatttcttcctcatacgtctccaaagactacgatggcgttgaagatgatttcgagcctaatacttgccaggacagcaatttggattttcaagaggagaagttaaacttgaataacaaaccgtcacagcaacagttcagcgacccagaaacaaaagataacagtttgaagagcgaaaacaaagaccaaataaaaggagtcacaacaacaagttatcgtgatttacctattgaatctagtgctttccaggattctgaaactcaaaataactccaaaaacactatacctaacatcgtaaatgaaaagcgaacgccagcattaccgtccaatctaagctctgttgagagttcccttaaaaacgagacggccaaagtagaggggaagacgaccgttcgtcttccaggacttcaaaataatgttgccttacttgagcaagaacaaagtgaactattcaagcactttagtgaacaacctgtcgatattagcgattttggtcgtaagattaaaaggaagcatagcggagattttgcagataacaagatacttaaaagaccgatattgccctcaaaaaatatggaccacacaacacataattcacatgattccgaacagaaaaatagctcgattattattctttcagatgaggacgaatctggtgccggtatcaatgatatagaaagtcctttgaaagtttctgaaccaaatacagctgatgcgcttaggagcagtgtaccagaagtcatatctttacttgacctacccaatattgacttgaataactcagtaataaaagaagcaagtggcagcaattcaattcctacatcagaaacagacgcacaatcctcgagttcgtcagttcttcaaggaactatcatgacagaacaagctactcaatcctctcaacacgaatgtaacagttcacttgatactctaaaaaaaaatcatcaaaaattattgaaggatttgaattctagagagtctgaactacgtaatgctctcagttgctgcaagacaaactctgaaattttaagaaggaaactaagtagaagagaaaaggaggtctctgatgctgaaaaacattggcagttattgttgacatcgatggctagagggggaagaactatcagctcaactcagcagatattagttgatgaagctgagaaccaattaaacaaactgaaggaaaaaagacagttgacaaaatcgaagctagattcaatcaatttgaaaatgtataattataacgaacaatggaagtcctttgtgcattcgaaaaatataaacctgcagaaatctttggctgcccttgagcggtcagccagggatagtaaagcttctgcgaccgtaaataaaagaaacgaatgcctggctgagaaagaaaagctagaccaaatgttaaaagaaggaaccctaagcttcagtacctacaagcagttaacaggggagatccagcagaaactgaatgacttgaaactgggggaccaacgcacaactgatatcaatagtgtattgccaatagtacggcaacctctcgccaaaagagatttatttattaagtccattgatactgcaaaagatttattagccaagaacacatccaggacagaaatgacgaagagaattctttatagacatttggacaacttggtctcttataaaaacttttttgaagacggaagatccttaatagatataaacagaagacacgttgcacatgaatcggcccaaatattgttcaccaacggtgtaaagatgcccattgtttttgaaacattacaagattacggcatcaagttttctaatccagccattgtcaatcctgacagaagagcccaatattttaaaagcatcgaagttgcacgcgatctcatatcaaagtctactagatcagaggatgctaaacgaaagattactcgatttttgaatataattgaagaatttcgtaaagatattgacaccggatttccacctactcctttaaaaagggaaggcgtcggaaaagctgttgttgggctaagacaacaaggacttaagatggacagactatatgaaaatttgagaagatataagattccaataacaagtgaagaattactgcagcaaagctatttatttccggtaaacgcagatcaacgacctccttcaaactggaacatcgtggaaaataccgaagatactagttctacagccaatgatctatcgatgcaagatgaatttcacatctctaatatgcatgcagcagaagatcaagaacagattagggctcttttagagaatgtcaaacaatctgaatccattatagacggcgaagcacttactcccgaggatatgaccgtaaacttattaaaacaccagaggctgggtctgcattggttgttacaagttgaaaactccgcaaaaaaagggggtctgcttgctgacgatatgggcctgggtaaaacgattcaagctattgcattgatgttagcaaatcgctcagaggaatccaaatgtaaaaccaatttgatcgtcgcaccagtctcagtcttgagagtttggaaaggtgaattagaaacgaaagtaaaaaaacgcgcaaaatttactacatttatttttggaggatcaggtaacggaaaagttaagcactggagggatttggcaagatatgatgctgttttggtatcttatcaaactctagcaaacgaatttaagaaacattggccgaaaaaactggatggtgaacaaaatcagctaccagctgtgcctcatatacaagctcttaataggttgaaaacctcaaatgaatactactctccatttttctgcaatgattcaacgttttacagaattttactggacgaaggccaaaacatcaagaacaaaaatacaagggcttctaaagcgtgctgtactataaatggaatgtataggtgggtcttgtctggtacgccgattcaaaatagtatggatgagctttattccttgataagatttctaagaattccaccctaccacaaggagcaacggtttaaattagacattggaaggttttttcagagaaataagcaatatcaatatgataacgaggatagaaaaaacgcattaagaaaggttagagtccttctaaatgccattatgcttcgtcggtctaaggctgataagatcgacggcaaacctttactggagctccctcctaaaattgtggaagtagatgaatcacgcctgaagggagaggaattaaaattttacacagctttggaatcaaaaaatcaagcactcgctaagaaattgttgaacaattctacgagggggagctactctagcgttctcacattactacttcgcttaaggcaggcttgttgtcattcagaattagttgtgatgggagaaaaaaaagcggaaggtacaaaggtagctaacggcaaaagctttgaagatgactggctcaggctctactataaaatcactcacatgagcggagaagcgcaggctcaggttattacttcaatgaattctatgacatgtttctggtgcatggaacaattagaaccagaagcgatgtccgttctgacaggttgtggtcatttgatttgcgacacttgtatcgagcccttcatcgaagagtcatccatgctacctcaggccaagaaaaccaaaggtggggcatttgctatcccatgcaaagattgtcaacgtttgacaaacgagaaagatattgtttcgcacaagttatacgaccaggtaataaaccagggatttactgaggaagatttgcatgcagagtatttaagtgaaatggagaaacaaaaaatacagcaaaaaaatgtatatgtgccaaattttgagagtttagaaccatctacgaagatagagcaatgtatacaggttattcaaagagtttttgatgaatcagcaaccgaaaaaattattattttttcccagtttacaacattttttgagattctcgaacattttctcaaaaataaactgaattttccctacttgaaatatattggatcaatgaacgctcagagaagatcagatgttatcaacgaattttatcgtgaccctgagaaaaggatacttctgatttccatgaaagccggtaactcaggactaacattgacatgtgcgaaccatgtagttatagttgatccattttggaatccttacgtcgaagaacaagctcaagaccgttgctatagaattagtcaaacaaaaaaagtccaggtgcataaattgtttataaaggactctgttgaggatcgtatttctgaattacagaagagaaagaaggaaatggtcgattctgccatggacccaggcaagataaaggaagtgaatagtttagggcgtcgggagttaggatttttatttggtttaaacgctctttgaagaacttggtgaattttgaagcattattgcgatacacatatgtatatgttgataattggtggctaagcttctagtttgtaggcttaagtaacttcactcgttggcacttacgagcttggcatttaatggaacagaaaataagccgtaaatcggccctactttaagtataagaaatatgcgaaatttgatatgatcgtttgaattactttttgaaaaagaaaataccattagtaacatacaatataagaagctcgtctcctggatttggaaatccacaaaagattatcaacaatgccacgaataacataattgcttccccctcctgttaattgctttaactcattattgcatcgttaacagttgttactaaatttgatttttgtttctcatcatatatgtaatcttcaaacgccagtataattatacgctcgcaacagctaccatacattaatgaaccgatgaaaatatcccgtttgatgataactggcaattaaatgacagtattaattaataatcaaagctgatcttatattcctataaaagagaagcgtataaaacacacgtggattgggggtgctttatacgtaaactgtgatttcagtaattttcgctgtaagatcaaagtaaagacacattcccttatatgtaaagttcaaattcattgttccactaatagaccgtcaacttttcttttggattttcagcccgaacaggttgcttattattaacttccttacaacaaggtacagtcagtgcattatatagatctatacaaccatgtgcctttgtgttttctaaggctatactgaaaataaattggtaatttataatttctatcttcacgcgctttctcactaacaagacttgacctctcaaataagtggcgcagatgctctagaaaaggtttcttatcaaataagttttgctctttaatcgcacaatgcaatgcaagttatttttttttttttgatttaatgactttcgatttcctctcataggcaaccggtacttatcataagtacgtaataagaaaagtatgtcgcaggacgtcataagctcagacttgaacaaaagagtaacaaaatcgcctccacctaattttcagccctactagagcctgataggatatcggcactgaagctgataagagaatcaatgaaaatatcatcctcaacagaaatactgaaaagaagcggtagtttttttttcttgttacaattatcagccaaacaaaaacagtgatctgaatcgtcaatcaaacattagtggaagaatgaaataatcgaaatgacctctatatcctgtacgaccaacaagcttaatagtagtgtttcctgggactaaagagtgtgtttaattatctcgaattttaatactagcgaaagatcttgaatgaacactaagtatgatcattttattaggttttttgctcattaggcaatttgtttttcactggaagtagaggattccttttcattatctttctgatgaacaatttcaaacacttttgtgttttctgaactagtttttgtcaactcaggtagttcatcatcggagctctcaggtttgtattcgtgtccacttgtgaagcattcgcctaatgtgtaagcacggatttcttcttcagaaatttcactgtatggaaccatgcccttcttccttgcttcttcgtcggtaaacgcaccgtagtaatctttgtcatcatgtttgacagtaattttgaatgggaagaggaggcatagtccccaatagacgaaaaaggaaatcaaaaaggagaagaaagaatcaccatagaaaaaatttataataccagtgttgtggaaatagtcattattgacttcccaagcgataccaggtagaccgggagccataccacacacccaggcaacgatagctctccagttgacacccttggtaaaatagtattcaccctttagaacaaaggcattggtaacggagtattgtctcttcctgatgaggaaattatcacagatcatgacagtgataataggtgtcattacgacaccgaaagagctcataacagtcaagaaagtagaagaagagttgtaaaagttccatggcaaacaggcccaggagacgcatgcggcaaaaatagcacctctcttaatatcaacatatttcggtaataaaccagccaaatccataccactggcaaacccacagttggagatggtatatgaaatttgagacattacaaaacaaaaaccacagaagaatgtagctgcacgcgcgcctgcagaatagttagttgtcaaccagttgtcaaagatgtccataggcatccaaaatgtttgaccgtataatttttcacaagcagaagcaccaatgataccgaatactgggatcaaggttgctggtattagtaaagcaactatagtaccagtccagatagcgcaattagaggaaccaaatctggagaagtcactttgattggtacagcctggagaaacagaaccgtaccagtacgagatcgtataaacccaagcccaagcctttttagagccagtaactgtggaatgagtagaagtgaacaagtcaccaacaccatgtgcgctcttagttaagtaaattaccatacccaacatggcgaagaaagtaccaacacacgaccaaattaaaatatagttcatatggtatggcttcataaagtaacagaacgcggtaaggatatggaagataatgaagccgatcaattccttggtggtcatggcaactttcgaggacaaagtattgggcagatgcaaatagtggtgagaccaagaatctaatatcatgtttacacaaagcccacctaaccaagcgttggaaccataatagacaatactcatcaatattctgataatgataccaagagctgaaccgtaaatcccaaagacgaatctttgagctagagtgaagccgaccttccagtcatagccaggacaagagttggctaaagcaaacaggatggtcaacaaatcagcaataataaacgcaccgatggtctctgagtaacttaacccaacagttaatgcagacgaaccgcctatccacataccaacgttgaaggacagaacaccccaatacgcaaaattagaccaaaacccccacgtttgattaacagacttgataggttgcaaatcagggttccttaaaaaattcacggaggccctatttttaacaggaatttccaaaaatctcaaagccctggagattctcgtaccgaaactcataatggtgtaatgctagagttttttttgcttgatagtatatcagatatgagagcaatagatgatgatacaagttctacagtggaaaataacatggtacacgctcttggcaacattgaaattacagctctcatatataaaaaatggaaagaaaaaagagaagaaaaaagagaagaaatgaattctattatgatagcgaatgcaaaatattcgtccacattcttttatctattgtcttccttctttctgtgcaactaccagaaaaagctatttcatctagtcgagtagactaattaatgaattatctcgtcttccatataaattaataaggcaaccagcaggagacgcctattgttaagcgtattacgaaacctgcggatctgtgcgctattgttatgccagtgaaggagcctgtcatcatgcactcatgtgcccgcgcgcgcgcttctgtgactacaacttattgtagggcgtagtacactgacgcctagcgctcaaaatacacatatgcagtgtggccgactatgcgatgaagcggaacagtctatcttatgtgaatggttgcaaaatgccgttatatggatactacggtgcgaacacgtatttataataggataatcttgtatctattcgttttatgctactagttctaacctttaggaagtgtccttcacaatatcagccctacatgcagtggtcttcgtaaatcctgtgaggttttgtctcatttctctatgctggaagggcttcgtagaagattccgcaaaataatggaattgaagccctgcgccaagcaagcctcacgaggatcgtcggttctgagacgtaaccacgctcttgaatcttgtttatgtgatcagcaatgacgtcttcggtggtaataccatttcattccggaaaagatgagtttgtagtcggttagggagtaccgtggcgtcctttcctatttctgcaaatttgctgtccatgttggcaactactctcaaaggtggcaactgcttagtaaatagccatatcgctcagagatacatatcaagaaactctagccagatgatcacgaatcccgaagcgatgtaattttccgtgaggcagtcctgaatcaggccgtagattgactattagcatctctttttgagtatgctaagaagtagagggctaccttattcccacacactttttaccacgggcgaaacatttattttcaagtcccagcacagtgatgggatgaagtccaggatgcgtcatacggtcctatggcaaacttcggggaaggtttaatatgctgctttcaagcaggattaacggtaatcaactccctaggcaaattggctcaactctgcctatctatccactgaggatttcaaatccaccgaatgggagaatatgtcagtgtccattttggagtaaggtatgagttcttttttcgtcagcttttcttctatatcttacaattgcttatcttaaaccaccgatatttttgcagtcccttcatcatcgagcacaatggcctatacgttgaaattttggttttggtttgaagcccactcatcttggcatcgctgacgtgttttcttccaagatttaaagaggactactcggtgcaggtggacatctcgaatgaatatgttacctagcttgatctcctccatcaaattacaacctttttgcagtgaattttgatacatggatttcggagcttaaacacgtattaactgaaattcaggcatggcgagaaaattcccatcagaacttgaagaatactctaaatactactgagataaaccgagaggtgacgtgaaattcttcccagatgttcaatatattatgaaaaaccatccagctgaattacctcatttgcagatcaatttcaaaggcttcggttcggggataatgagacattctgtccaaaatgtcccatttattacagcctcggaattaaggtgcttgatactgttctcataaacatgtgactgcattggtggttgatggagtaatgataccactgagcggtttcaaatgctaaaagtcttttgaagctatcacagttaccctcggatttggcagtctaattcaagtgccgtagataccgtggcattgaaatattcgaggcagttattagcaatgctcaagaggatattatgcggagtgctaccctatttgcatttttatgatgtcattgacgatgcgagaaagtctaacatgattagattggcacctgcacattatatattgcgtttctgaacttgtacattgtaatgaatgtgtttaggaaaccgatgagtaaatcataaaccaaggtgggatctcattatcaatttttttttcatatcagttacaataaatataacttgaataatttttcaatgattgtcgaatttctaaaacattcacacattctgagaataatagagcaaggttttcgaagatacaaaccccattagcaccctaatttgttgtacttgtgttttttcaccactagcacatcgttttacgattcttgaaaggctagatggaatagtgcagagcccaaaggataatatccatagttaaacagccgttctttgcgacctgaatgattgcttactttgattttgttgcattacaggctttggtaatagcaaagtttgtcgccaaatctgttttaccgttagaaaagctacttctcttcaagacgtcattctcagcttgacctacagaatgctacttatccaacatatcacgtaaaatctaagatatactatatgatagaagcgcagattaccggatctaaaataattgtctgggtatttattcatgtgggttatttatccaagcaagaatttgacccaacgtgctctatcttgtttgattcactaaggtttctactgtgaattctacgaattttgtgataatggtagggtttccattcttttcaaaggctgtaatattaggtatacagaatatactagaaattctcctccaggatatagaaatccccaaaatggaatcggtagttcaacaaataatattacgattatttctcaatctttatgccatcttctttcaccgcatgtaatagtatactagtaacactaatactatttaacagatgacattttagagttggaggagaacttctagtatattctgtatatataatattatagcctttatcaaaaatggaatccaaacaattatctcaaaattcaccaatatcttacgttgattctgttggaacgagagtaattaatagtgacatgagttgctatggtaacaatctaatgcttacatcgtatattaatgtacacctcgtatacgtttaagtgtgattgtgcctattgcagaaggaatgttaaacgagaagctcagaccatactgaagctgtgttaaagacctattagttgaacatgatatggtaggtacatatatgaggaatatgagtcgtcacatcaatgtatagtaactaccggaatcactattatattggtcatgattaatatgaccaatcggcgtgtgtttttgaaaagtgggtgaattttgagataattgttgggattccatttttaataaggcaataatattaggtatgtagaatgtactagaagttctcctcaaggatttaggaatccatgaaagggaatctgcaattctacacaattctataaatattattatcatcattttatatgttaatattcattgatcctattacattatcaatccttgcgtttcagcttccactaatttagatgactatttctcatcatttgcgtcatcttctaacaccgtatatgataatatactagtaacgtaaatactagttagtagatgatagttgatttttattccaacataccacccataatgtaatagatctaatgaatccatttgttagttaatagtttaaatgtttttatcggaagaggttttgtcatcacatcagcaatgttcttattggtctcgatgtagtatacgtataaattattacctgatacttcatctctaagtctcattgccttcgtgccaaaaaatctgtttctaaatttctcttcatttgtagacttaattatactgatcgttgatctactatcagtaagtaagcctttaataattggtttcttgttaagttcttgcacaaggtgactgaggttattcaatagcggtatagcttcactgactgcgtgtatttctgcttctgtagttgaagtgcatgttaacgaagcctttgtcgactttcctccaatcacttttccgttgagtaggaaaatgttaccaatttgtgacttgtaatatggttggttaccatatgaagcatcgcttattgcgactagtttattatctggcttggtaggtttgtttttgtgccatattaattgtttatctctagtgtcccacatgaattgtattaactcatatgtcatgtctaaaacttgcctagaggggaatagtatatgttgagcaagtgtgttgatgtagtatagtaagtcaaatctaaatttatatccaacatatgaagctagaccaatcaacttttgcatttcatgcactttctctttgtattcatcttcatctatttctagttcatcctggtctatataatgacctggttgacctggagctctaagtttctttccttttgggttcaaaggtacgtttagtttgggtaatttttctgtcaaggatttttccatacctaatttcatgtacttgcttctttgatatttgatctctaatccaagtatgtcgtactgaatttcgttatcaccttcacccagatttattatctttgtatcgtattgtttcttgagtgttgttatgattttcttatttgcatttaagtctttgctaaataaaatcatgtcgtcaacgaataagcaaattgttacttgactattcttaaatacgcatgaccatccgcgaacttcttgcatgtcgcaacaatttattaaatatgatttaatggtttcataccagtttgcaccactttgtttcaaaccatagagtgattttctcaaacgtagtaatttatcattcaaacctaaatgtggtggaggtcttatgtataattcttctttgatatcagcatataagtaagcagaggatatgtccagctgtgtgatataatagtcgttgtctaatgcgattgacagtgacgtcatcagtgcatagtgatgtacggtattggattgcatatcagaatcatatgtatcggggtgttgaatgtcgcctcttgcaacaaatctagctttgtgtgtaccatcacgtttcttgttaaatataaacattgagtttattacttttttaggatctatgtcatttctatcataatatttgtttgtatcccaagtgttcattttcaatagttggctaatttctttatgataagcttcaacatatctgtctttttctttgttgtctttattataagtaattgcttcatcatatcttaaggtcgttcgaactggtttgatcgatttcactccttttattgctgcaattaaatttatgcgtttcttcgatcttggtggttccagacttctcatattcttattattccatgtgtctcgggatacctcaatttcagtttcattatcttctaatgatcttttcttacttttggtagtagtcagaacattagaatcatccataccacccaaactggaattagtctgacgagagtgtatgtgtggaatatcttttgaaacatcagaagtgtccgtaggagattgatgggttaagtcaggaagtgggaggtcgtcaagaatagaatcagccgtaacattttttgaggatttgtcaggcattatattaggagtcgcatggtcagaagatcgatattctggcggatccgtatcaatggagggtgtattatcacatgcagcctttgtttctatggagatgatgggagtagtggattcactgttggacgaacggtcatctattgagggcgtactatttgtagtcctgtatttgatatttgtatcactatttcgttgaatatatggttcctccgtaccacccaaacgtgtagttttgatgttttcaagtccataattaactctatcctgtgaggtcaaatcaatcatatcgttgggactaccaggtcgcttttggtttcgtgcagtgaaggtagacgagtgtctaggtgaagtagtatctgattcaatggtaccacccatttcggtactctctttattaatgatatggggtgtacgagatcgtatagtagatggaagaatattgtattcagatatgtcggcatcaacttcttttggtgcacgtaccttttggactggttccttgtctaattgtaaagggttcaatgattgggacgagaaatcgttcactagaggatcagagtttatttcaatctccgattgatagtcatgatcagattctgtattttgatcatatgactgctccgtttcattttgttcaataaaagattggttatgggctgttaaacgattgagatcatcatcaaaagtgagtgtatcgtagtcgaactggtccaatttcgtttgcttgttttgtaatataacgtaattggtagtatctactgtcttttttaaggatggaagatagataatatagccataagagtttcgtgatggatgtaaggcgtaacctggaatgccacgaggatgtattttcgagtcgggattatggttgttaactataaccggttgaccgaaaggtagtatagtagtaatgtccagtccagctaaacctgcatgttgtcttgcagatttatcgttttttggtgagactaatgaatttctgattatagtagaaaattcgactgctgagaaccatagatgatttggtagaccactgcaatgaagcagtgtgcgacaatcgtttaataaagtacgatttaatcgttcagcgacaccgtgtgctctagaatctgccgtggttgtatagcatgcagtaatacctctgttcgtaaagaacttatgaagagttttgttagtgtactcggagccacgatccatctggataactagaacgcgagcattgaattggttcttaataaatgctaatatcgatgtaaaaacattgaggatagattcttcacgacggtcgtgtaatgggtacacccattggaatctggttttctcatctgtaaacgatataaagtaagaaggtgcacttttcggtaagtgatgtacaggaccaaatatatcggtatgcaagtactgaaaaggctcatatgattcttggtactttagtcgtgatcctttgacatgcctatgtttcgtgcttttgccgattagacagtcaggacattgatatgtgctagcgttagaccattcaatatccgattctttcaaatatgtaactgcattcttcttaagagacttctgaatacttcggaagttagcatgtccaagcattcgatgtattaacggatatggatatttatttacgcttttgcttttgttgacgttgtttattgttagctttgaaatgtgcgaaggaattaggtattttttagataaccagtaaaagtctccatgtttgactatgggagctagtactgtaccatccgatctttctaaagtgtttctggtaaagcaggcagtaatattttggttagccagctcactcaaacttaatagatcataggctatgtttggtgtgtgtagtgcttttattgatgttttggtgccgttctgaaagttgaagtgaagattaccaatggcatttataggaatgtcttgtttttgagcatcgactatgtttatttcagaattgggtgttgcatggtgtaaataatgggctgatctgacaagcgtttgcgaagctcctgaatcaataagaaggtgatcaggtagttcgtcattcgagtctattgtgcgtgttggcttagattctttctgttgctggcctaagactaagttcgttgtcatcgcttaagtattgtgatgaaacggttgattcattaatgtgatcattgttcacccttgagaatttactggatgtagcaatattgtgagcttttgctgctcttggttttgaactatttgttctatgataattacgagttgtaaccttcgtgttagtcgtgtttggagatgtgcgagaaacatttttgtattcgctgtgttgtttgtattgggacggtttatttagattcatgattttattttcgtcatatattaattgaatttcagcgaataattgggaaagtttcatgttcgttttggtacgatattgattacgtaggtatttgaagtcaccggatagacctttaagtattagttgacaggccaatctgtcgctaacattgatattgttttcttttagcctttgaatgatcgtgctgactgtaatttcaaatgtatcagcagatgtacttccgttgtactcaaggttggcaagagctatccaatcttttaattcttgattgttagtttgcattttggacacacttttacaaaggactgtaaggatgtcagaataattaatttctaaaatttgttttacccatgttggcaataaatgaaatggggcaaatgcttggaaggtattgtatatatacgcatgttcttcataagtcatttgtcttttgatttcaccctggtcatttggaataatgtcaccgagattagagttcttcaaaaatctgatgtaaaatttaacccatgtagaaaagttttcttctgatgttaaagtgtgtggtggtaagacattatttctcacctttgtcttagcttgaggtacttcagagtgttgatcctgtgaaccgattggatcaggtgaggaagtactcagcggtgggatatactgtggcagcggatagtgtgggtccggttgataatacgcaggtgacgtttgataatgtgaacacgtcatcatagatggttgttggtaatgtgcccagttagaagccatagctttgtttggggtcatcatgccgtgctgttggtactgtccattctgtggaggtggtactgaagcaggttgaggagagacatgatgatggttctctggaacagctgatgtcccaggtgttgtctcttgttgagaattaaccttagtggaatctctatcaaattccggtaaattggaagctgaaacggctaacggatcttgatttgatgggacttccttagaagtaaccgaagcataggcgctaccatgaaaagtgggtgaattttgagataattgttgggattccatttttaataaggcaataatattaggtatgtagaatgtactagaagttctcctcaaggatttaggaatccatgaaagggaatctgcaattctacacaattctataaatattattatcatcattttatatgttaatattcattgatcctattacattatcaatccttgcgtttcagcttccactaatttagatgactatttctcatcatttgcgtcatcttctaacaccgtatatgataatatactagtaacgtaaatactagttagtagatgatagttgatttttattccaacagttttatatacctctcttatttagtataagaagatcagtaattatttcttcattaatactattttttacctctaattatcaacagattcacattccaagatgagaattttaagtttatggtcccttaattctttgatatcaaagtctctcctcagagaggcattgcaagaattagcagcgccgtggcgcagtggaagcgcgcagggctcataaccctgatgtcctcggatcgaaaccgagcggcgctaatttttttacctttgatcctttatttttcttaatttccttgtcagtctgactattattgttaatacatagaatgaaatgttatttataaaaaaaaaagttttggagaaaagtaggatgataggatttgaaggtagactatgacctttgtgttaacttggacaatcgttttatcatgacatccgatcctgttaatacgaatataagtagccccactttaacggacagaaatgcagacgaatcatgggagctcttgaaaagagagtttaacacattatttagcaacctgaaaactgacagtaaagaagaaggtaatttcacagacaacaaaggagtaatcgccaagaaaccaattgttctgcaggataatgatgattcggattttacgcagaatcagggaaaagttgctactgcaaccagtacaactagtgacagaagctttaagcgaacacttggttctattgaaatgaaaaaacgttatgttaagaaaaattgccaagcaaaatttgtttttaacacgcttgaaggtaaagaagtttgttcgaaaatactacaacataccctaggcctattaagtttattgctattgacgagaaagatacgactactaaatttttcctcaaaactgcgattggtgattcaacaattgagtttatttcggtactatttgagattcggaaactttgcgatcaatttatataaaattatcaaaagatttcgctggttgagagaaatgaaaaaactacattataaagatcaatcaattttattttattttaaaaatttccggtttttcgacattattgaagctttttataatttgacagatgagttgatactgttccataagctacaatcaatgtttggtaaaaagaacacatcacatgcaaatactaatagactaatgacattcgtcaaagaacagcactatatcttatgggaagttttaaatattcttgctatcaataaaaacattgaacaatggcgacagctaataagagatgaaatttatttaagtatctataataccagtggtaatgcaataaaggaatacgagttaaagtacaaactacctaccaatgacaaagtcaatttggagttacggaaaaataatattacattggatttttataagataatactaaacttattgtctaatctaattaatattaaaggtaaaagggacaaatataactcagagctagcttacgaaataatttcagtaggttccggtgttactgaactccttaagctatggaaccgagccaaagtcacttcggctaatgaacatacaagcgctgtttgacaacagatgaccaagttcgttgcatccctctttatttcgtttttttagtttgatattatagtacttgtatatatacattttttcttctttacgtctaaagatttagttatacccactccgcttccacttgagctttttggaatgtgtagtcatttctattgatggtcaccacaccatctttcagactacatttccatctcgcctttgttcttgtgactttatcatataagcacagcattaagttctcatctggcccatcctcttcaccctccgaaattagatagtcatcgtcggaatcatctagttctgaaccgacctcatccgtatctaataatgcacttcttttttccttcttcgcttgtaattttacttgttctatctgctccttttccttgcgggttttttccacgtcctcctccttttcctcgtcgtctttcttctcactttcatcatctatgttttcgacggtagttatattggcattattaatagtaagttctatttccggttttacttcaattttaggctggctagttacgtccgcatttgtattaccactagtatttgtgttcaaggtagcacctgaattattagttgcttctaccgtattcgtattaatattggtctctccagagtgcggtatgttgttgttggaattgatatttggcaaaattagaccttcattaccggtattctcctccttaatattgaactcgctagaatttacgccgggggtagcaagattgaaatttaagtcgttctgtacaccattgatatttccttcattgaactgattgtcccatgaaaaagtagttaccttcgtctctgtgagctttttttgccaaatattttttaggtcttgtaaagtttgttcatcgatacccgcattttcaaagtcctctcttacttcatttaccacagactctacgataatctcgtacactctgctggcctctgcattcgacatgatatccaacgatgtcccttgtgtatggccttgatttgtgtgatactatcgcttttcttctttgagcttgcccccgataatatgccgtatggctttatccaccttgttatttggcttcttcatcttttcttcaactgtctcacatcatacttgacgaagctttttttcgcgttaatttatattctttatttatttatttataattcagagtgtacgatgagttcctctttaatggttcatttgaaggacactaactaaaaagagcatcattggtgtcaaggggcacccagttaaaaaaggttttgagcacatatcgtaattcatgaacgaagttcctaccactccagttaggcttattttagggcaagctcagcaacgcgagcagaattcagaaaactgttcgcaagaacgtaacccacgcacgtttaattccgaaccggattccagctttaactctcctggttcctcccagttcgtgatacatcctcatgaaccgctcgagaaggagaaagatgagaagcaggatttagaccgctcgattgattacggtaggtcatcagctcttaacaacaagaataatgccaatccattagagaatatagacataaataaaatgtttgatgacaaaaaatcagattcaggtaccaatgatgataaaggaggcgcaagtactagtgataagcatgtccttgcattgaattattcaccgatcagagttgaaatgaactcctcagagaaacgaagcgacaaaaacgtggacgtagatgaaaatgataaagaaggtagccatattaataaaaaattgaaattgcagttagaatcagtacctgatttgaaacaaagctctactaaagatatcattaatgacaaagaagaaattatgtcgtctccaatggcgattgatatgattgagaccaacataagcccaaataaattcataataaacgacggagttgaaagaaacgatagtttcaatatcaataccgacacacttaaattagaaaatgatataaatgagaaacaacaagaggaagacttcataaaatctaacagtaacaatgtggttaatattgacaatgcttataaggaaaaggaggacgaagaaaatgatataacaaattctcatataaacaggcttactcctttgtatgagacttctgcaagggagtcgaactcaaatgaagaggggaggaatgactacgatgatgacaaccaacttgatattagacatgacaattttcagattgtagcaaaaagaaacgaggagctcactgatcagatatatcacttaaatcaaatgttaaactctttgatttccaaaaatgaatcattgtcttttcaatacgagaaattgaacaaaaatcaccaactactaatagatttgacaaatgaaaagttagataaactaaatacagaaagagagagcgatattgccaaggtggaaaaattcaaaaagaggattaaggagttgaatacagaaattaaggtattgaattccaaccaaaaaatattacaagaaaaattcgatgcctcaattactgaagtaaatcatataaagggcgaacatgaaaatactgtcaacactttgcagcaaaatgagaaaattttaaatgataaaaatgtagaactggaaaatatgaaagcagaattgaaaggcaataatgataaattatccgaatatgagaccacgttaaatgacttgaattctcgcattgtgcaactgaatgataagattgaaagcacagatattgttttgaaatctaaagagaacgaactagataatttaaaattgagtttgaaggaaactttatcgatttctaaggacttcaacgactctgaccttataggacaaattaatgagctaatatctacaaaaaacaacttgcaacaaaaaatggatgatttgaataacctgaacgacgataatttgaaggtagtacaggataaattaattaaaaatgaggagacgctaaaactaaaagaagctgaaattgattcattgaatagtgaaatggacgagctaaaaaaacagatcacttcaaaagatgatgaatttaagatgtggcaaagtaaatacgaaactgtcgaagacgaagctaagatacgcaatgccgaagttacagagttgaacggagatattgaagatctaaaggaatcaaaattgcatttggaagaaacaattacggaactagaaaacaaagttcataaactagaaaatgagtgtgaactggagaaacaaaaattcgaaaaaacttcgctagaattagaaagcttacaactaaaaaatagtaacattcaggctgagcacatcaaagaattggaaaatcttcatgaaaaccttatttctcttcaaaatgaattgaagatttcatccgacaggataacaacattaacaaaagaaaatgaagtattaatggaacaaaataataataacaataatagcgttactttaagcaatgatcaaaaggatagagatgatgaaaaaattaaatcattaggaaaacaagtacaagattggaaagaaaagtatgaggccaaagaaaaagatacaaataaaaggctaaagttattagcagaagatttgtatatccagtattcatccaaacacgaacaaaaggtcaaactgttgaaaaaaggctatgaaaacaagtaccaaaataagtttgatcaattaaatttagaaaataaaactctgtcagaagaaatcgagcaattgaacaagcagctgtcttcagaaagagaagaaaagcaggagttactcaagttgttagaaaatgaaaaaaaataaacgcatttttttcttttgcattttatcttttcccttaatatgtcatgagaataaaatattaaggatataccgtaaatatacaaattcgtatcgaatatttgatattgtttcctaacttttctgtgttaaaaataaatatgcaaaaacatactaaccataaaaataaataaaatacaagatataaataaataatccagcaagcaaagacattgcggtccatgccataattgttttcttccaactattagatttcagtgtgcattatttcatgtttcttttcttcaaaacgttctcaataaatgcttcaccagccttatatgacgatcttactaggggtccagatgcacaatacaagaatcccatctctaaagctctctctttccagtagtcaaacttttcgggtttcacatattctacgactttcatatgtctcttggttggcctcatatattgaccaaatgtaacaacatcacattgaatattgcgcaaatccttcaaagtttgagtaatttgctcatcagtttctcctagacccagcattattgatgttttagtaatcagtgacggaaccgtagcttttgccctttctaaaacactcaaagactgtctataagtagctcttctgtctctgacatgtggtgttagtgattcaactgtttccaaattatgtgcgtaaacatcaagcccacattgtgccataatgtccaccatcttcaaatcacctctgaaatcaccagaaagagtctctacaagagtatttggtgccttctgtttgattttgcgaaccgtctcggccaggtgattagcaccaccatcgactaaatcgtccctatcaacggtagttaaaacaacataacccaacccccatcttttgatagcttcggcagtattttcgggctccattgggtccggcttactaggcgttctattggtcttcacagaacaaaacctacatccacgagtgcaagtatcaccaagcagcataattgttgccgttgccttagatttatctttgcctccccaacattcaccaatattgggacatcttgcctcctcacaaacagtactcaggcctaattcttttacgtcgcctttcaatttatggtaattggtacccttaggaataggaaccttaagccaacgaggtagttttttagcttcctctgtattttgccttgccttctccagagggtccaagatcattttcgaagctttacctgaaacaaaatctgcaaaagatggacccaaattaagagcatctttgaactctgtaattctttttctgttccccttgcgtctttttcccgaagtccctgttaactgactggttgcattttcaacctcagttgaatttccaactggtaccctaacgctagcgttatctgaatcagtattcaatgcattggatcttattggccgagttgcgctcgttccacacctaatagtggacgaaatccatcttgtatttctcccaacaaatagtactccaacagatcgtctatacattattgtggcttaacagttctccttaaaatccacataactgacaaaactggatacttaatgcccatcgagtcatatacatatatttgattactacaagtgcttttcaaataactgcttcgagaaaagcgtccgggtaataacaactattgaaaaagcatggcttcgcattaataggagccaaaaatatgaagatgagcctcgaagtttatctaaactaccaccaaagaagaccgactagatttacaatcatgtatccaggtagtggacgttacacctacaacaacgctggtggtaataatggctaccaacggcccatggctcctccacctaaccagcagtatggacagcaatatggtcagcaatatgaacagcagtatggacagcaatatgggcaacaaaatgatcagcaattcagtcagcaatatgctccaccaccaggtcctccccctatggcttataacaggcctgtgtatcccccccctcaattccagcaggaacaggcaaaggcacaattaagcaacggctacaacaatcctaatgtaaacgcatccaatatgtacggtccaccccagaatatgtcattacctccacctcaaacacaaactattcaaggtacagaccaaccttatcagtattctcaatgtactgggcgtagaaaggctttgattatcggtataaactacataggttcaaaaaatcaactgcgtggttgtatcaatgatgctcataacatcttcaactttttgactaatgggtacggttacagttcagatgacattgtcatattaactgatgatcagaacgatttggtcagggttcccactagggctaatatgattagggccatgcaatggttggtcaaggatgcgcaacccaatgattctttgttccttcattattctggacatggtggccaaactgaagatttggatggggacgaagaagatgggatggatgatgttatatatccggtcgatttcgaaactcaagggccaattatcgacgatgaaatgcacgatataatggtgaagcccttacaacaaggtgttagactaacagcattgtttgactcttgtcattcgggtacagtgttggatcttccatatacctattctactaagggtattattaaggagcccaatatttggaaggatgttggccaagatggcctgcaagcagctatttcatatgccacaggaaacagggctgctttgattggttctttaggttctatattcaagaccgttaagggaggtatgggcaataatgtggatagagaacgcgtgagacagatcaaattctcagcagcagatgttgttatgttatcaggttcgaaggataatcaaacttctgcagatgctgtcgaagatgggcaaaatacaggtgcaatgtcccacgccttcatcaaggttatgactttacaaccacagcaatcatatttatctcttttacagaacatgaggaaagaattggctggtaagtattctcaaaaaccacaattatcatcgtcacaccctattgacgtaaatctgcaatttattatgtagaaatatatgaatgtgtacgttggtagatgtattcagactggtgtagtatgtgattcaatttttatttttttagaaagcagaaacaatctaagctattaatactatatacatataggcaaagatatatagggaataggcattttggaaaataagaccatgtgtttttttaacgtagtgaatactaagtacagaaaaaaacatcacctcaaccaaagaaaaattaagtaatgaagaaagatcaggagaaaaatttttttctacttcaggtttaattttctttatctttttcagactcttcctgttctttcaatcttttttcttccaattccttttttacttgttgctctttgttagagtagtccaaatttaatttctcaatttccttttcgacagattcaatgttttgttttgtttgctcttcttgtttcgacaaaagctcttcatgcttcttcttcaattgctcaacggtgatcttgacatcatcactgttgattgggacagttacgtctaattcggccaaagtagcaattagtgttggttctaaagtaaacttgccatcgactttgttgaaaatagaagcaggttgctcattttcagtgttcttctgttggttcttcttcttgtatttcttagatttagatggagcaacattgacaaaatcatccttctttggagtgaccaaaaccaaatcatcagcaacaacttttctggcaggcttggtctccaaagcattgctactcaagtcaggcaggatgtttttctttggtttcacataagttgggtccaggacaagcaaagaattctcaatggcaccgatttcataagtgaaggctggaatcttggcatgagtcaacttttcttgcaatttacccatatcaacatctttctgttccaaaagtttggataatctttgttcttcttcacgtttcaaacgttctttgtccaatttggctctgaatgatttgaattcgttgtcaaagtcagctctgatctgtctgatttgactgtataattcgtcacgcttcttgtacaaggcagcacgtttgttgaataaagtttgtcttttgtcgtaaacaccttgagtttttgaatggatatcgttcaatttttgctggttctcttcgaattggttggagacatcctttggattcaatccgttcaattcttccttcaattgattgattttagccttgtcagcatcaacagactttctgattggctcgatgttaactaagtccttaatcaatttgttcaaagattgcatttctttgactagtagtttttcttgaaccaaagaaaggtcaccagaggcaatagactcttcaatctcattgattctttgcttggcttctgcagtggacgagaacttggcctttttgcctaacttctcctcaatttggttgttttttctcttgatttgagcatccaattgcttaatagagtcgtgaatgttgcttctacgggttttcaagtcagcttggatcttgatgatctccttgttcttatcctgtaacttcttacgttcttgttgggtggtatcgttgacctggtgttgatcgatttgctttctaattaaaccgatttcagtgtcgatttttttcaattgaacgttaagagtgtccaatttcttgtctctaacggagacatctgggcgcttgaacttgtgttgttgggaggacatggcaatggctgtgttgttagaaaatatgctattacgttgataaaaggaggaaaggtgaaatcagttcaaaaatgtgaatgaaactgaacgaagaaatgaccagaatgagtgaaaaatggagatggaggggcaaaatgaaaaaaaaaaaaaggatgaacctaaaatagaaaatagactccgtcgtactttaatgctatgtataacgcaaccaagcaattttcgaaactcaatttggcttataaatgttcgagataaaatgcgaattacgtgttcaacgtcgtcgagatcagttattttttttcaccgccacagtgcgggtaagcaatttttcgcgtaccaccaccattacacatgtataatgtatataggcttattatgtatgtttgtgctactttatatgacggttatttacaagttagaatattatctattaacaatgcagtagccacgcttacgtttagtgagtcaacaatgggttctggggcccgattgcctttctcaatgccaccaaagggaatttcgacgaagaagtcactcctcatcttcaaattcgttcttacgccctggctttcgttccccaccactagaacaacaggcagctcgttacataatccgttcaaatcgtgcatgctaatagtttttccaacagtgtatttttctgacgtggcattagctaagtggcttgtaataaacgtccagccacccatttcttgtgatttagtaaaaaactctaacggtttatcaacgtaaaatatgggcagaagttcgagggccccactgcttgtcttggacaccacaggcgtcaaaggagagcagtttcttctcgacatcacaatgaagtcaacccccaggaagtaagcgcttctaataatggcaccgatattgtgagggtcagttatttcatccagatataacccgagaggaaacttcttagcgtctgttttcgtaccataaggcagttcatgaggtatattttcgttattgaagcccagctcgtgaatgcttaatgctgctgaactggtgtccatgtcgcctaggtacgcaatctccacaggctgcaaaggttttgtctcaagagcaatgttattgtgcaccccgtaattggtcaacaagtttaatctgtgcttgtccaccagctctgtcgtaaccttcagttcatcgactatctgaagaaatttactaggaatagtgccatggtacagcaaccgagaatggcaatttctactcgggttcagcaacgctgcataaacgctgttggtgccgtagacatattcgaagataggattatcattcataagtttcagagcaatgtccttattctggaacttggatttatggctcttttggtttaatttcgcctgattcttgatctcctttagcttctcgacgtgggcctttttcttgccatatggatccgctgcacggtcctgttccctagcatgtacgtgagcgtatttccttttaaaccacgacgctttgtcttcattcaacgtttcccattgtttttttctactattgctttgctgtgggaaaaacttatcgaaagatgacgactttttcttaattctcgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgagaaaaaaaatataaaagagatggaggaacgggaaaaagttagttgtggtgataggtggcaagtggtattccgtaagaacaacaagaaaagcatttcatattatggctgaactgagcgaacaagtgcaaaatttaagcatcaacgacaacaacgagaatggttatgttcctcctcacttaagaggaaaaccaagaagtgccagaaataacagtagcaactacaataacaacaacggcggctacaacggtggccgtggcggtggcagcttctttagcaacaaccgtcgtggtggttacggcaacggtggtttcttcggtggaaacaacggtggcagcagatctaacggccgttctggtggtagatggatcgatggcaaacatgtcccagctccaagaaacgaaaaggccgagatcgccatatttggtgtccccgaggatccaaatttccaatcttctggtattaacttcgataactacgatgatattccagtggacgcctctggtaaggatgttcctgaaccaatcacagaatttacctcacctccattggacggattgttattggaaaacatcaaattggcccgtttcaccaagccaacacctgtgcaaaaatactccgtccctatcgttgccaacggcagagatttgatggcctgtgcgcagaccggttctggtaagactggtgggtttttattcccagtgttgtccgaatcatttaagactggaccatctcctcaaccagagtctcaaggctccttttaccaaagaaaggcctacccaactgctgtcattatggctccaactagagagttggccacccaaattttcgatgaagccaagaaatttacttatagatcctgggtcaaggcctgcgtcgtctacggtggttctccaattggtaaccaactaagagaaattgaacgtggttgcgatcttttagtcgctactccaggtcgtttgaatgacttgttggaacgtggtaaaatttctttggccaacgtcaagtatttggttctagatgaagctgatagaatgttggatatgggtttcgaacctcaaattagacatattgtcgaagactgtgatatgactcctgttggtgaaagacaaactctgatgttctcagctacttttcccgctgatatccaacatttggcccgtgatttcttaagtgactacatctttttgtctgttggtagagtcggttctacttcagaaaacattactcaaaaagtcttatacgttgaaaatcaagataagaagtcagccttattggatctattgtctgcatccactgacggtttgactttgatctttgtcgaaactaagagaatggcagatcaattgaccgatttcctgatcatgcaaaactttagagctaccgccattcatggtgaccgtacccaatctgagagagaacgtgccttggccgccttcagatctggtgccgctactttattggttgccacagctgtcgcagctagaggtctagatattccaaacgtcacccacgttatcaactacgatttaccaagtgatgtcgatgattacgtccatagaattggtagaactggtcgtgccggtaacaccggtcttgccactgcctttttcaacagtgaaaacagtaacattgttaaaggtttgcatgaaattttgactgaagctaaccaagaagtcccatcattcttgaaggacgctatgatgagtgctccaggtagcagaagcaacagccgtagaggcggtttcggtcgcaacaacaacagagattaccgtaaggccggaggcgctagcgcaggcggctggggctcttcaagaagcagagataactctttcagaggcggtagtggctggggtagcgattccaagtcttctggctggggtaacagcggtggttcaaacaactcttcttggtggtgatttcagacaaactagggtgaggattcttcgttttctgctctagcatgtcttatattttctttctccaatcactttttttatccaagtcctgaaaatactgtgttgtttgtttctctctagccgttgattggccccatattttttttattttctcactgggagccactaatctgttactttttttccactcttattttttatccatcgtttttttgttttttttttctttcatggttctaatattattttacaattgtactataaaatgcctttgctaatattaactaaaaaactaaagatttcactatgattataagcaattaagattttcatcttttagtgaaaagatgaaggaattattatctacttttactatattttccactatttttgcttaattgctttaaccgatctattcattggactgattatttacattatcttttatttccacttccactttttcagttttcttcgaatagagactttattttgaacagttttttcgaccttttttgtttgttattgtttctttttaccttacgaaaatattcttactgttcacagtaccattgtataatagtattcatttccttcctacattttctctcccttttttgagttgaggcctttttattgactcgccttatactctactttatttgtgttttgtagatagaataaacatcaacagtataattcataatactttctattgcttatttcctgtatattcgtttttgaatatactttgttcccaactttctttttagtttacttacattcatatttacatgtgcgttactacttattggtgcaaccaagtgaacagcgagtcttaccattggtagtaccaatagggattcttttttttttctaggtgttgaaccaaatcataaggatcatcgtcgacaaatcttctagcagataaatctttctcggttttttctaaatacgacttcttcactgcgttcaaagtatcagcttcatccggggccatctcatacagggaactgatgatcggtctatctctgggacagcttgactctttaccatttgtttcaatgtaacgctggtagccagactcaatcaagttttctagcggttcccttatacctacttggatacccctaggtatccatatctcatgtagtcctttgaactcatacctcccagttgtccttaataaaatatatcctatatctttcagaacgatctctatacttccaataaatggaggtattgcgtaccttttgtactggcttttttcgcatataacgcttttaattccacaataccgtgataacggatgtgtgccagatgatgaattgcacgagttgaatacatcaatacctttttcaatgttcttgaatgtttttgatggtcctggtatgtatttcacaatctgatttatggatcctttcggaggtaccaggtagaaaatccctcccacggtataacagcctccctgtgatgtgcccttcatagactcataagtcttctgttttatatgcttccgattgaataaatcggtttttcgcagcctttgaagccaacgctcgtcgattagttcttctaggcgtaatctggaggtggaagttgaatagcctggaagatcaaaaagtattttacctccaacttggtaggcttgtacggatctagttaaattgggaatatgtgatacaccagcagcttgaatcttgaaaaaattcttcgggttcgtaaaagcttcttgcatcacttcttcagagggggagttaattttcccagtagaatcaattttaaccttatatccaagatatttctgtagtagagtattgatcaaagttgatttaccaacattagggttgcctagcaaatatgtgtagtttttaaagtagttgtaaaacatggatatgttccagtttttcagcgcagatatggcgaatgttttatttgagtcaattcttaaagtgttctttaaaaattgcttcatgaatataggaacctttttgctgacagcatttttatctttaaaaacttgatcgcttttcgttaacactaatgtagtatctaaatcatttcgtttcaaaacattggggtctaaatgtaagggaaattctacaaaggggacaatatgcataacatttgagcctctggggacgtagttcagaatatcatttaatgtgctttcgggaaactcttccgggttataattgttatgatgaagggcattactgcaccttttgcaaatcactctcaatagtaaatctcttttggttttgaggtcaggatcattttgagttgcctgtttcgagagctgtatgtcttgactgaatagcaaatacttcagatcttggaggtcaggatttagttttgagtcgggtagactttttggcttcgtataatatcctggtttactaggatcctgatcctgtagttttatggaacatgacgcacatttcactttcacaatcacagaacaggaaaactgacgtacgcctcgaagagcatgacacagattcaacattcccgcatattgaattgttcaaagtaattagacgtgttactaggaaggtccttcgttaatattgctctgttaaatgtatcttgacccataacatcaaatagtagttatcatcttcgacgagttttgaaaaattttctgaattttttcttccgatgagatgagcatgatatttacagagaaaatagagaaacagaatacttgtacatgggtaaattcatttatactaatttttgaattgtaagagagatagagaaggtcaacaatagaataagtggagatgggtaaagtttctaaatcgaccaagaagtttcaatcgaagcatttgaagcatactctagaccaaagaagaaaggaaaagatccaaaagaagagaatccaaggccgtcgtggcaacaaaactgatcaggaaaaggccgatgctgctggtactagggaacaacagcagttgaaaaaatctgcaaaggaagaggtttttaaggacatgtctgtcgaaactttttttgaaaagggcatcgaaattccaaaagagaataaaaaattgaagaaaaaaactacgaaagagcaatctgatgaagattcctcctcttccgaagaggaggaagacatgggacaaagcatggcaaagttggccgaaaaggatcccgaattttataagtatttggaggaaaatgataaagatttattggacttcgcaggtaccaatccattggatggaattgatagtcaagatgaaggtgaagatgctgaaagaaacagtaatattgaagaaaaatctgaacaaatggagctggaaaaggaaaaaattgagctttctttgaaattggttaggaaatggaaaaaacaacttcatgattctccaagcttaaaattactaaggaacataatcagtgctttcaaggttgctgtaaatttgaacaaggaagaaaacatcgaagactataaatatgctatcactgatgagaaagcattccacgaattgatgttcatggtcttgaaagatgtaccacaagcgattcaaaagatggccccatacaagattgtaaaaggcgcaaggaccttaccaaatggaggtaacgtctccagggtctcgtccattgtcaagtcgcatgctggctctttgttgattttattgaatgatattactaatacggaaacagcagcattagttcttcattctgtcaacgaattgatgccttatcttttatcatacagaaggatcttaaaggagcttattaaatcaattgttggagtatggtctacaacgagagaattagaaacccagattgcttcttttgcctttttgatcaataccaccaaagagttcaagaagtctatgctagaaacaaccttaaaaacaacgtactccacttttatcaaaagttgtcgtaaaacgaatatgcgttctatgccactgattaattttcaaaaaaattcggcagctgaattgttcggtatcgatgaagttctaggttaccaagttggatttgagtatattaggcaattggcaattcatttaagaaatacaatgaacgcgacaactaaaaaatccagtaaaattaattccgcagaagcttacaagattgtatacaactggcaattctgtcactccttggatttctggtctcgtgtactatcgtttgcttgtcaaccagaaaaggaaaatggcagtgaatctcctttacgacaattaatttacccattggttcaggttactttgggtgtaatcagattaatcccaacaccacaattcttcccattaagattttatttgattaaatcacttattagactttctcaaaatagtggtgtttttattccaatatatcctttactttctgaaattttaacctcaacggctttcactaaggcacccaaaaagagccctaacttggctgctttcgattttgagcacaacatcaaatgtacgcaagcttatctgaatacaaaaatataccaagagggtttgtcagaacagtttgtggacttattgggcgattattttgctctgtactgtaaaaacattgcatttcctgaacttgtaacaccggttattatctctttacgccgttacatcaagacttcaactaatgtcaaacttaacaaacgtttatcaactgttgtagaaaaattgaaccaaaacagcacattcatccaagaaaagagatcagatgttgaatttgggccaacaaacaaatctgaagtttcaagatttttgaatgatgtagcttggaataaaacacctttaggttcttatgttgcagtacaacgtgaagttaaggaagaaaaggccagattaatgagagaaagtatggaagaacaagacaaagaaagagaaacagaagaagcaaaattattaaacagtctggaaagtgatgatgacaacgaagatgttgaaatgtcagacgcttaacaactcagcaagatttgattttttgtcttgaattcaatagttaagtctataaatgtgtaaaataaagaaaagtcttttttaaagcgtatatatcattgtgctcacatgtgctaacatgtgagcactccaagctttctcttgtcagctggatatttttatattttggccggtttatggatagaaaacacgtcaaacgttcgatggatcttataaaaagtaatgatgtaaagcaaggtacaaaaatgaaagaagtacggtttactgttatataattttcgaaatcgttcaactctcttaaagttcctcacgaaatagatatgattgctaacataacgcaaaatttagtacaagatatatgatttcttactgctggaagatatcttccaatcttaatcttggggctatgttcatggataataattcctggaataacagttttgctgcatatggaatagtcatcttaataatattctcagcacttttgcaggtagtacaccaaccactatagcccattaatccacatttatcgcagacatcaacttcaaaagcatctgaactaatcatcaacctttctaacagcaattgtgaagcaccatacgcgattacacaatccctctccatctcacccaacctcagaccaccatctctagatctaccctcagttggttgacgtgtcaaaacagcccttggaccacgagctcttgcatgcatcttatctaagaccatatgctttaacttttgatagtaaatggggccaaaaaagatgtaagcctgtaaacactcacctgttatacctgaatataacatatccttaccggaatagttgaaaccttggtctaccaaaatcttagacatatcttcaagtttagaaccaccaaaacaagtaccatattccaatgtaccattcaatacaccagctttacccgatatcagttcgatcattttacccacagtcatacgagatggaaaaccgtgagggttcatgataatgtctggaactataccttgatcgttgaagggcatgtcttcttgctttacaataataccacaaacacctttttgaccatgtctagaagaaaatttgtcacctaattctggccttctgttttgtcttagcaaaactttgattaaagcttgatcgttatccgaaacagacatcataacttggtcaatgtgagaaggttctggacctctatatattaccggagcttccctatattgagtttggacgtttacgttgtttgggtttggggcgtctgctgagttagttggaactgacttatttatataaatttgtccactttggaccttcatacccacctcacctagaccatcaggaccaagagattgatgttgccagataggatctccattttcatcaactctcataccaccgatgatatcttgggtatggttcgcatatcttttcaaaacagtggttgtctttctacgtgtttcgcaacggccgaaacctctatcgatggatgacttattcaaaaccaaagcatcttcaatatcataaccagaataggacatgacagcaaccgtagcattttgaccagcaggtaatttatcataatcgatcaattcaattgttttggttttcaccattggctgttgtggataagtcatcaagtataataatgtatctattctcttgaattgattgtaggcgattgcaccaatcgcttgcttacccatcgcacattgatatgtgttacgaggggattggttatgatgtggatatggaattaaaccagcaacagcacctaaaattgtgaatggctcgatttctaaatgtgtcatcgagggaactatatctttttcatacaatgcaatgtaagaatcgttttcttcattgacatctaaatattccaccaatccgagtttcaaaaaatcatcgaaatctaactcaccatctaataatttgcgtaaatgaatatctttcacgcgagattgaccatcagaaacaatgattaatggcctacaaattctaccaccatctgttgcaatatgaactgccatttggtgagaatttgaataaattgagataaactccgacactttacctgttcttctcagatgtctgaactgagtaacgaattttgttgggaatctgattgaaccaattaaagtaccattcaaataaacaccatagtttaaatgcaaggatgcactgtcaatcaatgttatgtcttctacaccaagaacataacataatttctttataggttcctcttcgtcatctgtagtaatatgagtcattaatgctaaatttttcactagaccacacgcctcaccttctggagtatctgcagtacaaagcataccaaattgagaaggttgtaatgctcttggaccggaaacttttcttgatttttcaaactgagaagaaattcttgtcatcatacccaatgcggaaatataagatagtctggaaagaacatgtgtaacacccgctctttccatcttaaatcttttaagagaccaattaccggttgagatagctctgttcagtccgctggtgatgttatttgaatggacgttaattgacaataatgcatcgtattccatagccctatttggttttttcaagaccttatcaatgcttagtttaaaatcattattaaactttttgaacaaatcttcgaacaataaagaaatcaattggcctgctaattcaagacgtttattaccaacataatctctatcatcaatcatcttagggttatacattgccatcaccaccctgcgcgtcatcatggcaatatataaagccttttctctaaagtcaagggcttccacagtcaaatgtgcaataaccgtggtagcaatggcctctataccctcttgcaggatagtcagtttttgccttctcattgtctttacttttgcaccaatatactctaaagcttgctgttgtgtgtaaatatctaatttcgaagattcttccaaattgactgcaaaaatatcttggtagctactatcattaccgcaaaccaattgcataatttctaaatctgataaaataccacaggctttgagaacaatagcaataggaatttcttcagcgatggaattgtgcttcaaatagatcttgccatttttggtaatgacataagtcttagattttctttcatgggtagatgaagtaacggaggcctgaacaatgcctttcttctcatctgcctccacaataatacgattcttggataattgttcttgaacaagaattactttttcggtaccgttaacaataaagtaaccaccaggatccaacggacactcgtttaatttagccattttcgattcatcagcatcatataggatacatttattagatctcagcatgatcggcatcctaccaatttccacgtctttatgcataataatgtttctacctctagtgtattctatatccacgtagattggtgcagagtatgtcatatctctaagcctacactcatgaggcggagtcaaataatcttttgtcgaagaagaggacttcttacccactctaatatcgacgtacttcaggtagaattctggatcaacatcactcaaaattaattgatttgcctttataattttttttaaatctgtatcaacgaagtagttaaatgagtcaagatgttgcttcaccaaacctttaaccttcaagaatgctggtaaaaggtgccacttatcctgagcagtattgatttcatcagttagtttcttacctttatatactggtttcaataaatcatcaaaagcctcgtctttcacatgcttatgtatatgagttttccgtctttttgtcgcagcaaccatttttcaacaagcactaagtccctagcgattaaaacgctcaattatcaacactttaaactccctttaattctttcctaacttgtccatatatcatcacttaagcatagatcgaaaaattttcagctcatctcacaattacaatttcgtccgacgtgatctggaaaatacgcgcctgctttatggaactatttatatctttatgtgtagtacacctaacaataaggaatatataaaaataatgcacctattaaaacctttgggaagtgccaactttgaatcatcatctttctttgaacaccgcgctgcgacctttgacaagaaagacgagatcactcaacctgacagacccgattcccctggttcccctcttccgctttgcacagcccttttcgcttagtttggaagcctaggtccgatccccagtgctattaatagtttacaataaaataggatcgacgttgctattgatggatcgcatagcacagcaatatcgtaatggcaaaagagacaataacggcaatagaatggcttcttccgctatatcggaaaagggccacatacaagtcaatcaaactagaacacctggtcaaatgcccgtctatagaggtgaaactataaatctgtctaaccttccccaaaatcaaattaaaccgtgcaaagatttggacgacgttaacatacggcggaacaactctaataggcattctaaaatacttttactagatctgtgcgctggccccaataccaactcatttttaggcaataccaatgctaaggatatcacagttttatcgttgccgctacccagcactttggtgaaaaggtcgaactacccgttcgagaacttactaaagaattaccttggatctgatgaaaagtatattgagttcacaaagatcatcaaagattatgatattttcattttcagtgattcgtttagcagaatttcgagttgtttaaagacaactttttgcctcattgagaagtttaaaaagttcatctgccatttttttccatctccttatttgaaattctttcttctcgaaggctctctgaatgatagcaaggccccctcattaggaaaaaataagaaaaattgcatcttgcccaaattggatttgaacttgaatgtaaacttaacttcaaggtcaactttaaatttaagaataaacatacctccacccaatgattcaaataaaatatttttacagtctctgaaaaaggatctaattcattattctcctaattctttgcaaaagtttttccaattcaatatgcctgctgacttagcacctaacgacacgattttaccgaattggctaaaattctgctccgtaaaagaaaatgaaaaggtaatattaaagaaactctttaacaattttgaaactttagaaaattttgaaatgcaaagattagagaaatgcctgaaattcaagaaaaagcctttacatcaaaagcagctatcacaaaagcagaggggtccgcaatccacggatgattcaaaattatattctttaactagtttgcaacgacagtataaaagttctttgaaaagcaacatacagaaaaatcaaaagctaaaattaattataccaaaaaacaacacatcttcttcgccatcaccattatcttccgatgatactataatgtcaccaataaatgattacgaacttactgaaggaattcagtcttttactaagaatagatattctaatatcttaccttacgaacattcaagagtaaagttacctcactccccgaaaccacctgcagtttctgaagcatccacaaccgaaactaaaacagataagtcatatccgatgtgtcccgtagatgcaaaaaaccactcctgcaaaccgaacgactatatcaatgcgaactatttgaagctcacgcaaattaatcctgatttcaagtatattgctacccaagctccgcttccttctacgatggatgatttttggaaggttattactttaaataaagttaaagtaataatatcattgaattctgacgatgaattgaatttaagaaaatgggatatttactggaataatctgtcatattccaaccacactatcaaacttcagaacacctgggagaatatttgcaatattaatggctgtgttctcagagtctttcaagtcaagaaaacagctccacaaaatgataatatcagtcaagattgtgaccttccgcataatggtgaccttacttccattaccatggctgtatccgagccgtttattgtttaccaattacaatacaagaattggttagattcatgcggcgtagatatgaatgacatcattaaactacacaaagtcaaaaattcgttattgtttaacccgcaaagttttattacaagcctcgaaaaggatgtttgcaagcctgatttgatagatgataataatagtgagttacatctcgatacagcaaattcatcgccactattagtccattgttctgcagggtgtggaagaacaggtgttttcgttaccttggatttcctactaagtattctttcacctacaacaaatcactcaaacaagattgatgtttggaatatgactcaggaccttatctttatcatagtgaatgaattaagaaagcaaaggatttcaatggtacagaatctaactcaatatatcgcttgttatgaggcattattaaattattttgccctgcaaaagcagataaagaacgcgttaccttgttaatagaattgtttttctcctattatacaaacacttttcgttttgataaattacataacctctcgttgcattttatttcattatatagatacattaaaaataaaaaaaaataaatctacaattaacaatctcctcataaagaaacacgggtttttttacgtactcgcaacttcatataatgttttatttttgcgatatcagctgcatatctatatgtcatatttataaaatcgcagagatgtcagtacccataactgaataattaggtccatctgtgcgcttcgttatcaccactccaacttcgttcagtatatcccaattcctctttcactctcttcacagtggcaggatctcccatatttttacctaagttatcagaaattttgatagcgtgattaccatttacttctaatagtttgataacgatgtttaacggctcacttttaacctggggttctgacttcttacgaaaatcattagtaaagtttgtgccaataccgaatgtggctagcattccattctctttagctgcatgggagtaagttattgccttttcgacgttcaaagaatcggaataacagataatcttcgagaatttaggcaatttcaacacgtcatggtaatggtgggaaatctttttggtatactcaactgggtctccagaatcttgtctaacaccgacgtaagcatcagaatatggtggacggaatgattttaaaaagtcatcagttccaaaagtatccgttaatgctaaaccagcattttttgcaccaaaagtattgatccaacaatccattgcatttttattggcatgcaaataatcttcactaatagaagcgactcccataacccactcgtgagccacagtaccgattggcttgactccatatttcttggcaaataaaatatttgatgtgcctaataatagcgatttgtttctgtctgggttaccgttcacagctttcatgattccttgcataattagatcttgagccttcagagatctacgacgtcttgtaccaaattcactgaatctaataccattatcaaacaaagtttccgccttcttctcagcttgttctaattggttttcgtagtcccagtcgatgtcaacaaatttaaaatacgcttctgatattagggacagtaaggggatctcataaaggatagtatccttccaactaccactgactaaaattttcaatttgtagtgggtgggcttgccctcgatttcttctgaagtgaaggaaatctgctcttcagggtgtagtttgtaattagaactgctaatatacttaatatatgccgatggcaaatatgggatttcctgttttaagtattcaatttcctcttctgtgaacctcaaatttcccaaatacgaaaattgctctttcaaccaattaatggcttccttattgaaggtcaattgggacgacctgttggtatatttataagtaactgtaacatctggaaaattagtgaagacagcagcatgcatcgtaatcttgtacatgtctgtgtccaaaagagactttatcactggttctgacatggttatcttgcttggcgaaaataggtacaaaaggctaaatccacctttcttctaaaatattatctaccgtttgtttccttacagtgacgaattgaaacaaaaaaactgatgggatccaatttacgtttcgataactgttgaaaggctcgtcattttggttagtcaaagacaacaattctttcatttgcgagtttttccagtcttataagaacggatctgacgaatttttcacccaggcgcagcagccatttttgttgatattttgacgaatttacaacgtaaaaaagtaagatgaagggttcatatatgcaaaagcagacctgataaatcttttcatattcttgaggtttttaagcccaaaataagctactatcagcactccgatggctactacactggaagtgtcagcaattgagaacacaaagatcacgttgaacgaaaagtaatttctcactcgttgtatttggtaaaaaaaatttcataagaaaaaaaaaaagaaacattgaataaaatcacaatgggatgatagttaaagtgtattcaaactgtagagtgtagaacgtaaacctcaataagcaaaataataatacaaaatgattgtcccagtcagatgtttctcatgcggtaaagttgttggtgacaagtgggaaagctacttaaacttgttgcaagaagatgagttggatgaaggtactgcattgtcaagattaggtctaaaaagatactgctgtagaagaatgattctaacccacgtcgatcttattgaaaagtttttaagatacaacccattagaaaaaagagattaagtgttcctcaatatggctgtttttgaacttttcttttccttgatggatgaaaaaaaaaagatgagagcggtcatgaatatagaaacgataaccatttattctcacacactaaaagaactacacgacaaccagatgtgtctctgcatactgtaggaataccattctcttccaaaataatagaaaataatatatatatatcttttgtttactcttcaagacgataaaggaagtatgtagatgttacatcgtgcgatataagagacttgtatactataagaaagagcttagatgaagggtatgcctttattttttcagaaaaatacaccctagtaattatataacggtaaaaaatgctatttacaaattctctaatgacactatttattttacatcataaatttttggagacgcccttgtagcttttcttgaaaaccaagattgaatctattttctccaaggctaattctaacagctcctttctcttttgcaattcaatatgccttgaaatcttcggatcttccttagcaaacatttccacttgttcatctcccaacaatgttaaccttctgtctaattcaatagggaagttataaaaaaaatcgcttaataattcaacgttaaggaataaaacagctgtggaggtcaatttatcactaactgcagatagaaatacctctggacaacgatccttctcaattgtcgaatgacatttgtttttcaacatttttaatctgaacgataacactttgcaccttttatccaggaaaatagcttcagagcctctttccaatagtaatttggacatgccgagtgtttctttttgcaaatttgattcattttctaaatagcccattacatttgctaatttcttactgccaacggcatttttgattgcctggtaccttgagttacattgacgtaattcttcctttattaaattaatggaatgttgacgagcaaggctccagtctctttcttccaaatcaatttcatacttgaagggtttgatacagttctcaacttgatcagccgttgaatagtatttactgtttagaacgttaatggctgtattgctaacaaggtctttgatcagttcatggttttttagttgagtagactccagaatgttatctagctcctttaaaattgcattggtagtaagcattgtagataatctaccaatgcccattttagttaagccggatgatgcgagttccaattttttatgccaatatagcatatcggtatcactttccagcttagaggaagatagatcctgaagattatcatccttccaataccgtgtagccaaaacatctaaaactttctgatccaattctgctctcaagattgatttcagttcatttctatgaaatttttcctgaaactctttaatacccaactttagtacatctatattattcaaaaggtatgatttaggagttagatgcctgtcgttaaactctactttaaacaaataagaagtatcatccaactcttgttgaataagtgttgaagtcggctccagcgcatttgacatggaaatctccaagattttgatcaacttttctctcaatttcttagtggaaacttggcaattggtaaaatactttttgttttctttgaaataagctttttcaaattgatgagacacaatttgttttaaaccattggtattttcttctccgctactttggccgtgctggccttttgaaaatatcccacttaatgacgaagaaggtgcttcaccgaaaagacctaggtgttttctgtttatactacttggtgtcttagtaatcactcctacatagcccatactgagaggatattttttattattcaagatgcttcttgctttttcaggatccaccaaatccagtttggtaatgacacctatcgttctcaagcctttaggatctgccgctttagaagctttcaaagcagaactattagccaggtcaacatccgcagcagaaattgctaaaataatattaggtgcagtcaaatatttttcgcagaggtcacggatttttgttttcagttctattggctggtctgccgcttccacttgtatatagccaggtagatccaccaatgataaatctggaacgcgggacgatttgattgtcaattgaataggctcctctgaaacagcctctgaagtcggaacggccatgttcagttccattagcattcttttcacctctttaaagtccttgatattgtatagacgcatgcttggaaaatcagctgttacattattcgagttaggtgtattgaccaaagtcaattcaatgggtcttcttgtgaccatgttggaaccttttggtaagaattccctcccaacaatggattctagtactgaggatttaccagacgattgtgaacctatcacgacaatagatggtaaagttaaatgtgcagaagaagagtccactttattcaaaatagttctaatttcaatcatttgtttggttaagtttaacatttcgtcttgcgttgtatctacagaatcgttttcatcatcctcgtcatcatcatcttcgtcgtcatcatctttaggatctccttgcctcttactttcgtcatcgtcgagtgatgtagcggctattagagtagcagttggcaccgttccatcgtttccatgaccaccgtcttgtgacttatcaccggaaaacattttattaaacttttccttcatcgattcacctaaatccttgattcgatctagtttgtccttagtaaaagagctagcttcttccatcttataagctatataactccctgcagcagccatcccgccacccacatatatgggtaacctaataattttagatataattttaggaaaatgtgatatcgatctcctggtgataacaaaactcaaagcattggcatgtgctgatctgtgaacattgctcatgcggctgtgtaagtgcaccaacggacttttgatgtaaggagagctatatagtatcgccggatgcgtagcaagctgtcttctcagaattaaaagccgtactgggctcgcattcatccttactaatgtgttatagttcgccactcttgggatggcccttaatgaagtagaattactcatgctttcagagtattatggtgaatatgcgaggctatattataagtacgaaaagaatggaaaagcctaagaataaaatgatatctgtactacccaaaaagaggctttttcgtgttctcccgttaactggtgtgaaccttcctagctgattatgtcttgcctttcaatagaacgctactattttgtttttaacggtacaaggaaatattaacaacttgcatattgatcatcgaatacgaagcgctgaatgagggttaatttcatagtaaatctttcatggacagaaatatttgaaatatatttcctcaaagagtacactagatccattcatattttaggcttcctatggaaaccgttttttcaaggataaaccccgccatatgttctttgcgaagtcttttgcagttaaaactaattacaactctgttatttactgacacctgcgttaaaattttatcacaatatgtcatccgctgagagagatgtactatttataattacttaagagcgactacttcatttaccattagcgagcagaagaacagcttacttgtcgatgttcttctctggctaaatgaaatgtcaattattgagattgagatgggtatgtatgatcggattttgatatcagccgatgagacgaagattcaatagcttcaaccgtccctgcggggggtacttaccttttgtaaccagtaccctgtgcaaattctcggcgtgtactacctcttttgggaccacaaccctttgtacgcactttcgtcagatgcaaatttttacacgcgttgaaaaatgtttcaggaagagatactgcgtaaaaaaaagacacatgtgttacgcaggaaaaagtttgtgaggctttttgccttaacagattgacttgtagccctgttaggtttacccaacagttgtttttctgtgtgtcgaaaattttttcagattgttttcaactgacacttgcctgtttcatattagttgtaacttaaactttcaaacataaaacttttttggaagtccatccttcacatgacttgaatcccttcaatatcgaaacagtatcctcaaaatctcttatcacttttctaattgttttcttcccctttttgtagtaactcgctgtaaagcacattttattcataatctcctttgtgccagaactcaaggtcaataggccagaattattggaaggaaagagggaagaaaatacgatattgctagttcattaagtcaaggaagaaaatactcaaaaaactgtacagctcaatcaggtacacattacgatggcagcacatcagatggactcgataacgtattctaataatgtcacccaacagtatatacaaccacaaagtctacaggatatctctgcagtggaggatgaaattcaaaataaaatagaggccgccagacaagagagtaaacagcttcatgctcaaataaataaagcaaaacacaagatacaagatgcaagcttattccagatggccaacaaagttacttcgttgaccaaaaataagatcaacttaaagccaaatatcgtgttgaaaggccataataataaaatctcagattttcggtggagtcgagattcaaaacgtattttgagtgcaagtcaagatggctttatgcttatatgggacagtgcttcaggtttaaaacagaacgctattccattagattctcaatgggttctttcctgcgctatttcgccatcgagtactttggtagcaagcgcaggattaaacaataactgtaccatttatagagtttcgaaagaaaacagagtagcgcaaaacgttgcgtcaattttcaaaggacatacttgctatatttctgacattgaatttacagataacgcacatatattgacagcaagtggggatatgacatgtgccttgtgggatataccgaaagcaaagagggtgagagaatattctgaccatttaggtgatgttttggcattagctattcctgaagagccaaactcagaaaattcttcgaacacattcgctagctgtggatcagacgggtatacttacatatgggatagcagatctccgtccgctgtacaaagcttttacgttaacgatagtgatattaatgcacttcgttttttcaaagacgggatgtcgattgttgcaggaagtgacaatggtgcgataaatatgtatgatttaaggtcggactgttctattgctactttttctctttttcgaggttatgaagaacgtacccctacccctacttatatggcagctaacatggagtacaataccgcgcaatcgccacaaactttaaaatcaacaagctcaagctatctagacaaccaaggcgttgtttctttagattttagtgcatctggaagattgatgtactcatgctatacagacattggttgtgttgtgtgggatgtattaaaaggagagattgttggaaaattagaaggtcatggtggcagagtcactggtgtgcgctcgagtccagatgggttagctgtatgtacaggttcatgggactcaaccatgaaaatatggtctccaggttatcaatagcttcgaattggaaatactgtgagcagtaattatcaatggatgctattatataaatatacatacctacacccatcccatatttacatagaataacaacagtaacattagttctgtggaagcgcaaaaacgtcctttaataaagtaagtcaaaacattcaacaatgaaaattcaaagcattgtcatttgcttcctttttctctttggataaacgaaacaaaaacgaacaaaagtgtcatgcactcaaaaattcttttcaatcgttttggaaacagtattattcactgacttatttgaccaacttgctagaatcatctatgttttcaggcattgtttaatttcatgatggctgtccctactttagcttgttatgagccttcactggctcgtccttatgtattgcgtctgacccaaaatttgtcctttcttgtttagtggaatttttgttcggtaatttcaaaaatgcctgaattttcattaacaaatcatctggtagttgtgttataaacataaaaaactgctcccttctgggatgattttcaattgctctctgtactgcaggatcattcaatatcatctgaaccacgtccgtcatcatatcctcatctataagcgcaaggcttttaatccagggcaaatcggctatacgaagagacatttcttcctccggagacactactttccacgggagatcaaaatatttagatagttcactattgagatgtgagaattcatgaggcacatcaacggtatagtcaactgcatatgcatcatcttcaaacgttaagtcatgttcaatgctaaactttccagcgttacctataaaaaagcattctatttttaagttaaactctccccaaccggtttccttgataaaaaatggcagcgagttcagtcgtcttttgggctgtttgaagctagagtgcaaatggtagatgcatttagagaggatggtaggctccacttcctttcctgttgcatctaacatgaggagttccatctgccaccgacgtaagggaagttcatttccccggatgttttgttccggtattataacctgttgtgtttttactctgaaagtgacttctattgaatgatccataaaagagcgtctattatatggcaccaaaaaaaaaaaaaagggcttttggagtcaagagtaaaaacaatttagtctgtagaaaaacttgagttgctgcacttcctcttcacccgaacatggctgttctagtttgttgtcgtgcaactctctaatggtgatgacttattgatgtggctttgattttttcttgcccgtgtaacgcgaccgcgccagctgtaaacgtcactaaataataccattaattggtcatttgcttatatgttatataaatgctttctctatcaaaactttgattatatgactgccgaactttaagggtgaagtaacaagtacagaccaaatagaaaagataagattcccatcgacggcattaaggaggatgatgaattttcgtatcccccaatagttgtaatatttcccggggtgattgttgggaaaatctcaacgctggtaacacccgtggataaagctaaacttgtcgtactagataaataagaaatggtgctcgttaatgttgcagtacttgtcggcatttcactattattgatgatgctcatattagttactaaaatatcttcatacgcgtaaattttcggtttcggaatctcttcaaatacctcgtctgccccgactttcttctgtatgctgtcttccataatttcatgtagaatactttcaatttgagaaaactttttgtgctccactattgttagaggatcttccaacagaaaatctataacagatttggaagcaaggaccgtatcggtatgttcttgagaatcaacagctcgcggctcctccggtaaatctgctaatactaagtatggattaaactccatttgatttagcagagctggtggtaatgagtttttatccaaatggaaaactaaaggaccaggttcattttgtcctgtttcatcttcttcatactcatctgatgtaaaagtaattgagtatttggtagcaaacacttgtgccataaaaaaggcgaagaaaagggaggatagatataatcctaacatttcaataaggatcaaaaaagagaatgggatacaaaactttactttccttcctttcgtgctagttactggcttggtgttgttctttagttatgtgtagcaatgttagctgctggttttttgtcttggataactacaaatactttcaggaaaagaataatttatacattatacaaaagcggcctcttttataaacaaagggcaaatgacagttagcaagacatatcatggttgccatgggacacaaaaacgtagccacaaaaaaaaaaaaaaaggtgaaaggaagcgagcattaattttttattttaatatgtaactgtgatatgtattaacaaagtatctttcataatttttgacgaatatttttacttcttttttactattgaaggttgggctgtgattcatcgcgcagaaaacaaggacctcatttgaaaatttccttgaattgcttaacaatgctatttttgatggcagttggagatgtcttccattctgttggcaatgacttccagtcgatttctcccatgatttccttaatttgaacttttttttcacctgcctttgttttgagggcgtccagtaatttcttcacattttgatcaatatcaagctctgaagacactggcaattggtccatatatttctttataatgtccatttcaccttgctctttggccaccagatcgtccctcttgttagcaaggaactcattgatcgagtcctttctttgagatattaacttggagtacatgtcgtacagggagtactcatcagcgctcttcccttttaaagcaatttctttgttttttatggcagataacatatttctgattgctgtcttcttcatctcatccttggcaatcatagcctttttcaaatctcctttcaataggctgactgcagccgtgtaggctggagaactgttataacgaatgaaggttagtctatttgaaacaagtggcctaattgattgtctgaacatcttggaatagtgttatttgctgtattccccaactttatcccaaagtcttttttctccagttcattacttctgtaaaaaatgttgcagatcctttttcttccctttaattttgagtccttccccccgaaaagtcccagatgccgggtagatgtgatttatatcatttatcgtttatagagtataaattgggtgatgctacactaagtacgtatgctcttctgaactagacttagtttgcccgattagtctttctcactctctttctcgaggtagttggtccaaagcgatacaaagctttccgttctcgatacagcgcttgaattcttagactcattattcgagatcaagccggcctgttgtttcttatcttcatcccagtttaagaaattggacagtaattcaagaacttcaaactttcttgggtctgctctgggtatggacacgaaagatatcaatagattggatatcagttctttatcaacggattcagaatcgcttgatttcttcaacatggccagtgcctttgttaaatgctcatttagtataatggcttcgtgacgtagttttccgatctgtaagatgtgctgcttagattcttcctcatatttttccttcatagaggcgtcctccttcatggcttctagctgttttttcatgctttctaaagcttctgtgtcattgttgtgcgtttctatctccgtgtcaagttgggatcgtaaagatttgacttcctggtctctctctctagcctcttcttcccttttgttgtcaacttcttctatcttcaattccagatcatttagagaattctttaatactgctttctccttttcatgggattccaaagcctgtctcaattcatctctttctgttctcaagtcagatatatcttgtttattattttctaagattatcatgagttcctgaacttggagatttaattgatctttttccttcctgtaagtgttaagttccttactatgtttttcaattatgtcgtgtttttcatcttccaaagcttctatccttgattcgtattccaaaaaaacctcttctgtactttcttgctccttttctaggttttctaactctgtatttagggtcacaatcgtggattgtaattcagagttttcggtcttggtagcttcaagtttcttcttcaatttcagattttgtgattcatattcagtaagctgctcctgcacttcctctaattgtttttgtgcttctttcatcttattaaaaattgatttcatagaagatatcttgctcaataatgtgtcatactgtgttttgaattcgtctctttccttaataacatttgctagttcatttttgaagtcttcattaggcgtttcttgatccttcttgtggcttagttccaattttaaacgttcaatttcttcccttagttccttcatctcatcaccagcctttttgtcctctaaaggatttatggtgtctacagtcaggccgtcatttactttttgtttgtctactccttcagagagatctttcccctcatcgtccgggcttgccacgataccatcagcctctggatctgtggacatttttggaggaacggtgacgtttacagaattgatgatttcttcaggtttattgacggtttcatcaacgtcctccacatgaggatgactcttggccttcttacctgttttcttcttatttttacccattctaattaaaaaaaatgcaattgtttgaggggatcaagtggaaagtatacacaagcatctactatatagctgtttatacaagattttcttgttcttcatgaatggtctttctgtttgtttccatttttcgtatcgaaatgagcacgaaattcaaaaagaagtactgaaaaaaaaatcaacatgagaaggaacagccgatctctcagcgaaaacagtggcttcgttgaatacgctgcttgatccttacacaataaggaattgggtatctcgcagttaattttataacttcaagtcacttcataataaactaagctgaagaaaatggtcaatatttctgatttctttggtaaaaataagaaatccgtaagatcgtcaacatccagacctacgagacaggtgggttcgtctaaaccagaagttatcgacttagatactgaatctgaccaagaatcaaccaataaaacaccaaagaagatgcctgtaagtaatgtaattgatgtatcagagacacctgaaggagaaaaaaagctacctcttcccgctaagaggaaggcctcttcaccaactgtaaagccagcaagttcaaaaaaaaccaaaccctcctctaaaagttcagactcggcttcgaatattacggctcaagatgtactagataagattccatccttggatctgtcaaatgttcatgtgaaagagaatgctaaatttgatttcaaaagcgcaaattcaaatgcggatccagatgaaattgtttctgaaataggtagttttccagaaggaaagccaaattgtttattaggtctaacaattgtcttcacaggtgttctgccaaccttggagcgtggtgcatcggaagctttagcgaaaagatacggagcaagggttactaaatcaatttcaagcaaaacttctgtagtagtcttaggtgatgaagcagggccaaagaaactagaaaaaatcaagcaattgaaaatcaaagccatagacgaagaaggctttaagcaattaattgctgggatgcctgctgaaggtggtgacggggaagctgccgaaaaagcacgtcgaaaattagaagaacagcataatattgctaccaaagaagcagaattgcttgttaagaaagaagaggaaaggtcgaagaagcttgcagccactagagtttctggtggccatctggagagagacaatgtggttagggaagaagataaattgtggacagtaaagtacgcaccaacgaatctacaacaggtctgtggtaacaaaggaagtgtaatgaaattaaaaaactggttggctaattgggaaaattcaaagaaaaatagttttaaacatgctggtaaagatggctctggtgttttcagggctgcaatgttatacggtcctcctggtattgggaagacaactgctgctcatttagttgcacaagagcttgggtatgacattcttgaacaaaacgcttctgatgttcgctctaaaactttacttaatgccggtgttaaaaacgctcttgataacatgtctgtagtgggatatttcaaacacaacgaagaagctcaaaatttgaacgggaaacattttgtcattatcatggatgaagttgatggtatgagcggaggcgatagggggggagttggccagctggcacagttttgtcgtaagacgtcaactccattgattctaatttgtaatgaacgtaatttaccaaaaatgagaccattcgatagagtatgtcttgatatccaatttagaagacctgatgctaacagtatcaaatcaagattaatgacaattgcgatcagagaaaagttcaaacttgatccaaatgtcattgataggttgatacagactacaagaggtgatatccgccaggttattaatctactttcaacgatatctacgactactaaaaccataaaccatgaaaatatcaacgagatctcaaaggcatgggaaaagaatattgccctaaaaccctttgacattgcccataaaatgttggatggacaaatatactcagacataggttcaaggaactttacactgaatgataagatcgcattatattttgatgactttgatttcacacccctaatgattcaggaaaactatttatctacaagaccaagcgttttgaaacccggccagtcacatttggaagcagttgctgaggcggctaactgtatttcattaggtgatattgtcgaaaagaagattcgtagtagtgagcaattatggagtcttttgcctttgcatgctgttctttcatctgtttatccagcatcaaaagttgccggccatatggcgggaagaatcaatttcacagcttggttgggccaaaattctaaatctgccaaatattataggttactgcaagagatacattatcatacaagactaggtacatctactgataaaattggactaaggctggattacctaccaacttttagaaaaagattattggacccatttttgaagcaaggtgctgatgcaatttcatctgtcatagaggtaatggacgattactatttgaccaaagaagactgggattctattatggagtttttcgtaggtcctgatgtgaccacagccattatcaaaaagataccagctacggttaaaagtggattcacgcggaaatacaacagtatgacacatccagtcgcaatttacagaacaggtagtactattggtggtggtggtgttggcaccagtactagcacccccgatttcgaagatgtcgttgacgcagatgacaatccagttcccgcagatgatgaagaaacacaagatagtagcacagacttgaagaaggataaacttatcaagcagaaagccaaacctacgaagaggaagactgccaccagtaaacctggtggtagcaaaaaaaggaaaacgaaagcatgatttattcatacactaagattataattacacttttcttctcattgattttgtgagccgttctatcacagatacgaaaactgtgtggtgataatagctcgatgggtatcatcaccgccctatataaaatactcttattagtatagtacacaaaataatgtacctgtacgtacaaccgtcgttaaatattacatttattaggtctaacatttgtacctaatatgtcattccaaaattatgcgttgcaattgagaaacttcatattattatattattaatcgcgtgtttgtctctatcgttatcgttaatatcgcaatcatccataaagttttataaatgcaaaacttcagtgttgtcaaagcgttcagcaaaggcatcccttaaccaatagtatagtttttggaatacaattctttgagcgttgtggtaccggatggaatgatcagagtctggaaaaatgtgcatgtcatagttcgtcaatcccaatagattcagttgatcaactaatctaaaagtattttgtatgtgaacattatcatcgaaagttccgtgcacaatgaaaagacgctttaaagattcgaatgatttgaaattttggatggtggatacttcaaaatagccttcatggttttccgatggttggttcatatatctttccgtgtaaacggaatcatacaatgtccagtttgttactggcgcgacagccatggcgtatttaaatgtgtcgccgttgtctaattccacggttttcaagctagtaaaaccgccgtatgaccaaccccaaatagcaattttgctttcatctatatgttggctattcctttgtatgaatttttttgtgacttcagtaatgtctctaggttcccaatatcctaatttttcgcgggcccatgatctaaaactccaacctttacccccagttcctctgggctctatttgtaggacgataacatctaatcctgaaacaactgcttgttcaaacgcaagagacgacttggtggtaaatgtttgagatcctggaccaccataaatgttgactaatatcgggtatttttttttaggatttaaattggctggtttgatctcaatgtaatttatttctacgccatcgtctaggaccatggttttatagcttgtaataggtaaatcgtagttctttattttttccttgaacttttcatccttcgtcagttgcaagattgaatcatcgtgaatttcggcaacgttcaaaacccttgtaagcggaccagctactttaataggtgtatcaggccccagttttttagaaatagcatatctcgcactagaacttaattcgaagtcataaaaatcgtatttgtctgatgggttttgtaaactttggaaagtattctgagttgtagaatccgtaaggctgatactataaaggtgttgtgacatgacaccaatctcattggcagtaaaaaatatagtatctgtttcatattcgtagccgactattccatttccagtcacttcccagttccctttggtcaactggataggctctttggcaaaaacggttgggtaataaaagagatgactgaaccctctactgtctgcatgaatatcaatgtacccataatccattcttttcaactctggctttggggggatgcttaaaatatccttcgtcttttcgatccatccgttgaacaggtttgaattggtgttcctcacagtaagcatttgagatgatggtatatcatacacttttacgtctaatatcttagagtttctatcggtgatttcgaacctgaatgtatctggactaatccattttccgttatacagaatggaatccttctgaccaccagtattaattgagtaaattataccgttctgtaagttaacgagaaacaagtcgaactgtggattttggaaccctggcttcgggtatttgattttggtgtcggaaaggtatgcttcgttcatatttgtgtaacggtttaatcggatatcgtcaacactggtgtcattgaatcttgcaaatacagccttcgaatcgtctggagcccaccatattgcttgatcagaagcaaggacctcttcttcatatatccagtctggtttggcattgaatatatccttggagccatcttccgttaccttcttggcaactccgctatttacttgttgcagaaacagattgttctcgtaaacaaaatagatataattgtatgcaggagaaaaatgcgcataggaaagttttgataatccaagttcataattatcatctgatttttcgggaggtaatatcggttcaatattacctgtgtttaagtctttgatccaataaaaccccttcgaggagtgtctaaactcagactctaagttagttccaaatataagtttatccaatttataattaatttggacagtacttacggtaaattctactccttcatataggaacctattgcccccaaggtttacttcaaaagtctcatcaaataactgctttgcaataaaattcgtatgtccatcaatttcttttgtagtaaaatatagccccggatctgagtcttggcctaataagcgctgtggtgggtcaataaagtggaaagtatcctcagggatggcaaaatctccgttcaaaacgttttcaattgagaaagatcttttgcccaaactagaatctcctgcagatgtcttaggacgcgtgattttggtaggtagaagttttgaaggtattagaataacaagtagaactaaaactgatagtgctattaatgtaaagactaagacataagatcttttctcgggcagagaccattctccccatcgacgattaaatttgtttacactgaaaaaggaatgcgtgtgatgctggttttcaatatcattaaactggaagctttctcgtctgggacgcattgagtattgttcctggagaaagggggtttgaggaacatctgtaacatctattgtagcttctgtcggtctaatctcgttaattgtatgtccattctcgttactttgaggatctgtgttagctacactatcgttattaggaaagaatggcttatccatggaagagtttgaacttttcctttgcggaaataaatgactattcttccttttatgcgaatgagttgaagcagacattaggggctttctatattttttacacgaataacaccctaactaagtttattgaggtcatgaggctggaagaaaacaacaaaacaaaataggtatctaatttctgtcatttcatacttaaaagactctaggtacaatcacctttgaagttgtttgttataccgtgaaacaaatttcatcggccgggtggctatgcgtaaagccgcgccttgatagaataaggagagaggcttatactatataccttgatgctacaaaagcatataatggtagcaatcaaaaaccaaaaaaagatacattagcgttagaaaatcgggaattatggcaaaccaaaagcaaatgagaactcaaatactaatcacggacattcctagtggcaaatttactagtaaatggcctacacaactggaaaaaactttattcaaggagcaatttccaaatttacaaagtcacttgcagtattacacgccgttgccatttttaaacagaattataatcatatttgataatgaagatgacacgctgcaagtgtttaagttcttacaggaattgttagctaaggagaatagcggtccgatgaagttatttgtaactgagtcccttttaaataatcaacatccgcgatctcgttccacggatgatgctgtttcgttgcaagataataacttggcacttttggaggatcatcgcaacaaaccgctcttatctattaatacagatccaggagtcactggagtagacagttcatccctcaataagggaggctcttcattatctccggataaatcatctctagaatcgcccacaatgttgaagctttcgacggattcaaagccatttagttaccaagaaccgctaccaaagctttctaggtcgtcttcttcaacttcgaacctctcattgaacagaagttcacagacatcattaccttcacaactagaaaataaggataagtcagcgtcaggcaccaaatgccttttcgcctctaagccactaggattgaccattgatacttctactagaagtaatgctgcatcgtgtaccgaaaatgatgtaaacgctactgcctcaaatcctccaaaaagtccaagcataacggttaacgagtttttccattagagcactagagcataactaatactataaattagacaaagcagaaaaagggaaaaaggttcatgctatgataatgtaaagaatatgcgtagagatatctatatatccatttatacgtttatatacttgcgtgtttactttgtatggcataataacatgtatgtttgcattagggatttgttttagtgtatccaagagcgattagtatagaaggaatgtatgtatgtgtatacgatatttatataaagggaagttggctaattttttgcacactttcgtcctctttccattttcaatgaatgcgtagaagcacagactgggagtggagagagttcgcagttttgatctctttctcaatctttgttctcctctgccgccttgtgataagcgtctatagttgctaaagaggtgtattctatagtgtccacttggggacaatttctccgaataaggttataaatcacattgcccgggccaaagcaaatactcttatcaatttccactggggttccagagtttatggtatcataacacatggtgaattgcacagtcctgcttgaacacttaacgaatctatctagggcatgatgaatatagtaagatatattaccatctaagttagctattattggatggttcaactccatcaacgtgtgagttccgtttttctttaatatatcccaaatgtagtcatagagtggttcctgaacgggcctcaacacagtgctattatggaaggggatgttgtatgggttagttaattctgtaattcttaaacgcgggaaccttaagttcaattctgttcttaaggactctaaatcatcaaccagaccggtgactacacattgctttactgaatttgcatttgctacagaaatggtattttgtgaagatgataataaattaggggaatttagtagtttttgcacttcttgcggtaaatctgtggccctcggagaagagagtgcccacatttcaaatttgttggatctgttgatattgtgggctactaagtacttttcagtagatgttaccattaacttatttctaaaattagcaatatcaaaaagatcctttaacgaaaacagtgaattaacactcagacatgttaactcgcctagcgagtgacccaaaaggtaacattgttcattgtctttcttgtcgggggaatcgatcttagtcatattttttggtgcttgatcttgaggatcagaaggattcgagagtatctggtacaattgatagaaaaggttggagcagactgcaatgcttccggggctggaagggttctggaagatgtactgcaatagatcatttgattccttgccgttctgactcagtattgtttggaattctcttgatttgtttcttattatcgcttttaatatcgaaatggagatggaggtcccttgacctgggaaggttagtagcttcatacaaacgcttatatatgtgtaccacgatcagaaaagtgcaaaacgctttgttactaccctcagtgtacgttattgaatagttctaatatgcagcaagttactggtaagctttgttttacccttgagttcgatactcagtttacttcctccatcggaggttgaaatgcgccttgtcatacggccaaaaaatgccatgtaagaagatgacactttctgcattttgagtatatttaagggcctataattttcttccaactttctcaagacaagcatattgtgtactttcggtttagcaagcctttttacttcgttaacacaaggcgatgctaacgtgtgtttactgttttagaagatcggcatttatcaaatgtaaggacaatgagacatggttgaccaattagttcttctcagataggagttctagttcttctgcatactacttagtcctcttctgtcgttgacattcaattgcttgtgcatttctaacatgaaatagtggtactacgaatgctattattctatgccaggcaaattcctctggaactttttttttttcagttttttcgtggtgagctttttttgcctgtctatctcgaaagatcttgttgttgatgactcagtgcagtcgcgatcactttcgactcgacatgcatttgcaagtaattctgttataaaacgttctcttcgttttttcagtctgaagctcttctgcacttttttactgggttagattctatatagtcaagtaattcgaggtagcatcaaagtaatatgtcatcagactcaaacgcaaagccattgccttttatatatcagttcatatcaggtgccgtcgccggtatttctgagttaactgttatgtatccgcttgatgttgttaagacaagatttcaactggaggtgacgacgcctactgccgctgcagtaggaaagcaagtagagagatataatggtgtcatcgattgtttgaaaaaaattgtaaagaaggaagggtttagcagactttacagaggtattagttcaccaatgttgatggaagcaccaaagagagccaccaaatttgcatgtaacgatcaatatcaaaaaatcttcaaaaacctattcaacacgaatgaaactacgcagaagatctccattgcggctggtgcatctgctggtatgacagaagctgcagttattgttccatttgaattgatcaaaatcaggatgcaagacgtcaagtccagctatcttggaccaatggactgtttgaaaaaaacaatcaaaaacgaaggtattatggggctatacaagggtatcgaatctaccatgtggagaaacgctctttggaatggtggctacttcggtgttatctaccaagtgagaaattccatgcccgtagcaaagacaaagggacaaaagaccagaaatgaccttattgcaggtgcgatcggtggtacggtcgggaccatgcttaacactccctttgacgtggtgaaatccagaatccaaagtgtggacgcggtcagcagtgctgttaaaaaatacaactggtgcctaccttcgctattggtcatataccgtgaagaaggcttcagagcattgtacaaaggtttcgtccccaaagtatgtagactagcacccggtggttcattaatgttggtggtttttaccggtatgatgaactttttcagggatctgaagtacggacactgatatttattgtatatagaatacctctttcctcttcaatcttaactacgttatttctacgtcaaaataagaatagcatgtctgtcctaccagcccttgcataggcgtcttaaaatgttgagaagcctaaacttccctcaatttcctacacaaaagggcattaagatgaacaaaatgatgatctctccgatggacttgacgcttataccaaaagagactcgatataaacaacacggttttatagtcctggattattaatccgcacgattaattttgtatggtttttttttaaaatttgaaataaaaagagtaaatatacaagaagtaaaaccgaggtagtactctttagaaattcttcatctctttttatagttgcactgggaggaaaaaaaaatatatatatactatctccattacccggagttgaatataaagaacggcgtattagggtcccttgagttattaaagaagacgcttgtgatataaaccaagcaaagagagaggtgaaaggcagcatacattgataaaattatgtccgcagaaccattattacccacacataacggatcgcagggaggggaagtgaggtccccagatcagaagttcattgtgatacggttttccgacgtatcagtaagggatctgcagttgaacatatcaaatgtaccattttcgaatataaatacccactggctacgtcggatgtgtagagaattgaggccccaacaaacacaaaaaagaagactgaagtttataaggaacgggagtattctgaatacgcattccaagattgctgaggaactgacgcattacttcgatactgctaataactctaacgtcgcaacaggcaccagcgtggcaccagagcagaacaactactatattcattgtataattggtacagaggagctgacacaagcagagttagccaacgaagatctaaaggacgatgcaactccgtccaatgactccatgaccacgcaggccatcgggtttgataggctacgatccgtgggatttactgagcaagaaatcgaactgctgaggcaacagtttcgggccacgtatggagatttggaggaggaggaggagagacttgctcaaaatggcaacagagatgatgagggccatgacattagacagttggaggaacagtggatggaaagcgggagtgggaccgctcaggggaatggggccggaggcggcaatgaagacaggtttaactctgtgccgatcgctaacataaagcacaacaaagacttgcttttaggtatatgtgtcggattcttcttcggcgtctttggtatactattaatgaagtttgatggattgttcaacagacggcaaaaaatggcgatttttgccggtgtgattgttaatgttatgttttgtcttgtgagaggtttttagtagtgaggcgattagatgtcgttttcatgtacaataatgatattattttttttttttcaatttttagtattttacatggcattcttacacttttataaagtattatttatattactagtagcagtaagtgatcgcccttttttttagcactcggtccaatgctgctaacgacgaatcaaaagataagcgttctcttgcttcaagttattcaaatttctatagttaccttctaatctcattaagaggccaccgaatgagtagtaaacggcaattagatccttgcttacttcctcaaacttgtaagcggtaccatacatgacgtaatcataatcatctgcaagggatctgtcaccagcctgtggaggtctccagcttcttgtcgcagaagagtcgttagctggggtgtcttcgaggtttaaagaggatgcaatagtcactgtcaaagaatcttgtgcggcgacgggaaacaattcaacatttatatccaaggttagtttgcattggtcctgagtggtagatgcggcttcgatacggcagactttgttataacgaccgggatcaacttccgagacttggaatatatcatcaaatagagtgttagacattgctgcggttgttatggaagcaatgagctggcaactgggcttttatagctgccatcacagtttaaatattctgaaatttttcatcttagttttcgctttagaaaaaaaaaaatgtgaaaatgaaagatgaaaataagacctggagaaaacctatcacgtctgacgaacatgaaaaaactaagtcaaaatttgatacataatgtcactagtattatgactgtttctgatattaattacttattattatacctaattattcttttaaccctttctataaaacaaccagaaaaaaaaaaccggaaagagaggacctcttgtattttatcatattatcgtatcgcctctctttcaatgcaaaacggaggggttcctctttgttttgtagtccttgattgccgccttgatagcgtcttctgcaagcatggaacaatgcagttttactggaggaagacttagctccttcgcgatttccgtgtttttaattttaacggcctcatcaagtgacataccgcgtaccagctcggtcatgtaggaggaggaagcgatggcagacccacacccgaaggtcttgaacttaacgttctcgataatacccgatttatcattcacctgtatttgtagttttatcacatcaccacacgcaggggcgcccacgattcctgtgccgacattagctaaggacttatccatggacccaacgtttcttgggtttgtgtagtggtcaattaccttaggatggtaaagtcttttggcagctcttgttatgtgggagcccgtgagaggcttgaagtgggcaggattagcgagtctggcgaacatctatgctgtgctatgtttgttggtgatgtatgagctgtaatgaaacctcagcgttgtctacatatgcttcttttgctgttgttatatactgctatactgctgcaccggccggccccaggtgcttattaatagtaggttccgcatagggaaaaaacgagggcgccaaaaaacgttgggcctgaaccggactctgaaacaatagaatcatggtgactcggatatatgcagtatgctgtgtatctgtattatgggtgtacatatataaacatctgaccactataaagttgcagtcataattccataccatgcctttctagactgggaaggtgcggaccctgtaatgaaataagaataattccatagtggtttggcgtttccttttccgggttatgcttaattatttcttgagtttgtctgccttttgtttttgcttagtaacgttaaggggcaggttaaagaagcgacatgattgacagttcgatgggttaaggtggaaagcgaaccctctataacttacatttgactcttccatttggttgcagttgccacatttctcgagaactagcctgttcccgttttattaccacttgcattacgtattttctcctttcctcctcgcaccagttcccttccttcagtgatactgtcgtctaatatttgactgagtcccttccttttttcttcattctctttggccattgtatatgtattaatttgtatctggttgaatctagtctgacatgagctccaagttgaagtacactgatatagatgtgccattggactggttgtataaggggaaacgaaggaataggaccaaaagtgcggcttccacgcgcacttcagaagctaccaccacctctgtaaagaaaactgctactttgccatcaaccgcagctgttcctacgaaaactatagcttctcctcaaaggcccctgagcggccagaatgtaaataacgaattatccaactctaaaccagcagtatccgccgagaaggtttcgcagcaaggacaagtgcccactaggaggactcgttctcactcagtatcgtacggcctactccagaagaagaataataacgatgacaccacagattctcctaaaatatctcgaattagaacggcacaggatcaacctgttaaggaaacaaaaagcagcacccttgcggaacccatcgtttcaaagaaggggagaagtcgttcttcttctatatcaacttctttgaatgaacgatctaagaaatctctgttcggttctttgttcgggagaaggccttccaccactccctcgcacgttgttgaaagaccgttgtcttctcagaatgaccataaaaaaagcacagaactccctcctatagataccagacagtcaaagatctccaccccaactagtactcctaccactgcatcttccaaacccagtagttctggtgggaatagacattctgatggatctcttacttcaaaacttctaagtattcctcataacatcttggaaacctcttctacgaattttaatgcccaccaccatatccagtcacatcatagtagtggtcgtgaacaagactcgccccattctgaatcatcagacctccctcccattttagaaaaagaaactacgcaaaaacaattacagaaggtgtcaaaggtaaatttgaaaagggttactattgcagttcaagaatttaactcagatcccccacaacaactaccttctaggaagcctaaaaggggtaatgttctcataccagaagatatgattagtgcccccccactaatctctctgggaattacaaacagcagcgatcaaagcagttttcagtccaatatctctccctcatattcaaaagattctaaagaatataaattagctttggaaaattttaaaaaagcagctaaagaagccgaaaaacatcaaaaggatgcgtattatgttgcagagcgaatggctcaagaagtggcaaactataaggccaggcaattgaagacatcgccgttaactggagcaactaattcagcagcagattcagcgacggatcaagaatcctcctctctagatgctagagcttctaagcttcatatcgataaaccgatcaatgtaggtgcacatcctttcgaaacacatcaggatgataacattaaatactcttctcaccttgaacaaacattggacgtagcttacactagatgctgtcatttgagagaaattttaccaataccgtccactttgagacaggtcaaaggtaaaaccgcacctttgcagactttgaaatttttgaatccaaaaccaaccttagtggatatattatcattttgtgattttattgccataactccgatccataacatcattttcgataatgtgtccttaacccatgatatgttcaagattgtcatttgttctttggtaacctctccggtagtggagaaattggggttaagaaatgttgtgataaacgaacaaagttggaaactactttgcaagtttttattacaaaataaaacattgatcaagctggatatttctcagactaaagcaaggacagatttaaatgattctaactacagagaccaaatggactgggaactattttgcgaagttcttagaaatagagaaggtagacctttggaagaattgcttttgaatggtttaaggtttgacaaaatgtcattcagtcatttcaaaaatatcctacttactttcgcacaaatgaaccctaaaaaccctattcgtctcgggatggctaacgtagaattctcaaccgagtgttttgattttctctttaattggatgtctgaatataacgttcaaggtgtggatttggcctataataatttagaaagtttggcaaaacgaatgatcaaaaaactagctaggcttccttataagcatttggaatattttacccttaacagcactaatatcacctctgttgatgatatgtcctacatactaaaatatctttcacgtttgccaagcataaaatttctagatttgagcaacttgcctcagttattcccggggattttaacatccggctataagtattttccccaatttccacaactgaaacgtattcattttgatttcgacgatctttctataaaagaaacaaccatgcttgtcagcatattagctaagtgtgaaaccctctctcatgtttcattgataggacaaagtcctatgcccgatgcaagtaaaatatccgacagtactgatgaacccgataagtcgaaagatgaaaagaaagaacaaatcgtatttatgagaaatacgctttgggcctcattgtatgcatttgttagggactctcacaatttagttagtttagacgttgactatgatcaagtaccagacgaaattcaatcaagaattgcgttatgcttaatgcataatatgaagagaattatggactctagctttaaattagatgaattgactgtacaagatgatttaatatttgatggttccttgataactgagacagcagaagaagttttgaaaagattaaatgacaaatctttacttcaaaatgatgttgggaagaaatatcttttaaagaaatattttgagaaaatggaaaaggtacatcataatgttcaaaatacaattgattctatgtttgagaaaagaaaatccggcgaactgccactgcaggaaaaggaaaacctactaaggttattgcttcttgagaaaaatttatcaaatattcttgatatttttgcttctatgcccaatatagcagatgtcgtaccattttcaaaagccgataatagtttccctaatattggggatagcacggttagcgcaaactataatgatggtattcgtccatctctaaaacacttagattctgacaggttaatcaacgatgtttcaattcctgaaaacgattcatcaattagaccacacttaatggccaccgactcgggacgaatcatcgatgtgaccactggtaaagctcttcttttcaagagttcgtctaatacctcactggccggcaagagacaggaagaagaggaaggtgaattacataaatggggtgtgtttgtacagcaccaaagctcaagacataactctgggcttccttcatccgccaattcttcgagaattagcgggtcgttaacaccagatagcagtgtcgccggaggaaagaaaggggaatcctctcgcacatctggtacaaggccaaaaatcttaccaaagattcctaccggtgccgaattaagggatgccattattaaagctaagggtattgattctgtagatgatctgattaaaaatgttacctctgaaaaggttggattggaatcattatatggagatgaattgaactctagaagcccgagtaatgacagtttacaagaatcacaacaaaaggcgcctttgcagaggccccttgttgaagatgaaacagtgacaaaaaaatatgacaaactattgaacgatctgtctaatgttcgtcacagtaaaacctaaattattttatgcttctgtctttcctttctctttcgattattagaaggtgcatctttgtataaatatcccatcaataatgtattcttaggaatctatatatgtatgtacgttttatgtgtatatgtattttacgttttttcataatcatatactttctgccgaaattttttgccttcattatgcacactaatgttattaatcagataaaaatacagaaatttaaaataaatactgagaataatataattaactgttcgagaattgtcgcaaattaatagcttcacactactcccacaaggattcctaattcacgtgcaacagcaaccggatctttttgaaaatgctttcgaattggttgggacccagtttcgtagaatcctctttcatcaatctaatcagagaaacgaacccaacgagtgttaatagattgatagctgtggaccattttttcctgctagtcatttttctaacaccgaaataacggcagagccccgaacctatatgatatacacctgactcgaggagaatagctaacggcaccaggcctccaagccatttccaccacctgttcttgctagatagtaattgctttatagaggcgaaatccacctcagtagagatggaattcggcacccatttcataattaataagtggtatatcaggacgggaacaaggatgtatccactaatcacttgtggaggaatgcggaaggtcttatacaatccaaataaatagccagaaattccaccagttaaaccaatcgaatcttgggatagatcttgttcggccgatatctttaaatgtcgatgtctatttcttcttggcttgttccagttgttcacgattcggagcaagacaccagcagaaacatgaagagtaatacccgcaactaacagcttggtagttatggacggtaaaatctctctcaccatcattaaaacgtcgtcaggagcagaatcaggtgatactgccggcgtgattaatgtatttgctgcatgtagtgggaaatacaatgccatgggcagtaccgaaatcttttgacagttccaaaggaatctccgacatgaactcctggaaaaaggatacggaatgccaaatatttttttcctcttatcaggattaccatctccttcggggctatgtgcattaacatcatgagggagactagcagggtctactggttctggaggcacttcatgcaactttatcatcgtaataaacaaaactctgggctaactggtatatgccctagtaattcgggacctgttaggagcaatacaatctacacaaggttttccttacttattttccaattgacgaccaacttgcctcacacaattacagagcacgtattcgctctctagccactcttttcaaaacaaattttagttgtggacctggttaggatacaatcagcgatgtcggaagactgatgtagtagaattgactggaacgcttcttctatagtctacacggaagctatactcccttgaatagatggtagatgttccgcataaggtttgtccttttggttttttagccccgttcggggttcgaactgctaagtcatattccgcacatatgcgtccgcagactctcattggatcattcttacccattcgggtcataatgcaagcctttaccatttatggcactttgatttccctttccatctcacatcttcaattctattgtttttgaaaaaaaaaaaaaataaaaaaaaaaaagattaaaggcaattagttagctgacgtatggaacatctctgctgtacagctacatttacttataagacaaggagcaattagtagcgacgggagcaagaactaaaaaggatagaggatggcgaaaagcaaatccagtcagggtgcgagtggagcacgccgtaaaccggcaccttctttataccaacacatttctagctttaaaccacaattcagcacaagagtcgacgatgttttacattttagcaagacactgacatggagaagtgagattattccagacaaatccaagggcaccttgacgactagtcttttatattctcaaggtagtgatatttacgaaatagacactactttaccattaaagacattctatgacgacgacgacgacgacgacaacgacgacgacgacgaagaaggtaacggcaagacgaagtctgcagccaccccaaatccagagtatggtgatgctttccaagatgttgaggggaaaccattgcgcccaaagtggatttaccagggcgaaacagtggcaaaaatgcaatacttggaaagctcagacgacagtacggcgatcgcgatgtccaagaacggctctttggcatggttcagagatgagatcaaggttcccgttcatatcgtacaggaaatgatgggccctgctactagatactctagtattcactctctaaccagaccaggttcattagcagtgtcagattttgatgtgtcgacaaatatggatacggtagtaaagtcacaaagtaacggctacgaggaggacagcatcttgaaaatcatcgacaactccgatagaccgggagatatattacgtacagtgcacgttccagggaccaacgtggctcactcagttagattttttaacaaccatttatttgcatcttgttcagatgacaacattttaagattctgggacacaagaacagcggacaaaccgctttggacgctaagcgaaccgaaaaatggacgactaacgtccttcgattcctctcaagttactgaaaacctatttgtcactgggttcagcacgggtgtcatcaagctatgggatgcgcgtgctgtgcaactggctactactgacctcacacataggcagaacggcgaggaaccgatccaaaacgaaatagccaagttgttccattctggcggcgattccgttgtcgatatcctgttctcacaaacctctgcaacagaatttgttacggttggaggaacgggtaatgtctaccactgggacatggagtactctttttcaagaaacgacgatgacaacgaagacgaagttcgagtggctgctccggaggaacttcagggtcaatgtttaaaatttttccacacaggtggcacaagaagatcgagcaaccaattcgggaagaggaacactgtggcgctacaccccgtaatcaatgattttgttggcactgttgattcagatagtcttgttactgcctacaaaccatttctggccagtgacttcattggcagaggttacgacgattaaaaaaaaaaaagagtaagaaattaacgttaccacctatgggaaaggcagtaactcacaagcattcacgtacataattctgttttttttttttttattcatttctagcacgctatcggggttatttttttttttgtaatatatagtgatggtataatgttgtatagatactggtatcgctcctaataaagactctttcagatttctgaagccaacgaagtaaggcctcaagaaaagagggttaccagtaattaaccaagcaatttcttttttttctttccagcaaagaaataagacaaaaaccggctatatggagaagagggaggatctaatggtgacatagtccatttcaagattccctctttcgtttctcggatgaagctcgatgtttacaattcagaatcttaaaaggctgtcgctaagaaagacccagaggcacatgcaagatagttgtgcctgtaccacgtgagaaggcggtattcaatatgcggtgctgtgctggcttccctttttggaacgcgccggggtataacaaagaaaggctaagtcatacaataggcaaaagacctttgtctttcctttttttcctctttcctaacatacggtggtttatgtactatcccttatgtaattgcttagctatacacagtgagcacacatagtggcgctcactactcccttttaatttcaactcgtagatagttgggctattttccttcgaatcctcgtttatcatctcatatttaagagtaccatttcggggcttttttttaccttttccttttccatgcagtctgtccccttaatgttctatgttttttttttttttttttcagttctgtagcttccagtataaagggagggaaaaaagaagatccgaaaagtttatattcgcctgaattgtagatattagataagaaaattaattattaatcaaccaatcttgaaagatacaaataaattgtaacacactatacattacaaccaaaaatgccaaaaaaggtttggaaatcatctacgccttccacttatgaacatatctccagcttaagaccaaaatttgtgtctcgtgtggacaatgttctgcaccaaaggaagtccttgacgttcagcaacgttgttgttccagataaaaaaaataacactctaacctcaagtgttatatactctcaaggtagtgatatctacgaaattgacttcgctgtaccactacaagaagccgcttcagaaccggtgaaagactatggtgacgcctttgaaggtattgaaaacacctcgttgagcccaaaattcgtgtaccagggtgaaactgtctccaaaatggcctacttagataagactggagaaactacattattgtcgatgtctaagaacgggtcgttggcttggttcaaagagggtataaaggtccctattcacattgtacaggaattgatgggtccagcaaccagctatgccagcatccattctttaaccagacctggtgatctacctgaaaaggatttctcattagccatctctgacttcggcatttccaatgataccgaaaccattgtgaagtctcagagtaatggtgatgaagaagacagtattttgaaaatcattgacaatgccggtaagcctggtgagattctacgtactgttcatgtgcctggtaccactgtgactcacaccgtaagatttttcgacaatcatatctttgcgtcttgttcagatgacaatattctgaggttctgggacactagaacttccgacaagcctatatgggtgttgggagaaccaaagaacggaaaattgacctcgtttgattgctctcaggtttccaacaacttgtttgttaccggtttcagtacgggtattatcaagttatgggatgccagagcggctgaagctgccaccactgatttgacttatagacaaaacggtgaagatccaattcagaatgaaatcgctaacttctatcatgccggcggtgattctgttgtcgacgtccaattttctgccacttcaagctctgaattctttactgtgggcggcactggtaatatttaccactggaacactgactattccttgtcaaagtacaatcctgacgataccattgctcctcctcaagatgccactgaagaatcacaaacaaaatctctgagattcttgcacaagggtggaagcagaagatctccaaaacagattggaagaagaaacaccgccgcttggcatccagttattgaaaacttggttggtactgtcgatgacgatagtttagtcagcatctacaagccctataccgaggaaagcgaatagtcgccatgctaaacgcgcggaacaaggccatatttatatatttaatgcttttaactattattagtttttctcacccagggctggtttctttaccctgtgtgatgaaagtgcgcgcctaaagttatgtatgagctactgttagtatatttattattcaatatttaattaaacaatacttactactgatgaaagataccgtacacctgctggcgaataagtcactatacacgagcaattatatttctcaggtcattgcgacaattgaaaaatcggatcgactgattatcattaaggcgtgtgacggctcagaataaggaagttctattttaaagggcagcaaaaatttggcacaatttaaaaagaaagttggtctctggtagggttggatccggtttttcataacttgcgtttcatttatggttgcgtatttctcgcagtgtacatagaccaaattaactctatccttccattgcacaatttgcccagtatggcttcactgttcagacccccagaatctgcgaaatgcaacccaaactctcctagacttaaactgcccctcttacgaaataatcaggtagatgaaaataatatatacttgacgtcgaatgggagttccaccacagcttacagtagccacaccccagaaccactgacctcttccacatcgacacttttctcccaaactcgacttcatcctagcgactcttcaatgactttaaatacaatgaagaagaggcctgcaccgccatctttaccttcgctcagcataaattcacagtctaagtgcaaaacactacccgaactcgtacccatcgccgatgtgtctgatggtaaacatgatttaggattgaaacagcgtgtgatagccgaaaatgagttgtctggtaatagtgacttaaccccttcatcgatggcaagccccttttcacatacaaacacctcttctccctacctcagaaatgatctgagcaattcagtgggatctgacttttcaaatttgatatcggcatatgaacaaagttcaagtcccatcaagtcatcgtcccagcctaaatcatcttctgaatcgtacatagacttaaacagtgtacgagatgttgatcaattggatgaaaatggttggaaatatgcaaatttaaaagataggatcgagacattaggcattctaggagaaggagccggtggctctgtttccaagtgtaaattgaaaaatggatcaaaaatattcgctttaaaagtgataaacacattaaatacagatcccgagtatcagaagcaaatattcagagaattacagtttaataggagtttccaatccgaatatatcgtacgatattatggaatgtttacggatgacgaaaactcttcaatttatattgctatggagtacatgggtgggcgatcgttggatgctatttataaaaatttgttagagcgtggtggtaggatcagtgaaaaagtcctggggaagattgcagaagcggtactaagaggactatcatatttgcatgaaaaaaaagttattcatagagatattaagccccagaatattttactgaatgaaaatggtcaggtgaaactttgtgattttggggtcagtggagaagccgttaactcgctagccacaacattcacggggacgtcattctatatggctccagaaaggattcaaggtcaaccatacagtgtcacatctgatgtatggtcacttggattaacgattttggaagtggcgaacgggaaatttccatgctcttccgagaagatggcagccaatatagctccctttgaattgttaatgtggattttaacatttactcctgaattaaaggatgaacccgaatctaatatcatatggagtccatcattcaaatcctttatcgactactgtctgaaaaaagatagtcgtgaacggccatctccaagacaaatgatcaatcatccttggataaagggtcaaatgaaaaaaaatgtcaatatggaaaaattcgtgaggaagtgctggaaagattaatcaataagcaattttttgcgaacatgattaagtttattttactttatttcgcattttccataaaaaaattttcctccatacaagattcatacccaggatagcctaactaaaatgtatggctttatacagcttgacgacaaacttaatttgaatatatagatatattaatttaatcagcaggattagcatttaatgtcttacatgtctttgtatttggcatacgtattcagtgatattttaatacctcgcaacgcaatttccagcgagtttacgtttgaagcaaacgtaactcccatgagttatacataacgcctgctgcagctgaaccagaacaatataccgtggtattaccgtaagcatttgaaaacaataataagtttccaagtgccgctttagatccaaagtacaaggacatattgtggaagagtaagttgaatatttgaaaatgagagctttttcagcagccaccgttagggccacaactaggaagtcgttcatcccaatggcaccaagaactccttttgtgactccatcatttacaaagaatgtaggctcaatgagaagaatgagattttattctgatgaagccaaaagtgaagaatccaaagaaaacaatgaagatttgactgaagagcaatcagaaatcaagaaattagagagccagttaagcgcgaagactaaagaagcttctgaactcaaggacagattattaagatctgtggcagatttcagaaatttacaacaagtcacaaagaaggatattcagaaagctaaggactttgctttacagaagtttgcaaaggatttattggaatctgtagataactttggtcatgctttgaatgcttttaaagaggaagacttacaaaagtccaaggaaattagtgatttgtatacaggggttagaatgacaagagatgtttttgaaaacaccctaagaaagcacggtattgaaaaattagacccattgggagaaccatttgatccaaataaacacgaagcaacgttcgagttgccacaacctgataaggaaccgggtactgttttccatgtacaacaattaggtttcaccttgaatgacagagttatcagaccagcaaaagtcggaattgttaagggcgaagagaactaaccttgatgaagaattattactacctacgactttatctatatgtgccttttttctttctctgcctggtttagttttatttactacgtttacttgtatatatttgtaaactaatgaaaatataaagaaataaatctcaaaacatgcttttatactgtaaaaactggtgttatatgggttaatgaaaggcatataatatacaagggtgacaaatttttagtactttcgtatacattttaaagaagacacttttgtttcttgaggactggtcaattccatttttatttttttgtaaacaatgacggcgagtttcattaggaacgtgagcagaaaaatattatctgttgtaaacaatcgcatcggtgggagagcataaacttctactgaagatatacggtttgaaaagacaataacgcattagttgtttttttagtacatatttttttagcaagttcactgtttattgagcttactgtgattttcaagtaaaacaccttttattttctcgaggaaatccagccaccttttcacaggtaaagtcatcgcataatattctatcaggacattccgtatacctgaatatatatacatggcttctgtacctaaacgccatacatacggtggcaacgttgtcactgatagggaccgtcattctcttcaaagaaacaatgagattttgcatcctatacataaaaatcagcgaaaacatgctaccttcggaccatacataatcggttccactttgggtgagggagaatttggtaaagttaagctgggttggaccaaggcttcctcctcgaacgaggttcctaagcaagtggcaatcaaattaattagaagagatacaatcaagaaagatgccgataaagaaattaaaatataccgcgaaattaacgcactgaagcatttaactcatcctaacattatctatttagaagaggtcctgcagaattcgaaatacattggaatagtgctagagtttgtatctgggggagaattctataagtatattcaacgtaagaggagattaaaggaatcttctgcatgcagattgtttgcccaattaattagtggggtcaattatatgcactacaaaggacttgttcatagggacttaaaactggaaaatttattattagataagcacgaaaatttagtcatcacggattttggttttgtgaatgaattttttgaagataacgaattaatgaaaacttcttgtggttcgccctgttatgcagcaccagaactagttgttagtaccaaggcatatgaagcaagaaaggcagatgtttggtcgtgtggtgttattctttatgcaatgctcgctggatatttgccgtgggatgacgatcatgaaaatccaacgggtgacgatattgctagactgtacaaatacatcacgcaaacacctcttaaatttcccgaatatataacccctattccaagagatttgctgaggcgaatactggtacccaatccaagaagaagaataaacttacaaacaataaaaaggcatgtgtggttgaagcctcatgaagcgtttttgagcattcagccgaactattgggatgaacacttacagaaggaacgtccgaaaccgccaaacaaaggtgacgttggtcgccactcaacttattcttcatcagcatcttcgtactcaaaaagtagggatagaaactctttaattatagagtcgactctagagcaacatcgaatgtctccacagcttgcgaccagcagaccagcatcaccaacattctctactggttccaaagtggtgttaaacgatacgaaaaatgacatgaaagaatctaatataaatggcgagcgtactagtgcatcatgcaggtacacacgtgattcgaagggcaacggccagacccaaatagaacaagtatcagctagacactcatccagaggcaataagcacacatcggtcgcgggactcgtaacaatccctggctcccccacaactgcaagaacaaggaatgcaccatcatcaaagcttactgagcatgtaaaagattctagtcagacaagctttactcaggaggaattccaccgtattggtaattatcacgtgcctcgcagtagacctaggccaacttcatattatcctggactcagtcgtaacaccgcggataatagtttagcggatattccagtaaataagttgggttcgaatggtaggttgacagatgccaaagacccggtaccgttgaacgcaatacacgataccaacaaagctacaatctccaacaattccattatgctattatcagaaggtccggctgcaaagacttccccagtagattaccattatgctattggcgacttaaaccatggtgacaaacccataactgaggttatcgacaaaattaataaggaccttactcataaagcagctgaaaatggttttcctcgagagagcatcgacccagagagtacctcaacgatattagttacgaaagaacccactaactccaccgatgaagatcatgtagaatctcagctggagaatgttggccactcttctaataaatcagacgcttcttctgataaagatagtaaaaagatctacgaaaaaaaaaggttcagcttcatgtcgttgtactcatccttaaatggttcaagatccactgttgaatctcgtacctcaaaagggaatgcacctcctgtttcatctagaaatccatcaggacaatcgaatagaagtaacattaaaataactcagcagcaaccacgtaacctttccgacagagttccaaatcccgataagaaaattaatgataatagaataagagacaacgcacctagctatgctgaaagcgagaatccgggaaggtctgtacgggcttctgttatggtgtcaacactacgagaagaaaatcgatcggaattgtcgaatgaagggaataatgtcgaggcacagacttcaacagcaagaaaggttctgaattttttcaaaagaaggagcatgagggtttgagttttcagtacatagttatatcgacaattacattatattatagagtgataatattattttctttttgaattttaacagtctttttgataggacaccaaatattgcttaacgcactgcatgttcctggtagagaaagaagaagaaaagtcttactgtcactacctgcagaaaagattgtatgaaacgaaatggagtaagaactcaaaatataaacaaaagaataaggatatatatatgaatgcttattttttatattttatacaatattaataacaataattataattttgttttggtttaacttaattaaatgttagatgggtacaagaaaattctgacagaggcaccgaaagtcttggctggcaagttgtttctaaaggtagctctaacgacaccagagttaccgtgagttctggtgactttgccccacataactctaatcttggaacctctgacttccttggaagctctgtaaacgtaggcgatacgcttacccaaatagaattgagcttcttgtggagtggcaacaccttcaatcttaatcaaagagacatttgggttgttaactctcttagatctttggtaggataagtgcttacctttaacgtatactatcaaaataaaagtagaatagaatttgtcaattcataaataaagctgttagtaaggttgtactttcatgagcacgttgcagagtgaaataattcgacatttcattgagcccatgatggaaagggacgcagttatgtcagaagcgacctcaaatgacatatatatacgctatcttaacatttctggcacgcgcagtttcatgtaaaaatgcatttcctggtgcctcctactacttggtggaatttcatatcaggtaggttatctccttcttctttccctagaaggtaaactgatcatttataatacctttctcttttgaatttttttcctatgaaacttgttcattctgttcttctcatcgcaaaaccatgcactatttaatatattcatactctttaataacagttgtccaacaagtgcgggccccaactataacacatgttttatcgaatatcaataatgtcttctaagctcgaatcagcctattccacggcaacattcatcatatagtaatttcataacatacgtctatgggattcagccattttatctatgatttatctggttctacttttgcaaaggttgtttaagcaaagaaactgttttcggacctttatctgctataataatcgttttttcaaaatctggtgctaagcgtaactggtgcaagccataggtagcctcactacggtacagaggttactttgaaagcaagaacccttcacatgtcacacctgcacgcagaggcatggagaggccagcacaaaccaccatggatgggtaaagtcatagaaggaaaagcacatggtacccaggcagagttccccccagcagtgacgctctgttgcactggccggaagaagatggtgtaaagagaagcggtctccaggcagaacaaattctgattgcccgtctaccggtaaagctttctcacaatataccgtacgtttcaaaaaaaatattgattctttttttataaaaatatcagtagtatgtatgggctgattgtatgggtttatacaggccgtcaaaattttttcacccccccataccccacataccttttactattaaccctgattttttttcttttcacatacagcgccttaaggcgaaggcaaatcctgaaaattttctcatttgctttcccccaccagacatatataaaggctttgtattctgctgtcaattagatttagtacatcttttctcttatgttttcttcttgtttctacttaaaatctgtgtcgacgtacttcagtatgtaatataccccaaacattttacccacaaaaaaccaggatttgaaaactatagcatctaaaagtcttaggtactagagttttcatttcggagcaggctttttgaaaaatttaattcaaccattgcagcagcttttgactaacacattctacagtaggatcatttctataggaatcgtcactctttgactcttcaaaagagccactgaatccaacttggttgatgagtcccataacctttgtaccccagagtgagaaaccgaaattgaatctaaattagcttggtccgcaatccttagcggttcggccatctataattttgaataaaaattttgctttgccgttgcatttgtagttttttcctttggaagtaattacaatattttatggcgcgatgatcttgacccatcctatgtacttcttttttgaagggatagggctctatgggtgggtacaaatggcagtctgacaagttaaccacttttttccttttctaaattgtttaaaaccaaaggtttggttttcagttaagaaattggattagttggtgtgtaagtataattaaatgtagtcttggttagcttaatgtataggttcttgatagtatgactccacctaaaattcgtcaagagcgacggatgcgaaaacaaaaaaatcgctttgcatccttacgtgcgtgagatggcatcgctggccaaagggaaacgtttcattattttctgtagttaacattatgctttgcatgataataagagaaattgaagagcgcaacgaactacgagcatggctggaggaaagattcctattgtaggaattgtggcatgtttacagccggagatggggataggatttcgtggaggtctaccatggaggttgcccagtgaaatgaagtatttcagacaggtcacttcattgacgaaagatccaaacaaaaaaaatgctttgataatgggaaggaagacatgggaatccataccgcccaagtttcgcccactgcccaatagaatgaatgtcattatatcgagaagcttcaaggacgattttgtccacgataaagagagatcaatagtccaaagtaattcattggcaaacgcaataatgaacctagaaagcaattttaaggagcatctggaaagaatctacgtgattgggggtggcgaagtttatagtcaaatcttctccattacagatcattggctcatcacgaaaataaatccattagataaaaacgcaactcctgcaatggacactttccttgatgcgaagaaattggaagaagtatttagcgagcaagatccggcccagctgaaagaatttcttccccctaaagtagagttgcccgaaacagactgtgatcaacgctactcgctggaagaaaaaggttattgcttcgaattcactctatacaatcgtaaatgaaacctctccgcccgtatattttttttaatatgttaaatagtgatagaactgataagcctcattttcttttattgggctccaagacgcgaactgttcgtagggtaaccgtttgacacctaaacgacctttcagcctcacctgcagtatttcttcaacaacgcctgtcgctatgttaaataatagcaatcgtttgtgatcaccattgtcgaatttgacgcgcttaaacaaaaaccattgttttggcctcgttccctgcattcaacaaaagagcaaggtatgccgtcaaacagtcgttaaaagagaaggtttataaactatcttgttttgtactttgctgtcccggatccagttgggtcttcttttcaacctgtctgagtccgatctttctttccctacttgaagctccatatatctaagtcatctaagtgtatcctgctagattacaaacgaaaatgtctcaacacgcaagctcatcttcttggacttcttttttgaaatcgataagttcgttcaacggagatctatcgtctttgtctgcaccaccgtttattctttctcccacttccttaacagagttttctcagtattgggctgaacatccagctttatttctggagccttcgttgattgatggtgaaaactacaaagatcactgtccctttgacccaaatgtggaatcaaaggaagtggcgcagatgttggcggttgttaggtggtttatttctactttgagatctcaatactgctctagaagcgaatcgatgggttctgaaaagaagcctttgaacccattcttgggtgaggtatttgttggaaagtggaaaaatgatgagcatccagagtttggtgaaacggttcttttaagtgagcaagtttcacatcatccacctatgacagcattttcgatttttaatgaaaaaaatgatgtttctgttcaaggatacaatcaaattaaaactggttttaccaaaacattgacgctaacggtcaaaccatacgggcatgtcattttgaagattaaagatgagacctacctgattacaaccccgcctttgcatatcgaaggtattttagtcgcttctccatttgttgaattaggaggcaggtcattcatacagtcatcaaatggtatgttatgtgttatagaattttcaggaagggggtatttcacagggaagaagaactcctttaaggcaagaatttacagaagcccacaagagcatagtcataaagaaaatgcgctatacctaatctctggccaatggtcaggtgtttcaacaattataaaaaaagactcgcaagtttcacatcagttttacgattcatcggaaactcctactgaacatttattagttaagccaatcgaagaacaacatcctctggaaagtaggagggcatggaaggatgtggcagaagcaatcagacaaggaaatattagtatgataaaaaagactaaggaagaactagaaaataagcaaagagccttgagagaacaagaacgcgtaaaaggtgtggaatggcaaagaagatggttcaaacaagtggactacatgaatgaaaatacatcaaatgatgtagagaaagcaagtgaagatgatgcctttaggaaattggcgtccaaactgcagctttctgtgaaaaatgtgccaagtgggacattgattggcggcaaagatgataagaaagatgtttcaaccgcattgcattggaggtttgataaaaatttgtggatgagggagaacgaaattactatataatataaatgtttttaaaagaataaatatcaaaaattaatactaattgatgtttgcattgctttttttaagggaaaatgcaagcgtttttatttttaacttttggttttgaagctcgtaattcaacaaaaaagaattaaataatcttcaagtccgataacaagatgtagaaaaaacatcccaatgaagttacaagtcaaaccattcactgagaatttttgtaactcaccaccgattttttggataaaatgtattcctgcaacttttttttttgaagagataaaaagaattgaatagaatatgcagtaaaaaaagaatctcgaaaaaaaaaggacaagaaatcttaactaccatcaaacaattgaaaattgaatgtactcaatggacgaaaaagtcgaacttattttagtgccatgccactcaatatggaagtcctcatcgcatcctagtgataattcagttaatttgggtcaattacctgaatactggcatttagctccgtttcagtatgagggtaatgatcatttagcattcatcaaacatggcctaactgctattaaactactcctacaaagattcgacaccgctaccgttatcttcagtggatcccaaacgaaaaaagaggcaggcgctatatctgaggcacaaagctactattttttatttgaaaagttgattagatatgtgatgagcaatgataacatcgatgttccaaactttgataacgagctgcgtcttttattaaaagaggtcaaaaacttgctatcaagtcaaaatgtaaatgttgatgaattgttctatggtggttcaatcactactgaagagttctcgctggactcatttgataatttaatttattctatatatagatttgaggaagtgaataaaaaattcccacagaaaataactataatagggtttgcgtttaagatgccaagattcatcagctgtcatgccaaggccattgattacccacaatcaaacataacctacataggaattgaccctaaaccagcaaactacaaccaaacacaactttcaaaatactatgatgatctagtacaaatggaagataaaaatgcactaagcttattttcttcagattggtacgctacaaaggatagattactcaccaagaaaagatctcgcaacccatttaacagaactgcaccgtacgctcagaatattttctgcaaagaaaacggcaagaggatcgagggaatcgaggatgacgaggaatattttgaaacaaaaattaagtgtaaaatgccatggtcgtcgccaagacaataaacgtgtgggagtattgcaaaaacatagtatataagcgtaaatcactatataaagcccaaagaagttagcactaaagcatcattcatcgttcaaaactcctctctcaagtgagagaattcggcgctgaaaaaaagctttgtcaaaaccaagaaaaaaacgtaggattggacacgaggttctttttttaatgtaaacaagaagtggcactatagctgtgaaacttccaatacaattgtataccaaataagctattacaaattgatttaaaatgggtgtcgcagatttgatcaagaaattcgaaagcatctcaaaggaagaaggcgatgctaccgttgatacaaacagttcatcaaagcctctcaaatcaaacgatgaaaccaaagaattgcatcaacaagagtctactgctgttccgcaagaggttgacgtaaatgaagagtttgagaatgaaccagaaacaattaacagtagtagaactgctgagaaaccattggaaacaaacctcccaaaacctgaaactaacgaagaagacgaagaagagggctccatgagcgagaataaaatatattctaaaggtgaaaatgctgacatcaacgttaatgattttcaagaatataaagaaatggaaaatactggcgctgaagttcttgcaagtagtgttgaagaatccgatgctattcaagaaggtgtggctgaggaaactgaagggattgctactcctaaacaaaaagaaaacgaaaaaaatgatgaatcagaagaagaatctgcaaataatgcatctgaaccagccgaagaatattctcaatctgaagaagatgctgacatcgagcaatctaatggcaaagaaactgaaaatgccgaaaacgcttctcaacaagctaatgatggctctacaagtaccacgacttctaagaataagaagaaaaaaaacaaaaaaaaaaacaagaagaagagaaatggaaatgttaacaccaacgctaatgtcgacgacagcaccaaaaccggtgaaaatgatgatacaaccggcgacaccacgtcatcaacaacctccgccattcaagaagtgaatgatttggaagttgttgatgactcttgtcttaggcattgatcaacagcataatagggagcatttgaaagcgttaactcaggacgttaaagaagagacgttagagaatattgcgcacgagggcagaggtgataacacaggcgatcagaatgcagtagaaaaatctgatttcgaaaaatcagatacagaaggttcaagaataggccgcgacttaccctttgaatttggaaaacgtaacttgaccgaggaatctgacgtttgggatcataacgcttgggataatgttgagtggggtgaagaacaagtccagcaggcggaggaaaaaatcaaagagcagtttaagcatcctgtacctgagtttgacaaaaaactatacaatgaaaatccggcacgttattgggacattttttataaaaacaacaaggaaaactttttcaaggacagaaagtggttacaaattgaatttccaatcttatacgcatctaccagaaaagacgcagaacccgttacaatatttgaaattggctgtggggcaggtaacacttttttcccgatcttgaaagataatgagaacgaaaacttgaggataatagccgcagattttgctccaagagccgtcgaattagttaaaaattctgaacagttcaaccccaagtacggccacgcaacagtatgggatttggccaatcctgacggtaatttacctgatggcgtcgaacctcattctgtggatattgcagtaatgatcttcgtttttagtgctttagcaccaaaccaatgggatcaagccatggataaccttcacaaaattttgaaaccaggcggtaagatcatatttcgtgattacggtgcatatgatttaactcaagttagattcaaaaagaacagaatcctagaagagaacttctacgttagaggtgatggtacaagagtttattttttctctgaagaaaaactaagagaaattttcacgaaaaagtacttcttggaaaataaaattggaactgatagaaggttgttggttaacagaaaaaggcaactaaaaatgtaccgctgctgggtacaagctgtgtttgacgttcctcaataggaagttctgagacaagtaccacctcctctctcatcataaaacaagtaaaagttttctcgtcgcgcatattattttggtgattgattgttttttcctccgatatcatcacttattacctgtaattttatctttttctaccccatagaattcgtcttataagtctataccctcaaaactatctatcattttaatattatctgtcgctttaattgtcttatttctgaagctcactgaagaacattgctttattatgcataaaggaaaaaaaaattaccctaatttgattacttcgtttcggatgaatttgaaaaaaatcatattgaaccatgaccgatttagccatccagaaagatggaaaacaaacgcactcttaaggttcaccttcgtgtatataaaatttctcttcgacttgatgataatcaaaaatccattaaggatggttggaaaaacttatcgagacgctgttactgcgctaaactctttgcagtccaattatgccaacatcatggctatccgtcaaactggtgatcgtaaaaacactatgacattattggaaatgcatgaatggtctcgaagaattggttactctgcatcggatttcaataaattaaatattgttcatatcactggaacaaaaggtaaaggttctactgccgcatttacttcatcaattctaggacaatataaagaacaattaccacgtatcgggctatatacgtctccacatcttaagtcagtgagagaaagaataagaataaatggggagccaatttctgaagaaaaatttgcgaagtacttctttgaggtttgggaccgtctagatagtacaacctcttctttggataaattcccgcacatgatcccgggaagtaagcctggctatttcaagttcctcacattgctttcatttcacacttttatacaagaggactgcaaaagctgtgtctacgaagtcggcgtcggaggtgaattggatagcactaatataattgaaaagccaattgtctgcggtgttacactattaggaatagaccatactttcatgcttggtgatactattgaagaaattgcttggaataagggaggaattttcaaatctggagcaccagcattcaccgttgagaaacaacctcctcagggattaacaatattgaaagaaagagctgaggagcgcaaaacaacgctaacagaagtacccccatttaaacagttggaaaatgtcaagcttggaattgctggcgagtttcaaaaaagtaacgcctcccttgccgttatgctggcttctgagatcttgcatacgtccaatatattggaggagaagatcaaatgcagttcgaatgcatcgattccagaaaaattcataatcggtctacaaaatactaagtgggaaggcagatgtcaagtactagaaaagggaaaaaacgtttggtacattgatggtgctcacaccaaagatagtatggtagctgcatcaacatggttcagagatatggttcgattgtcgaagagaaagaagatcttgctcttcaaccaacaaagcagagatgccaacgctcttgtgaataacctgtactcatctgtttcgccagaaataacgttcgatgatgtgatatttactactaatgtcacttggaaatcaggctcatacagcgctgacctcgtttccatgaacacttctcaagaagatgtagaaaaattgaaagtccaggagtcattagtcaagaattggaacaaaatagacgataatcgtgctaaaacgcatgtaacggctagtatagaggaagcaaatgaattgattgaaacgctatacgatgaacctgctgatatatttgtaactggttcattacatcttgttggcggattattggtcgtttttgatagaatagatgtaaagtaatttgaaagtaacttgcactttaaaaatcgtacataatggacttcatttgcatttatttatttgttgaagagtaatttagttatcaacttaaaaattcgtactacaagtcaatgcaaggctggtctgtaatatctttcccgtaccatattgtccatgttttaaaatatttattatatagatatgagcccttttgttcgtattcttccatagctctcatagcactggaaatatcgtaaaagaatatagatacgcataattttcttgatacaataggcgtaatttctagaacctctccaaaattctgaaaatctttttctaattcttgaatatcaatgttttctaaagtttgccctttattcagatttgatttgttaggcattgctgttgtcgagctttttttcactatcaaacatcttgatatgaacttttcctcttctattattctgttgacagattgctctttcattatgttttcatatgtgctctcgaggaatatccattctggttttaattgaactccattaactttaaaaatatttgtttttgcgtatctcataaaagattgagctccctcgtaatttaagaagaaaagatcaactttatgcaaagaacgttccggagtatcgtacctatagacaataattctttctaaggaacctccgcgtacttgagacaatacactagagatgcctgtgccgcgcggtatatcgtttaatgaaattgatcttgttttgagaagagcgggattctgagaacctgccgttttctcatcaacaacctctgattcttctgaatatacttttcccttgaaaattaaatcctgattaacgtattctccattctcataaaatttgttgacggctgcttctgtttgcttattactgtcatcatctatgggaaaaaaacaaccctgtgaatggtgctgccttttccaaagctgttgatcgtttttatcttctttttttaaacgtcttttgtttacatttgccccaactggtgtatatgaatctgtaccacatgaacctatctcacgaccaaacagatatgcttttgcaaatcgtctaaaacctatgaattcgtttccattcgaactagacgagtcattgaaaaatgaaaaaaaagatgatcttctcgatctcaaagctttcttcctcaaacttccagagtctttatgctttttataaacttctgtgtttgaataatagttcttgtacatttgaccggattaaatgcttcgtattttattattattttaccttcgttggattcccgacttcaatacgcgagaatatatctgtctttttgtttataaaatattgatagctacagtataataattttcctctattaggtccttcttgttgagaaacgtggttgtatcctttgataagatatatctagaaggtgttgtttatatttaaaaaggctttatctttgtgtgcgatgcgcagatacatatttaccgacgcctgaagtgacacgacacggacacaacaatagtgtatgagggaaagagcttccgacaaaaaaagtaaactaatatacatgaatattgcacctcgtataaccttagatattctccttaacatcacacatgtcgccacggcgagaagtctcaagcttcatgagttcacgtaatgccatggtggcatatgcggaggttcctaattgaaattttaacaccaccgcagtcttctcaccgcctttatctggcatatatctgtccaacttggctttcatatacttctggccgctttcttttgctctggtgttattcaggatgtccaaatcagtgttcaccaattgttgagaaggatcatcatagtgaattattctatactctaaactctttggcttttgaataacagttctataagagccagccaatgaaaaatcgcgaacttttcttctcatattaaatgggtccatattatctgctttcaatatatccacatacagttgcttcaattcttcgttggaaggataaagcacatcaaaacccggcgatggtaacacgacatcttccatggtatacttaactgagtcgatatcctcttgagttactgcttttgcacgaatgaactgagcttcacggacatcttcatcaaagtcttcatcgtcaatcccagaaattagtggtgacttttcactagtatcaatgacaaggtcacctacaactaacttcaaaccatgtagttctatccgcttactagcaatagaattccagacgtaactttggtaggcatgtacatacatagttctcaaatttctgggaattttcataatagcagtataataagcgttctcagaataagttccatcttcttcttttctttgattagataaagaatatagtaacgcattttctgcgagacactgtcttggcatctgcttcaatgctaaagccgcgtccttagtttctgcccaaatcttcctagcttccttagatttaggaagcacgttatcctggtcagataaaatcaactcagcagccttcttccagtttgaaaggagcaattctctaccaattgtgtgcgtagaaatactgaatgtaccgaatctctgcataccaaaataattgataaacccattttctgataaagacttacagccgttagacacaatttcttccagtgatacctcactattgccggtggtaacatctctaataacaacaacgaactcatttcccttcaagtctcccagattcaaacttgcatccgaaaaattgtaatttccgataatcattccttttaaagtcctatttaaagcatttagtctatccaaaccaatctttgaaatcgaaaccctttggcacgttactgctctacgatccttagtacctgcatatctaattacacggcttggaactcttaacaactttgttataacattgacagcttccatagtatccttattttctttatgtagagtgaagtgaataaaatctttactgggaccatatccccaattttctacaccgttagcgtccctggtttggttaattttctcttgtttattggttcttgaatttctatttgatcttgcaatcttaaaagtgttagtatcagtagtcacagattctaattcatttttaaatgcctcacgtaacagttggtgaattttagttctaacagatttatcttcgaaattttttgccgtttccattttattagccgtgcgataaacggattctattttcaatacatcttcctcaccaaatatctccaccaattgatttcttaattcggggtcgacgttgaattcttgtcttctagctgcttcagactccttttctgcattgacctcttctttagagcgttgtggtttctttggcattttaaatcctttatcagttaagtgaatgaccttaccttcttgatctatttcgttgaccaaaaagtcagtataacgctgcttaatttggcctctaaatcctggcaattctggagataagaacaaagtaataccgacatctgcttcgtgaataccatctgcctgagtacgttgctcaattttcaacttctttgcagcattttcggaaggtcctacgtgagcatcaaggggtctctttacagtggcttctgaggagtcagacatggcatgcaacagatattgcttttttccttgggaaggaacaacgtgattataattaatcgatgagctgtacctattgactatttcatcattattataatgatggaaaattttccaaattactacccgcccgttgaaaagatgaaaacggcttccggcggagcaaatgcaaaacgaatattgctaaaaggtgtatattattatagtaatcaaaggagaatagaaaagagctttaccattctttagacgcttcctgtgctaccattctcggaaatactgcaagaaatcatcgatgtcccatgacggaaaagaagaacctggtattgccaaaaagataaactcagtagatgatattattatcaaatgtcaatgctgggtccaaaaaaatgatgaagaacgattagctgaaattttatccataaacacaagaaaagcaccaccaaaattctatgttcactatgttaattacaacaagcgtttagatgagtggattaccactgacagaataaacctggataaagaagtactatatccgaaactaaaggctactgatgaagataataagaaacaaaaaaagaagaaggcaacaaatactagtgaaacgccacaagactctctgcaagatggtgtagatggtttctcaagagaaaatacggatgttatggacttagataatctaaatgtacagggaataaaagatgagaacatatcacacgaggatgagataaaaaagcttagaacctccggctctatgacacaaaatccacatgaggtggctcgagttagaaatctcaatcgaatcattatggggaaatatgaaatagaaccatggtacttttctccatatcctattgaattaactgatgaagattttatatatatcgacgatttcacgttgcagtattttggatctaagaaacaatacgaacgctacaggaagaaatgtacattaagacatccgccaggaaatgaaatctacagagacgattatgtttcattctttgaaatcgatggtagaaagcaaaggacttggtgtcgaaacttgtgtttactttccaaacttttcctagatcacaaaacattatactatgacgttgatccgtttttgttttattgcatgacgagacgagatgagttgggtcaccatctggtgggatatttttccaaggaaaaagaatccgcggatggttacaatgttgcatgtatcttaacactaccacaataccaaaggatgggatatggtaagttattgattgaattttcgtatgaattgtcgaaaaaggaaaacaaagttggttctcccgagaaacctttgtctgatttgggtctcttatcctatagagcctattggtcggacactctcataacgctattagtggaacaccagaaggaaattactatagacgaaataagctccatgacttcgatgaccactacagatatattacacacagcaaagacactgaatatcctgcgatattacaagggtcagcatattattttcctgaatgaagatattttagataggtacaatcgacttaaagccaaaaagagaaggacaatagaccctaatagactcatatggaaaccaccggtatttactgcctctcagttacgctttgcctggtaagctatgtagtgctttcctaaacttacattcaaacaacttctaatgtaaaagctttaaataaatgaaatttacgtaaaacaatcactaatattcaacgagaactccagtattcctgtaagttaatactcttacttaagatatacagcccaaacactaaaaaatccttatttattctaacatattttgtgttttccaatgaattcattattacccaactatcttcaattctgcatccggtaccccatatttttctctattttcgtaatatagtcttttcaactccgcaatatacaaatcatggaaatgattaacaacatcatctggcggatttgttattttcttttcaacgtatataggccttccaacaacaacattgataggcgctctaaatggcaacaaaccgaaatcgtaattgaataatcctcttgcgtagaaaatgggaatggtaaaaccaaagttttctttgaaccatagttgcattttacccaggactgaatctttttttgtgctcagaacattataacagtccacctctccaaatgcaaacacaggcactaggttaatattccccgtttgaatggccagtttaataaaaccctttcttttgtttaaaatcagttgtgtaccatttgttgaacttaataaagattccctagcgccaccaacaacaatgcagatcgactgatttttgcttagagtccttaaagcgtttttccgagatactgaagaaatacctaacgccaataagtagtctctatacaatgggatatgaaattgtgtgaccagtgtcatcagagaaataggaatacctgggaaaatcttggaatagttacaaccttctgttgcaaacgctccaaacgcaccaagtgctcctatgccgtgtggatggtaaccaaataagtacgttggccctgtacattcctggttgcgatagtcaatagtagagttgcttttgagattaatggaatacttagttggccacaatctaatcttgtaatttttttcgttaactctcttattttttgaaagcgtaaaagttggttttaaattgacagttttaatcaaacttatagggaaataatcacaataccacttccaaatgggcaatgaacgaaatcgaagagagtatcgatttaccacttcgccagttgcaggagacctatcgaaaaaaaaataaatcatatatggaatagcaagaacccacagtgctggtgtcgagattgcaaataacgtaaatatggagaagagtacaaatgaagaagtgtgccatgctacagccagagtttgtaaccttctttcaaaaggggtcgccaatggacagcatgactctagttgtggtttgagagtctgttctcttttatcgatgcttgacaaagacttattctcatgcctttcggtaataccggctgtagggcttccttcttccttcttccttcttcttatatcattgaatgttcctgacatttatgtgactgttcaaactgtatgcctctgcgtttccttatgtatatgtaagtgtatgtgtaaatggaaatgagatgatagtaaacctccttaatggaacaaacgtgatctgggataaacaggaaaaaaaaaaaactttggcggaagtgtagtgaaagatccaagcctgatagaccactgtcgtgcttggttaagtacagaaatgcggtggaagtactggtctgctttgaggaataagtttccaaattcagtcttctctttttctagccttcccattacgtcaatgctgactgaatctatcaattgaataaaaaacgcacatcataagcctttgtcggcccgtaacttagttgcctgcagagaacaaagtacagaaaaacttcttgctctgattaccagttacaataacgactaactaatatttaaataaaatgtacatctatctactctttcaatctttccgtcttgttatatatcgaaaccacggtctcttagttgatgaacggtccagatccaagtcgatgccgcttcgtcgacattgttagaaacgtagctcgatttagattctttaccccccgtggtgaagtacttcccgttatctttttcgacagataaattcgggtccaatgcacacttcaaagaagctagtgaaccttgttcgttcgatacgccgaaaaagaaccctacgacctggaacaacagccaaaagaaaataccgacgatgggtaaccttgtccaataactgaataagtttgtgttcatcaccagacccggatgaacggagagacaaagaacgtcagggtatttgatggccaacatcttcgtgcattggattagcgcggttttactcatcgcgtacctaaaccatgtgaaaagcatattaggtttgtaatcccacgtcttgctcagtttccagtacatgaactctagatgatggcctatcgaggacagggaaatgatcctgccacgacaatggcgcagtaaaggcaataatctcatcgtgaagatgaagtgcgaaatgtagttagtctgcaattgcacttcaaatccgtccttcgtcatttctaagggcaccgccataatccctgcattgttaacaagcacgtctatgtggtcttccagcttgagaattttaagtgccgctctctccacacattttaagtctgtcaaatccaaatggatatagtgcagtgaccctagacgctgaatgcttggacctgggcccgcgcctgggcttgaaccgtcgtcatcttcatggcacctcttctttgcttctgccagtatctcctggattgctttcgaaatcttgtgagagtttctcccacaaatataaacgacaaacccatgcaaatacaaatgcaagacagtataccacccaatacccgtatttccgcctgttactacagcaatcttcctctccacagccgggtcgtagtatggcaatattcgtgggtctaacattctgcctttggcgtatgtctcgtactgcggatgcctctaataccaatcaggcctacaaccattgtcttccccgtttctacaaagacaatagtgtgtgtgcattgtaagtgatgcatcatgcaccataatgatttgtttatatatacccatgtacacttgggtctcatttcctcaattttttcatatcttacccgcatatcttttctttcaatgccctacttctatacttcagggttttccaaaaaaaaacagtgattaagcagggcggcattttctttatcttggggcttagaagacgcgaaagacctgtggctcaatacctttttcggaatatgtcaacaacacgaaacgccaaaattcttggccctgattcaggtaccgcgggggccacgaattttggcgttctgtgcaggaatgacgtctctgccgattatgaaactaaacaaggtatgctatcggaggtggtctgagttactcgacagatttttctgacgagagtgagtgtcgttcgagatatttaagctccaaaatatttccctcacctagcttacattttggtttattctttcttacctctacctttctaagtttttctcttctgcttccttttcttttcacttggcatattttatctataaaaaagttttgcaagcgtttaagcaactagtttagcacaacatccaaccaagaggtttctcgcgtatttctctcatttttttacccattttacaaattttttttgctatttgagccatagtacccattaataggtctcgtccattcccttgttttttttttattgtttcaattacactacataattaaaaatcacatcactttcactctcaccttagtcgttctttatcaaccaaaaataaaaaaatgcttcaatccgttgtctttttcgctcttttaaccttcgcaagttctgtgtcagcgatttattcaaacaatactgtttctacaactaccactttagcgcccagctactccttggtgccccaagagactaccatatcgtacgccgacgacaccactaccttttttgtcacctcaacggtctactccacgagctggttcacctcaacttcagccaccattaccaatgcggcctcctcctccttgtccacctcttcggcctctggatctgtaaccccagaatccacccatgaaattacctccacctcgactatcacgtccactttgctgctaacccttcatgactccactactttgtctccatcatctactgcagcaagtgtcagtgacgaagattcaaacaacaaagatgcaaaggtcaagtcctttgaacaggcttcaacttccaatggttgcgtcccaatcacaaagtttgtcactgtcaccaatgagcccgttacccagtacgttacagtcaccccaaatacgactacacaatacgttactgtcaccggtgcaccttctgttaccactacctctccaggtaacgtacaatggtacaacaccacttcgattactaattcgaccagttggtgaattatgagttcaaacgtgtccttttaagttctttttgtttcttttttgtatctgtattgacaatttcaccttctgtaactctatccttctgctacctaaatacatcagtttaagttccaactggtatttatttttcactatcatttttctctcgtttatatatatatacatggacatttgtttgttaatagaaaaaaaaaaataaaataaaaagacacttcacctaatttgctttattttctaagtgcagctataaatcattttctttgctcacaaatgattgaggtgttgtgcttatacttgcacccgttagagagttacagtttattatgcttatttaatttatttgctttatatagttattgtcaagtcatctgaacatccctatcctcttcaacactaagagattccaaaagctcatctgtcttcttccttacaaatgggaattctagaatggttgataggttacagctgatcaagcactctgcctccatactcttccctacctgaatcaaaacttcacataatttaagcaataatattacacatcgcaaaggatttcctatctctttgtattcgtcgattaattttattatcttcggcaaacttcttatccctacgtcacttaaaagtaaaacattgatactttcaatttcaaatttgaatctccagttcgaatccgccacttcttcacagcactccttgacatattggttgattaatcgcatgcttaggtcatagtcacctattttaacgagatacttcactcttaaatatttcaaatttattttttggtcgtagtctagttccagtgattctgatttcaaaaggtattgttttacttttaaaaaatcgtcttcttcaagtgccttgaaagctacctttatatcttggttgataatagaagagtcgtagttccttaaagaggaagaggatgttttagacaggaatttctcatatacatcggatatggattcgtatcccagttctttccaaaattttacttcatagctaacaagactttggaaaagatcaaagttttgagaaggcacgttctgcaaagtgatagccatgaatttcagaagtgaactagaaacttcagcagttttcgattctttgaccatagataacaatgtttcaaacttgtaggcgttactgaaaatattggcatcttctacatctgaactatttttcagatattttattatttgttctactgtgatataaaatctgtttgcatattccgggtgcacctctatgaagtttattatccatatcattatcaaattcaacgtttccatatctttattttcccttgcgattctcgtggcttcctcaaaagaatttatcgctgcatcacactcattgaaacttgagtggaaggtggcaagggacaacaaggagatatggaagtaattttgagaattgcccgtggacttgtaatcaaaatagttatgtagagaatctagtgcggtttgataactgttctcttttatagcttcgagatactttaatataaaaatcaaagggaattttgtggcatcgttcaatgaaagcgtatctagcaaatcaaaaactagtccgctttgttcttcatatgtggaactagtttcttcttgacccatcagattaaattctgtattatctaaccaattcacaatttgtcgattaactattgattgtaaatgttggatggaaatcaatgtcccataattttcttcgttcattgtttttgaatcagcgtcattaccattattgaagtgttggaaaaattccaccatctgttgatcctccaccgagatctcgtcgttagccagaagacagttttttaccttttgaatatgaacgttatctttaaatcgtagccatagcggagtatgcttaaatacagttttgaaattttgtagattaatccagattgtctccctcatttcaaaatcaccaatttgatacttgcgtatacaagttgacaaaaatgttcctaaaaaactcgctcttgtcatttgtcttcttgttgatgttgtacgcattttcattgacctgtaattattaaccaaacagttcttttctaaatccatcattagtctgttgattgaatccagtccattaattgcttccaaatagcccattaatgtcagagctattttgttaccatccttgtcatctaacagtatccttattatattatctagaataggaagtacaggaggaggaacaatagatgaagatcttaaattactattatccttgagcagaggattccattctagtgaaggtctagtaggggatattaaccgaagaaatactgctgttggcactgatatgccattatcttgtgagcagtgagcatgtattaggattaatatgcatagatcgtacggagtaataaagttagtaatacccaatggaccatacttactcatttttctgatcagttttgatttgccttttccttttaactctcgtcgttttttatattcctcgatgaaactgcagcagttttttagctagcgcaaataatgtcaaagacacaaattggcaatattgttaatatataagcgttggaaaaattaaaaataaaaatcacccaaacaatacttcgacagtacagtacgatatttgtatggatttgatataaggctcttgaacagataattttacttactctaaatatctatatgaagttagaatcatcgccttgctgggaagtcggcctgggacaggtagtaaaacccttaatttacgccttttttcattaacttctgtaatcaaagcgaatcctaaaataggcgattttattactgttgcctgatctgcccttctttctgcgaacgttatggctataatagcgtgctgtaggttacttggagttatagtgacggggaacagttccaccctaccgacctcgttatcgaaaacattgctaggtttccaaatagttaaatcctcataatcaacaccaatagcataaggactcaaggctgtatcaagagagccgtaaaagtactctcttatggatgtcctctgcaaggatcttttgtatacatcatcaactgcggatacaccatccaatttaggaatgaaaaaaatattattatttcccaattctggaccaaatgtcttttttactttctcccaaagaggatccgtttcagaacatagtactagcataatgttaacattgagtttctcaatgatatggtgcagttcagccaaattttcatccagttgtgatattgatggcgtatcgacaatgcaccctgatctcctgacttgaggatccaaatgtaacctttgacctactacttgacctaactggcttatacactcaaggtatagatctttgttctcattaatcctttccaggccaaaatttttcaccattggctgcttattatgtagtagtgtggcaccactagtgagactctgaccccaagtgggtagttgtgcatcaagtatatctgatattggggtggcagatatgcatccaggaacagtaaaaatgggctgttgagggtcaagattgatgtatagtggttggtaagcgttgaatttcaaagcgtaagaacatagtgtcctcgatagggaagtcttcccggtttgcgaaccaccaacaatcaccactcgagggccttcaaagttagacattcgtatcttctccaacatgaagtgtagattataaatatatttcatagtatggttaggcttgacagttattgtattcgtagttaaatcaggacatttccataataattctgtttcttcgacagcgtatatgggaaacttccagttctgaaaagtgtactcatcatctactgccaactcggtgccaaatatctcaactatgcccgagtttaccttgactatcagttttccctctgctttaagatcaatttgccaatcactgcccttgggaataaccaacttgtgccattcgttatcaccagttatcaattcttcagaggtagtatgctcatcaataccaggtagacttgccatgatggtttaatcgtgttggaatttcgaaaagaattaatagtttgttcttttccctcgatagaaaggtctctgctcatttttgccagcagtcttattttttgctgttattttctattttaccgggcaataacaatgaagagcacaaataagacaaagaaagggagatcgccctttaagtaagtagatagataattaatatatgtagctaaataaatcgacttgtcaagaatatatttctcttattaatctctgttttcagcaatccactcgggcccggatttcaagacccactcggtccaggatccatcatataatctaacattgggaactcctgctagctccaatgctgtcttgataatgactcctgaaacgccagttccacaagagcaaatagttggtttacttgggtccaaagtgcaatgaaagtctttcaatgccttttccaaagtagcgtgtatcgcctccccagcttctgggtacgttttggtctccggatcaagtaaacttccatatggtaatggttgggtacctggaatatgccccgatggaatgtcggaacgaggctctggttctgtaccttcgaatctaccgagcgaccttgcatcgaaagcattgaatttcttagccagttccccactctttaccaattggaacatttcctcatagtctacaatctccttgtcttggaaactttctgaggactcataatgactctttggatagggtgaaaacgctgccaccttagaggaatctagagggtacttaaactctctgtactggttgaaattatttagtaagtacaccttaggatgtcccatcactcctaatgtccaagcacatctaggggagctaaagttaccaacacgatcgtaaaccactaatatatcatctttttgaactcctaaattactcatagcgtcgtcaaaaaccttctttgtagggaacatatgtggatagggcgattttttgtcactgattgcatcaatatcaaagaaaatggagtttggtatacgtggtttggtcaagaaatccactttattatcaagcttccaactgggtaggtaccatgttgcatcaactggaacgattctatgaaccttctcactggccactaacttaacaaacgcttttggagaaataagatcaaataatggcattgaatgtatgggcaattttcttcacaactttatgcttttgtcctcattgtttgaatgcacttacgctgtattattgtacacagctgaacatcccgagcgaaaattttaaaatggtttaatagacgagatgagagatgagctctttaaaggtactttctaagaagaaaagtatcggaacaggacttaccacgacaaactaatcatgccggttactaaatctttatctaagttgcaaaagaacttatccaagaaagggaaaaatatcacggttcatccgaaggtagaaagtatgaaaagctggtcagggctactatgcgtgaagataaaatcgcagccaaaaagaagcttcatcaagacaaaagagtccacgaactagctcgggtaaaatttatgcaggatgtagttaactctgatacattcaaagggcaaccaatatttgatcacgcccacacaagagagtttattcaaagttttattgaaagagatgatacggaattagacgaactcaagaagaagaggaggtcaaacaggccaccaagcaatagacaagtgctactgcaacaaaggagggatcaagagttaaaagaatttaaggcggggtttctctgtccagacttgagtgatgcgaagaatatggaatttctaagaaactggaatggcacttttggccttttgaatactctaagattgatcagaattaatgataaaggtgaacaagtcgttggaggaaatgaataagaagtgtcgcagaggaatctttatggtttatatgctctttatataattttatgtatattatagtagaaaaagcaaagaaaaaaaagaaaattgatattattagcgaagctttttcacaaattaatccgtaacaaacaaattggcaaagacaattgaagggagtagtgcgaaatatgggccgtgatatatgcacattagacaatgtttacgctaacaatttgggcatgctaaccaaactagctcatgtgacagtaccaaacttatatcaagatgccttcttcagtgcattattcgctgaggatagcttagttgcaaaaaataaaaagccatcttcgaagaaggatgtacatttcacacagatggcttattacagtgaaataccagtgggtggtttggttgctaaattagttcctaaaaaacaaaacgaactatctctcaagggcattcaaatcgaatttttgggcgtgttgcctaattataggcacaaatccatcggttcaaaattactgaagtttgcagaagacaaatgctcagaatgtcatcaacataacgtgtttgtctatttaccagcagtggatgatcttacaaagcaatggtttatagctcatggcttcgaacaagtgggcgaaactgtcaacaatttcataaaaggtgtaaatggcgacgaacaagatgctatcttattgaaaaaacacatttcttaacagatggctgaaaaattttttttttttttttggttttgctttgtatacacatgtatctatttttataaagatgaaatatatacgtctaagagctaaaatgaaaaactatactaatcacttatatctattctggtgattcatcatcttcagcttctgtatccgtatcgatatcagtataatcgctagcatcactttcatcatcactttcggtttcgtcgtcatcagtagagtactcatcatcctcctcagaatacacctctacttgttccactgcaggagaatcacgaactttcatattcatggtaatatccaaatctgtagtgaaataatctgtggatttaacgattactctaaaaaagaaatcaccaacagtttcaggtgcaggctgacctaatggaatttttatggtcccgatttcccaatcatttatatcgaatttttcgtgtttggttaaatccatttttatcctcttatcaaagaaatctttgtcatcgttcaagttcttgtaagatagcttttcaatgataattggcgtttgaagtattttaccatctttttgagaacttaccagacagcaccaactcccacgtctctttgtagggaaaaatggtgcaaaggaatatgggacgagtggctgtttactcatcatagcaaatggatctctttgagattcaaaatcttgaggttctgttaaattttcttcaggaattaagctagttggtatcaatggctgtttagcagaacgaaccagtactttcaaagaaatgtatggggtagatgatggtgttacttggttctcacctgggacaaggaagtctgccttgatgatctttagatttggaatatgcgatgcaactctcaaagtttcgtttaactttgcttgatcctttattccaagaacctcaccaatcttggcatcttctaaagtaaacaatttacctaatgtatgaatatctccggttttggtaataaagtgctctttatctacgttcggcaattgaaggatttgacagtttggtgttaatggtacagcctgaacaatacacttgaaagtattgattgcacccaatgcaatatctaaatttctgaatccacaagcaatatccaataaaccgtgtaacaaagagtgacatttggccactattctaaatttcgcattgttaagtttaccactatctctgcggttaatatgatcttgcaaaagtttttcaaaatccgttggttgcaaatccgggaagaattgtttaaattcatgagcaaatgataaccagtgtaagatcaaatctgtggtgacaatctcagatggcttgtaattgactaagttactaacaaaattagaagccgtcacattatgtattcccttcttagtatacgattgtgttcttgcccaccatctactaacaaaatatggcaagattaaacctagtagcgcaacataacaaaccactaataatggagatgcacttccatctaccaaaaatcttggtagagcgataccatgtgaagtagattgtgggccatctggatgaccgtatttcaaatagttttgcctaaccaattcgtcagtaagggattcgtaagccttcgtaatctgaacataagtttcttccatcacacttttctcatcaggtgttaggccctttgctaatttatctggatgaaatttaacagataattttctataagcagatttgatgtctctatcggaagcactagtagagataccaaggatttcataaggatcaaataattttgtagcagcgtctttaatcgcgtcattactattaatcctttgcagaagaattgcaactaagatccaacccacaataattataatatttctcctgctccatattttggacttcttattactatttttatcaaacttccttctaaattgtttgatttcatcactggtgtattcttcattcaagttcttgaaaacttcctcattaaactccttactcttccctgaattcccatcttcagcattggccccaaaaaaaatttggtatatttgaagcagtgtcataggcccgacgaccatcaagagccccgttaaaatgaaggacggccacgtctcactagcctcatcatactcgtaatttgtaggcattgtgctgtaatatgcagtatatttattttgttgcgaaggccttctttggtcaattataactgactattgttccagtcgcatcttttattcgttcagtgatcttcgacgtgttcaagacaaatttttcagaaaacgcctttccgtaacgagtgaccaattcgcgttataagagcgattgtgtcagtaatgaagtcagattgtgacattataaagctaagacgttaataactcaaaatagaaaagaagcatgagagcaccaccttcaccgagaaagtccaaatctggtcattttttttacctatattttcgactgtgtcaactgttcagtggccggaaattaaagaggaggtggcatgtccacaaacttcacattcaccaatataatactcgctggaacttgagccccctctccgaaatacacattgaggacatgataaatgaaccgtctggactatgtccaggaagttccaaaaagaaaccactactgattgcaaggtttcccaagggttgccaagaatcaccaagggtatatgtactgcaaaggaacaatttgtctcgtttaaaattaagcaaaagaaaatatgccctaaggttctatcacaatgaaatttttggcaataatttaaagagaaaagacggaagcatccacaaagttgaacaccaacagtgcgcagaaaccgttagaaagatcaagaaagtcacagcaaaccatgctgatgttaaaataatatttcacgataaaaatactataagaagtgacaaattagggggtaggagtaataagatgcagactaggcctagtgttcttgaagaggatgtagaagaagaagtctcttcggtatatatcagattttgtgacgaccattccctgagagttaaagattatcactctttgcacaggcattctaaaaaatcttctaaagaaaaacgaaataatcaggagattggaaaatctaagttgcttgggaagctttttgaagaggaaacatcgcgtcaaaacaaaggtgtagagaagaaactagatacgattgtgatacagaaatttcaaaattatcctattgtctccttctctcgtgtcatttaacaaaaagatatatacaaacataggatactaagaggaaaagcatcccaaaaagaagaaatgcttgcatgccatgtattacataattaaagaaaaattttattaacatacttccttatacttacaatatgtattctttcagttcaatttatttatacccgatgtcattagtctcttcgacaaacaatgcagcagactgatggagtactttgccaataaggtcaatttgttcttgagccctcttccagtcatcatcgtaaatcgcatccatcactcctggaaatgtccagaaatctacatttccaccatttttagatttatcctcctgtatcaatgttggtccgaacaaaacgttcttataaaatgatctattaggtagacccgccggagagcatgttcttctaccaatattagtcaattttttattccatgtccacctattaattgaaagtaaggagggctctataccatccccatgcgaccatactatgttctcccaaccttgagtccatgacgcccattcgctaccgattttcttccaaaataacaaacctttgattattgatgtgaagtttagtttttcagggtatgcttgctctaacctttgcaatctttcatcgatatcttcaacatagcttattatgtcaaaatgaagtagcgggtcatcaatcaattccatactaatatgtaaaagatatactagcaaatccttgacagattgttggttctgttcgtcttccagaatcttctcaacacgttcaaatttatcctcagatgtttcagttggggtgtcacggtttctcgtagaatcagaagatattacagatacaggaattccatttgccagaaatggagtccagtcaccatagtgctgtacattatccacagatatatcaaagtttccatgcgcgtttctattgaaaaacttcttcaataagggatgtgtctcaatgcttaattctcctctagttttaccgttctcatatttttcggcaaagggtatacccagttgactaatatcaatcaaagaataaatttcgtcttttaatggcgttagcctttgctcaaccagctccgaagatccagcataattaaattcggtaccaccgaatgagatgaaatagatatttctcaaaggtttccaaccaaacttatatttcacctcttggaataattgaactatagataataatgcagctgtaccaaaattgggataagtagttccaaaattgatggaatttctcgatgcagcaattattatagctttgtctgattgttctctcccttcaattttaccaacaatattaggaataaaatgcttttccctaacattagtttgcagatctacatcgatcaatacgtctcccattttcccactgttactacgatcactattaccatcatcaaccgttactcctcctgaagataaacgcgatagtagctcttttccttgtctcgtggagattgggatagttggaatatgagtttgacgccaaaatttatgatccttttcttctacaggagaaccatcccaattcaatcctgatgcatcaccagtcgaatattggggcaatcctacaggcttagattgaacaacgtctatattctcaccatatggctcagatatgaagattacagctttagccccgaatttctcagcaattagtacttgctgactcactaatttatcatattgcagtaaaagcacatagtccttcccatcttctatcgttttcgaatcttttaaatgttgtaaatcgtatgttgtacctttgcctccataaatcaagctcactttggataatttcccgttagaactcaacggattgaaattttctttagaaagttctagatcatgcttttcattcttgttatcataatatgaaattgatacattgcctggataattagaataaactgagtatcccatttctttaaccaatttcaacccattgttgtcaaaagattcctgaatgtatcgataaatagctgcatcacccttcgttccggatccatgaggcatgctactaatatattccaaatctctctcaaactttgccaaatccacggattttttggcatattcaaaaagtatatcgtgttgagaaaacatccctttagatcctgatgccttttcgttgaataagtagccacttgacaagacataatatgcaataaatgacatgaaaatgatgtaaaagaaccttcgaagtataaagggatttccgattttacttaagtaatagtcagctttgtctggaacgaattttgatatttgtaagagtggatgaatgatgttttccattaagggttccaaaattttttcctgaaacccaattgaaaccctctgtagatgtgttcttttgtgaagatcatcgtgagggtcctctatatcaaattcataagaaggtggttcaggtggaggcgttatattagtttctatactgttgtcgttagaactaggaggagaatcatcaaaacgctggctcatcaacagattatgggacgacgacgcagtaggtatagcattttcatgttcaaagtttgtagttgacactggttgataactgctcctcattaaaattacttgatctcaatacccgggggtattatcttggtttgcaaattagttacagatttcaaataacccaaagcttgatgtatttctctagtattgagaggcgtttaggaaaagaacaactttaatgatgcaggaagtacttgcttaactagttcttgcctgatgccgtaattttatctactaaatttccaagagttttggaggcttaactattgcgaaatagagagaaaaaaagaagaatcctaattagtaagtatggaagagatttattaaacgagaaaggaagtgaaccaaagaagaaacggaaataaatcatacagtatgagtaagaacaggtcatcgctacagtctggtccacttaatagcgagttattggaggagcaaaagcaagaaatatatgaggcgttttcattgttcgatatgaacaatgatgggttcctcgattaccacgagttgaaagtagcaatgaaggccctgggatttgagctacccaagagagaaatacttgacttaatagatgaatatgatagtgaggggcggcatttgatgaagtatgatgatttttatattgtaatgggggaaaaaatattgaagagagatccgttagatgaaataaaaagggcattccaattatttgatgacgaccatactgggaaaataagtattaaaaacttgaggcgtgtagctaaagaattaggagaaactttgacggatgaagagctgagagcgatgattgaagagtttgatttggatggtgatggcgagattaatgaaaacgaatttatagctatttgcaccgatagttaattatgactatatatttaatctataaaaatgatttgtaactatattagtatactcccgtgggtctctcgttttctgttttaacttacatcttgcccaaggatgcacttaaaagtgaaaaagccaatctaatcctgcagggcaacaataagagaagacaataaaacaaaacactgaaaaatgtcatggaggtatgcgttaaaaaactacgttaccagcccagaaacggtaaacgatgatacagtcacatactttgatgataaagtgtccataattagagactcgtttcctaaatcagagtgccatttattgattctaccacgaactatgcagctgagtagaagtcatcctactaaagtgattgatgctaagtttaagaatgagtttgaatcatacgttaattctgcgattgaccacatctttaggcattttcaagaaaagttccgaataaagaagagtgatgatgacaaagacccctgctgggatgacatattaaaagacaaaaacaagtttgtaagaaattttgtacaagttgggatacacagcgtgccttcgatggccaacttacatatacacgtcatatccaaagatttccattcggtaagattgaagaacaaaaaacattataattcatttaatactggattcttcattagttgggacgatttaccattgaacggaaaaaatttgggcactgacaaggaaattgaaactacgtacctgaaagaacacgatttactttgctgctattgtcagcgaaattttagtaataaatttagcttattgaaaaagcatttagaactagagttcaatagccatttcgagcttaaataaggcaagctttctcgcatttctttttgttactgatatacacatacctatacatacacatgtctttttaacatcataatttttggtattctatagtgccttccaatttcttaacttcagctacttttcttacggctttcattaaatcatcagggttgatgtgatcacggtcatctcttatggcgaaaaaacctgcttcagttgcacagttacgaatatcagcaccattgaaaccatcactcatttttacagcagcctcgaagtcaaattcccctgtttttttgacttttgcagtatgaattttgaaaatttctaatctgccggcctcatttggcaatgggatttcaactttcctgtctagtctaccgggcctcaacaaagcaggatctaaagtatctggtctattcgtagccatgatgattttagtctgtccaagattatcaaaaccatccatctgggtcaacaactccatcaacgtacgttgaatttcacggtctgctgaagtaccttcactgaatcttctaccaccaatagcatccacttcatccataaaaatgatgcaaggttcgtgttcctttgcatatgcaaacatttctctaataatacgagcagactcaccaatgtatttatccacaataccagacgctggagagaaaatgaagttggctccaatcgtagcagcaactgccttcgctagtaaagttttaccagtaccagggggaccatatagtagcacaccctttggaggtttgataccgaccctctggaaaatttctgggttcttcaatggtaattctataacctcccttaattctctgatttgctcagtcaaaccaccaataccatcaaaagtgatttcaccttgttcaaaactggtcatattatacaccagtggatctgtctctctgggcaaaattctcattatagtcaaagtggtgatatctaaggtgactctcacccctttctttaatttagagcgatctaccgaattcctaactccgacaatataacgtgggcccgaagaggccttcactatatatttctcttcagataattccttcatgacttcgccaatcaattgtccaatactttgcaaagcttttatgtcgttttcagtcttgtcatataacttctctagatctcgtatattttgacggcgctgcttcaattgatcatcataccttctgtgttctagcagctttctcttgaattgattcaaggccttgttatgggcctcctgttcaggatccactctagaaggctcctcttcatgatgttcttccgtttcctgtggttgttctggttgttgttcgtgtgactgttgggtgtgattgtcgccggacgtttcccccaatcctgctaataaagggtcctgttcttcactcattcttagttattaatatctttgcttcgtctgttatctttggaaccggtgcgaggtactagatttaatttacttcactatggtatttcaagcttcctttcccttcggtggcaaattccactatttgaaaggtcacccgcctatcgcaaaatttttcacttctcatcactatattgaaatataacaatcaagcactttacgatgcaacagaaaatgctgaacgctgtgctgaccaaaagttcccaccgttgatagctcccccccctattgtcgtagtcatgtcaattcaggcttttgtcttttgcggtaaaggttccaatttggctcccttcacccagccagattttccattccaaacgcagaacaaagacagtacagctgccacgagcggtgacaaacttaatgagttggtcaatagcgccctcgattcaactgtcataaatgagttcatgcaacattcaacgcgcttgcccaaggctcttttgcccatcggtaatagacctatgattgaatacgtcttggattggtgtgatcaggcagatttcaaagaaatcagtgtggtcgcacccgttgacgaaatcgaattaattgaaagtggactgacttcgtttttgtccctaagaaagcaacaatttgaactaatatacaaggctttgtcaaattccaaccacagtcatcacttgcaagatcctaagaaaattaatttcatcccttcgaaggcaaattctacaggtgagtccttgcaaaaagagcttttgcctagaatcaatggcgattttgtaatcttgccctgtgattttgtcacagatatacctccacaagtcttggtcgatcaatttaggaatagggatgataataacctagcaatgactatctactataagaactctttagatagtagtatcgataaaaagcaacagcaaaagcaaaaacaacagcaatttttcactgtttattcagaaaacgaagactcagagaggcagccaatacttttggacgtttattctcaaagggacgtcacaaagacaaaatatctacagatcagatctcatttattatggaactatccaaatttaacagtatccactaagttactgaactcattcatctacttttgttcctttgaactttgccagttgttaaaattaggacctcaatcaatgtcaagacaagcttcattcaaagatccatttactggaaaccaacaacagcaaaaccctcctactactgatgatgatgaagatcgcaatcatgatgatgacgatgattacaaaccttcggctacatctatccagcctacctacttcaaaaaaaagaatgatctcatcttggacccaataaactgtaataaatcattgagtaaggtttttagagatttatctcgtcgttcgtggcaacattcgaaaccgagggaaccaataggtatttttattttaccaaacgaaaccttgttcatcagagccaataacttgaatgcttacatggacgctaatagatttgtactaaagataaaatcacaaacgatgttcacgaaaaatatacagattcaatctgccgctatcggtgctgatgccatagtagatcccaaatgccaaatctctgctcatagtaatgtcaagatgtctgttctcggtactcaggccaatattggttccagatgtcgtgttgcagggtctctcttatttcctggagtccatcttggtgacgaagtaatcctggaaaattgtattattggacctatggcaaaaatcggttcaaagtgtaaactcagcaattgttatatcgaaggccattatgttgtggagcctaaaaataactttaaaggtgaaacactggccaacgtttatttggatgaagatgaggaggacgagttaatatatgatgatagtgttattgctggagaaagtgaaatcgccgaagaaactgacagtgatgatagaagcgatgaagattctgatgatagtgaatataccgacgagtacgagtacgaagatgacggattatttgagcgttaatataaacttatgtatattccttcagtctctttaatagagaccaagtaagtaagtggacgagaatagaggcgatattatgcatttatatttgaaattcaacagaacataattatgcttaagcaaattaacatgttgtattaatacatagcgttttacacatctatttcatatattatgttatgttaatttttgaattaatttttcttgttctttcgttggatcaatggcgcagttgcttctttgtcaccactctcactctcactgtcatcagagacttttgattgtttgtcctttactctttgttcttgaatttttttattttgaattttgttttcaatcaaatcatcaaacgcgataattgacctaaccaaattgcttatatatataaccattaattcatcattagttttcacagttaaagccttttgtaagttatttgaaatattaattctgtcatgattctccacatctatttcgtcatcatcaggtgttcccagatttggtaaaaggttgaaaacatcttgtagcttgcccaatatagtgtggtttatcggtaattccttattaatgactttgtctaagtactcgacaacgtcttttagtttgctttgtaatcctttcaaagattttaattggttggtcaaccggatagataagccacctgctgcttgatcacgtacgtctctcaataagtgttctacaccaatttcttcagcttcttcggcctcaatagtacaaggcaaatgaagaaacgtcttttctgtagacgtaccatcatccttaacttgctcaatcgcgacatatgcatctgttggtaaaccaacaccttgttgtttgacatcaacaattaataatagcggattattctgagtatattttttaaacagctcattaatcttgaggtcagaagcccttaatttaggaccactatgataccatccaatgagtttttccttggcattaatctttttacacatttcattcatgttttcaatataattatggtctaaaaaccacacgtcagagtttttctcatcttcttcaaacggtaaggcaaaggaattagtgactctgatagtggaactgttagcatcacctaagatgacaccaacgcatcttttgttttcttttgtctgcgtacgctcataatgatccaaagcagatagcaaaactagtggtgcaatggtaactttctcgtgttgtagagacattgtaatttgattttcctttctttctttcttttttaaattcgaaaaatgccctcaatcagtagcagttgtacagaaagccaacgttacactatagattgcttagctgttggcttcacaattatttcattgtagattctacgttacgtgcaacttgagtaacgatttgccactgaggtatccccgaactttagtaaaatcaaatttcgtaataagtgattaggaatattgctacttaaagtaagtgatgctcattgaaagattgcattgtgagtcttcactacttaccgtaatagaatggtttgttttcatttgattgttgttgtgtcaatagttttgattttctactagagagtacaataatgcccttcgctcagattgttattggtccaccaggttcagggaagtcaacctattgcaacggctgctcacagttcttcaatgccatcggaagacattcccaggtagtgaatatggatcctgctaatgatgccttaccttacccatgcgctgtggatattcgtgattttataacattagaggagatcatgcaagagcaacagttaggccctaatggaggtttgatgtatgctgttgaatcattggataattctattgatttgttcattttacagatcaagtcacttgtagaagaagaaaaagcatatcttgtattcgactgtccgggccaagtggagctatttactcatcactcatctttgttcaacatctttaaaaaaatggaaaaggaattggacattaggttttgtgttgtaaatttgattgactgtttttacatgacatccccttcacaatatatctcgattttgttacttgcattgaggtctatgttaatgatggatctccctcacatcaacgttttttctaaaatagatatgctgaaatcatacggagaattaccctttagattagactattatacagaggtccaggatctggattatttggagccatatattgaaaaggaaggctctagtgtactgggaaagaaatatagcaagttaactgaaacaatcaaagagctagtctcagatttcaacttagtatcatttgaggttttgtccgtggatgacaaagaaagtatgataaatcttcaaggtgttatagataaagcaaatggctacatattcggcgcatccgaagttggtggtgataccgtgtgggctgaggcttcgcgagaaggtgcattaatagcgaattacgacattcaagacaggtggatagacaataaagagaagtatgataaagaagaagaagaaaaacgtacggcgttgttaaaagaacaagaattgcaaaataaagctgttgatgtgaatgaagaagatgagtgggaaaatgcgctgaaggagtgggaagagaaacaaggaatggattttgttaggtagcgtgttcaggtatctttttctcgttcagccgtggaacttaattcaaaattgaaaattgtatacagagtatatatgcatataattgaaagcagcttactacgaaatgttcttgaattgctggccgagttgcaaatcagctgcaaaggacagaaccctatgtctgaacatgattgctttcgtaccctgaaagccagcgctactaattaaccaggttgaccagccttcactcattcgcggcgacagcaaaagcggaagaagaaaaaaataaccagcaaactgtcaatgggtttctaggaggaaaaagaacaagttaaaaatgattagcaccaacaacgttgcctatatctgtcattgggcagctgtgcggggattctaaggtttttgcgcagatcgtgatataaaatgttgtaaaaatggtttgctactctatattgatgaagttttcatattcaaaaggatttattaaatgaatgaaccatttataattgtgagggcaggatagcaaaaaaatcctacagaataacttagtaatgccaagaaagtttttgggcaataaaattgaaaagaatgttgatgcagtcagaccatcttcgctaacattaacagctgatgacttgaagtatattccaccgataccacaagattttgaagatgaagatgataaggttttacgtaccagcaacggtggtaacaggttgtctaaaagatttgggggtacactgaaactgaagaaacggttagagtctgttccagaattgttcttacatgatttcaagaagaggccacgctcccaacttgaggtgattagagagaaaaaatttactgacatgcaagttcccaagggaccagtttgtcctcaaagcacgattctaccattacgagaaagaaagaaggtaaaatcactaccaattcaaagaaaaagtttacgtaggccgacgctgtcaaagcctgcagtagtacaatctttagggcataagacacattcggatcatattattgataaagtgtttgtctctcgcccggccccaattgtaatgcctgtaaaagcccttactcctattaatccggtctccctaatgcaaacacagacacaagattgctgtagaaaaaataagtatggcaaaagcggtagtgaaatattgtttgacgaaattctatcagcctatgaaaacgtttctacaagcgattctactgccctaaattcagaaattgacagaattatcgatatatgcgcttcaaaacaaatagctaaaaaaaatgaggcatttcaggtaccatatgtcgtctgccctgacgacacagagactttgttttcgtcaacaacaccaaagttgaaacctgtcaattctaacacattaaacgatgtcatttctagcccagaatacaccacgtctggatgcagtacatactctgaccaatcgaattcagatgaggaattgtccgaagtagaaagtatagtatggaacacgaataagaggacaatgagatcatccattgtgtctgaaagcactagtgaggaaggctattgcactgctgcggagactttgccctcaacagtatcagtggaagatctggatatacataacaagcttccaaaagttgcacaaacatcatcgtgcaatacgcttttgaataaactctctataagaaaattaaaaaaagtaattctcgatccgcctaaaataatgcatgtcatgacttttgacgatgacagtgatgatggagatgacaacgatgacgaggatagggctttgaatattcttcaaaaaaaaattgactgcattgaaatagcaagttgcagcagtagcatttacagcgaataaaaaaatttattctaggtttcaagtaaaatcatacgtatataagtagaataatggcatgagcggtgacacattgtgtatttgcaccagaggtggtcatcaatagaaaagtgtcacaatttcaacgataaatggccgcttatgtcgcaccttttgtagtattacccgcaaaggatcataatgaagaactactatggctacatataaacagagcagttagatacagtgcgtcttataagggcatttttgagcataaagcacaacaggttgaactcaagaaaactacatttcactatcaatggcacccacacaattggatataaaagtcaaggccttgaagaggctgactaaggaggaagggtactaccaacaagaactgaaagatcaggaagcacatgtggcaaaacttaaagaagacaagtcagttgacccatatgacttgaagaaacaggaggaggtccttgatgacacaaaaagattattacctactttatatgagaagattagagaatttaaagaggatttagaacaatttctaaaaacttaccagggtaccgaagatgtcagtgatgcaagatccgctattacgtctgcacaggaattactcgattctaaataatctatagataacctttttcttaccttttcgcatttattttgatgcaggtttttatactttattatgtacaaacctgttgcggatgaataataaatctcgctagaaaatgcacggaatattatatgcaaaagtagaaaagtggaagacggctgttgatacagtgacgagatataagaacattttactctatatttaaaaagaactttattaatctatttaattgagttaacacctttaatgccatcgatatggattctcgagttgcactggtacgaaaatacatagcaccatcggtgataaaaagcgattctattcaattgcacggtttagtgaaggcaccactatttaaagcgttgaatagccgttacaaattaggttcactacagatagtacaggatgtcgattggaatgcgaagacaacaccatccgattctccagagcctctggccgctactctaaactctaatcgatccctaccaatgactaagttccccaagcaggagatcttggaacaggtaaaattggatactaaggttggcaaatggaggaaattcatgacaggttggtttagaattggattgtatcttttaaaaagctataaaacaggaattcagaacacgttaaaagtattctgggatactcgaaacgaagagcagaaattcagcataaaaaacggtgcattggctaacttagtacgggaaatagaaatgcatgaaatcaatacaagactatcgtcttcatcattgcctacaagttcttcagcaaaagccccattaaggccactttcaatcaataggaaaacactggtggaactgatcagacgagatcaaatctggaaattacctgtatttttcaccttagtattcatatttgaggaggtaagtgtattgatctttaccttttttccacgtgtctgtccgtacaattgtttaactcctggtggatacaagaagctttccaactcatatatcaagggaacaacaagcacacaaggtaactacggtctgggtcccttagagtttactaagcaaggtacaattaagtatgagccaccatatgcagttcctattgagaatttgtataattttctgacaagctttcctcaaagtatgatatcaaactggaaactgtatatttataaaaagttaaaattacagaagctactttgcaatgagatagaaaaaatttaccagtatctgtttatcgatgactggttgctgttgcagagtatactcaacactgatgttgagaaaactaaaatcgcgctaagtgatagagaattggttaactgtatacttgaaagaaaactttatcacatgggcgatgacttgaatgagatggttaatgacacgttagggaaagaaatcttactgaaaagattgtttctttattggacattaagatataatgacactatatccttaaacggaaagcatacattcagtgagaaatggggtgtcaacaatatatcattgttaaaatataattcagaattggtagctacgaaagatattcaatagatgtaaatattcatgacattatctatgctgtacatattgtttaaaacaaaaactcttttaaacttttctaattgcaaattcaaacaataattcagtgatgtttcttgcttttggagcaaagggcaatgttactctatattgtatgtataatatgatagatactcttccgtatatatagtatatagattttcgtcaagcgtttcaattggaaagtgaaagaaaaaaataagaaaaaatagaaaatacaattaaattaatcgaaaaaagaagtgaaaataattgagtagttcgtattaaaccttgtaggtctctaagtgagcattttcctccctaaccaatgtatggtgatggccaggcgctctaataactttattttttgaatccatggtacaggcagcaatggcggcaaaccattcatcattaaaaatatcatctaaggttgctcttttctttggatctacttgcagtatacgggacatgataggtcttgaagcatgtggtagtagacgtaatagacggtatgggccatgaataatttttttatggtgaggtcctctgtgctgttgactcgatttattatcggaagcgatactatgggccttgtcttgattttgatgctggtgatgatggtgttgttgttgttgttgttgttgttgttgttgttgttgttgttgttgttgttgttgttgttgtggattgttttggggaaccatatcagggttagcgttggcagcagtgttgacgttagtatcaactttagcgttacaatccgattcattgctgcagtcattgttagcattacaatccgttttgtcattgcagtcactgttagccttgcaatccactctgccgttagagtcaccattagcatcgcaatcagcgtcggcatcggcatctactttctttgggttagctgaaactaccgtgcttttattctcatttttgcttattttaatatcgatggtactttccttgtcattatctggcgtgctttctttatcattattgctatcatcttctttattttcttcggtttcttcttccacaatgtctggtttgttatcgcttttaccctgtatagatgctggagtatttggaacttgattttgaactgttttcaagtttgattcatgagctggttgttgctgattgatggcggaacagtcactgtgattcaaaaacctttgacgcttttcttttctttccttcagtaactcttcgtgatgcctggcagattcaacatagtcgtgttctatatcatccggcatacaatataatctaaaattatcgtcagaatctctaggggctttccatggaaaccttttaagcaccatacaacaatatatgatcccaatagaccatatatcgacgcactgaggatcataagatttggtggaggtaatcacttccggcgctaagtaagggtcactacccacgattccatgagccatcgttacgccatcttcaaaaggatatctgaacacaacagcactaccaaaatcaattaatttcaaaataccctgggaagtcatgacacaattatccaatttcaaatctctatgtgccaatcccatagaatgtaaatatttaacaccttcagtcaattgcttcaagcaacagttgatctcgccacgagacatcttgcctgtcataacaacagcaaaaaaatcaatcggacagtactccataacttcatagtatttattttgtttagaatcagagaaaacgtcaacagtttcgataacatttgggtgatgtaaagtcgaaccaatacaaaattctgcggtgcacttcttggcatattctttcacactctcattcggtttccttggtctgaattctttgacggcaaaagtagcaccatcagttggtctcacaagaactttaacggacccaccggcaccggaacccaataacttacccaatttcccgtatttttgagccagaatacaatcatcgtgatatatattaatattattggacaaagataggatagaatcggtacttggcggtatagcagactgggtatgagcatagtggtctgtaaagccatgaggatgctgggcacgatagtgattatttaaattaactgtagaagttgattttgaaggtgggggggaatgggtgctatgtttcttggaacgaagttgagacatagatagttttttatttacagaaggtctgaaaaaccttttcaattctgccatggagtgggtttgttttggagaggcgggagaagtatagtcatggagcccatgagaaatattatggtggtggtttgtttcatagttattattgtagttgtttgttgagatactggttgcattagaatggctatgggtgttgttattaaggtttgttgtagtataatttgtagtggttgtggtagatttcatggaatctgtagatttctcgcttcttagtgagtcattactttgttttctaccaatgaagtttaagaaagatttagaacttctgatcaactgtggcgggttattagacgaattttcacggtcatgatgatggtcattatgatgaccatggaatgggtttctcgacaatagattaggcatctttatacgagaaatagttctaccgtattattataattattagtgttattatttttgttttcgatcaattctagcggagctacaatgtggtagtcaaacgctgctattgtatttaattccggctcgagaccagtctggaaagtcgacgtatatcgttactactatcctttttttattattcctactatttccttattgaaaaagtggaaaactgttaaatctggaaattcttcacgattctagaaaaataggaggtgaagaagatttctaagctttttgaaaaaaacgggaaaaggaagaggcccaaaaaagtgaaaaaaaactgtgtgtgtgaaatgtaaacgaactttgctccctctaggaaaaacttctttaagcggttgggaactgtcttgggcttacttgtttgtaaacagttgtatgaatgattctatatgctaattctcagtttgtctctcttaaagatttgtcactctgaaatatatagccaaatagaactaggcgaagaaaaagaaaaggggcggcgacgacgtaggggtcaggtagaagagttgggcacttattggcgatataaaagacaaaatacactaatgcaagagtatggtgagcgaaaggaaaataaagaaaggctacgttattgacggatatatgaatcaagacacaagactattttgtatagtaagcagaaccggcttgtgtttgtgattcatggatcaacgagacggtagcgaataagcaccaacggaaaaaaagaaaacatacgcatacatgcacgtacaagataaaaaaagcacaggtgtggtggtagtattgggataaccaggcacacgctactgcgagatagcaaaagacccttcccgtaaaccgctcggataaaccgattttgtcctttagcgtgacacggattatacgcggggatccggcgtcacaagccacggcccgtcccgtccgcgtggtttttaattctggctccgcgtagtacattttgtagcttgccttttttccggcttctagaaaactggaaaaaccataagaaaaaaatgggaaggggaaaacaaaaaccattcaggtcttgcgtgccgagaattttttttttctctttttcgttgtcaacttttgcagtagcagccgctggcgacccggacggtagccatggcaacggttagctaatggtaggtaaataaaacgagtaacgacgttttagtatatcttggtaaactacaattagatcttaaaacggttcctgaaaaagtgctttcatctaccattgaatttaattcacttccctttatggaatttgcactggttttgtgctgtgggatgtgggtgttttgaaatattttcagcttgcaagtcgtgcatattgcacttgtttcttatttttggcgagtgtaaacgtaataggtaatcttagtattgggccatcgtcgcccagatagccattgataaagcagctaggttcgtcgtccggttgttggtatacacctgtgcgtgcgtaagtgtagaaaaaaatagaaatgactaactggcagcaacagcttcctttaacagatacacagaaaaatgaactcgataaaagtgtcctccgatatttgaattggaattacaaacaaactgtacgacatgagcatgctcaagattacgaaagtgttcgacatgcaattgtaactctatcaggttttctgttgcaagaatcagtggaccggcaagaattcatcagtaacaatgacaccagtaacgaaagtatggtagacattgatgaattactgctaccgaagaagtggaactcaattgttagactacaaaaaaaaatcattgaattggagcagaatacagagacccttgtatctcagattaaagatttgaacactcaagtgtcagaactagcacaattcaaacctaccaccagtaacggcaccagcgcacataatgttttgaaatggataccgagaaatctaccaagctgtttaattaatgttgaatcatctgtcacttccgtcaaactacatcccaatttgcctatagtgtttgtggccacagatcatggcaaattatacgcatttgatttatttaactacaccatccctctggcatccttgcaaagtcataccaaggcaattacctccatggatgttttatttaccaattatacgaactccagcaagaagaactatttggtgatcgttaccgcgtctaaagatttgcagattcatgttttcaagtgggtctccgaggaatgcaagttccaacaaattaggtctttattgggccatgagcatattgtctctgcggtaaaaatctggcagaaaaataatgatgtccatatagcgtcctgttccagagatcaaactgttaaaatttgggacttccacaatggttggtcgttgaaaacatttcagcctcattcccaatgggttcgttccatagacgttctaggcgattacatcatctctggttcacatgacactacattaaggttaacacattggccatcaggtaatggtcttagtgttggcacgggtcatgaatttcccatagagaaagttaaatttattcatttcatcgaagactctccggagataaggtttagaacaccatcaacggatcgatataagaattgggggatgcaatattgtgtctcagcgtcaagagatagaacgataaaaatctgggagatacctctacctacgttaatggcccatagagcacccataccgaatcctacagattcaaatttcagatgtgttcttacgttgaaggggcatctttcgtgggttagagatattagtattcgaggccaatacttgttttcttgtgctgatgataaatctgtcagatgttgggatctgaacacggggcagtgcttacacgtttgggaaaagttgcatacaggatttgtcaactgtttagacctggatgtggatttcgattctaacgttaccccaaggcaaatgatggtcactggtggattggattgcaagtctaacgttttcatgagataagtttggctttcctatttctttttcccttttttttgactctttttaagcattggttgatactttaaatactttattgaattagcattgatagtatataataaggtttactcactatatagtagcatcatttattatttaatgaagtacttaaatgtttcgctttttttaaaagtcctcaaaatttagcttgaagcggaagagcttgcactagcaacagcgacttccatgtctttatactcaaatgcgaatggttcgtatggtaaaccttcacccacgaaaaacttggacatagattcaacccagtgcaaacgtaaggaatgaagcatggcagatgtaccttccatcaaaacaagaactgcacatgttagtgcgaaccacatggcaaaaagtgcaaccgtcataaacacacccacaaatcctctaaatccaaaggcaatttgaattgtcattgtccataaaacactagacaattgagcatgtgccaatgataaggcccataaacgtaaataggatgcagtgtgcgaaacacaattcaaacagaattcaattgtatgaataacttgatgaatcataatatcaccaaagtcttcaccatgagatccagaaccaacttcttcttcttcagcgtcatcggcgtccatcgcggaaattaattgttgtgcttccaaatcttcagaactagcatctgcttcagtcgatggcagtggttcgtgagatttctttttatgagtgaatttgaaatgtaatggcttcaccaatagcaaccaaggaatacaaaccaaggccatcaacaacaaaaacacttggacctttgcttgatgagggtataattcatcgtcaatagttcctggtgataaaaacatgttgatcaacatatttaacaaacctggagcaggctttccgtccttaacccaatcaacagcccatttgtaaacaatacaaacggaaagataaccaaagataccttgcataaatagcaaaccaggaataaagttaccgatgatatcaatcatagagttaaagtataggtggttagccaacgaaaagaaataagaataggtcatgtggatgaaccccattaaaattgatagtttcattttgtaagaattagaaaataacaaagcattttcagttccatgccaagcccaatctaaaccgatagggtatgtacccaccgatgtagcagtaatactctcaccttttttccaatgatcaggccatttccaaccagacttgaaaatagtcatagttttagagaagatatcgttgtaaaggaaacctgtgtacatggaaaagacacccatcaacaaaataatgtatctaccagtgaaggccatatcgaaaatttcgcctcttttcattttgttgattttcttttcattcaatacaagagacaatgcggctaaggtcattaagaacccgtgacccatatcaccaaacatgatggcaaacatgaaagggaaagtgacaattgtgggtaaaccagcattgatttctctgtactgagcaataccgtaacagtcacagatactttggaaaccagcagtaaacttgttagttctgtggaaggtaggtggagtgtggtttgtatccaggacttggataatggatgggacatcaatacccaatcttgcgatcatttcaccaagacgagcttgcaaagtagccaattcgtctcttggtatccaaccttcagcaatcaaaatctttctattggtatcatagttagacttgttcaaaatttcaaaaatcgccttttcacgggtaacatcttggaaccaagagtccaattctttggcaatggcatataattcactttctaaagtggtagaagtggttttcaaaactgtgtacaaatcactcaaattcttgttgaccttggccaattgttgtgatctaccctcgttggaagagtcaacatcgtaaagattggcatccaatgattccgcaatctttctgattcttttaataatcagatcaccgtgagaaaatacgataaaagcatttttatgtttatactccctggttttgacatcataaacaggttgttcaatttcaacagttttgaagaaaaggttacctcttaatactctccaaagaatttgttctaaggtggcaactttgtctctagcaatgacaccagtgacatagtttacagaagcaccgatagcagcagcaatgttttccccattagcgtcgatcatgtcttcatccatataggaagtgctgtcggtattatcacccttcaagaaaaattcatcacctgactgcaaaataaagcgatactgttccaagtcatttttctggacttcaatttgatcggttgcatcctccatttgaatcaatctttcttccaaatatgaagcgttccggacataatcatctatcactgaaccgcttggtggaacgtacaattcacctgagccgtccaaatatttgtccgtgtctccttcgtagagcttaatatcgtgtttcttcaaaagagaataaaagtaacgatactgtctttctacattatccagtcttctaatttcgttcacgaaagttctttgaaacgcacgcaccttagagttcaagtcacggaattgaacaagacccaattgacctaaagtgtaagcagagtctcttgaaatttcttgaggaatatagaattggactaaagccatttcagcagagcgaaaaatcgcttcctccttctctgccattattttccttgtgtaacctttaaatgttttttttttgattcaaattaaaagggatttaaaagttcaaaccctcacttgttgtatagagaaaggtaaaagctagcaaatacacacaggtagccctctaagcaagtatagatatattgagaggcaaaagctatggacttatttggacttttgttgttttgtaacctctaaaagggttgcactcaagaaaaaaggttttccatatcgacttatctgagtttcttttttttgctttttttttttttagcccattttttttttgacgcattagtcgttaatgatgatataatgtccacgtgatgacatttcaatctgcaacaatagctcggcaactggattactagcagtcatacgtatgtcagtcactacacatatatatatattaatgtttaactaatttttttttcttatctatctgatatttattctataactatataaatttgtctcttcacttctaaatacctctgttaaaatagaccttttcaattggcttcccatccttatccttcttgccatgtagttcaggttctagtttatttaaatggattgcttgtctttgagggaagataccgagtgcaaatggcaaagctgagaacattgtgactgagatcaaccccaaattggccaaagtttgcacaccgagagacttacctttgaggacaccgcgttgtagtctaaccaaaatcaaaggtgggatgaccatagttggagtggcgttaatcactctacttaatgcagtttcaccaactgccatgaaggcagccttcttggactttccgacttcgtcaccgttagagtcaaacacagaaataccctttctaatttcgttgcctctcattaggaagacgttgacaataccggcactgaccacggcggcaaatggcaccaaacggcccaagatcaactttgaatgtggagaaatgtttttcaacctgggaactaggttatttagacctaacgcaacaccacacgacgcagttacagcggcagcgtaattggtgagcaattgggacgtggacataggatgagatttgtttgcgttagcggaattaacggcgacgtttagcgattgatttgcccattgccaaaatacagtccctgccgtacccaaaccaggcgtcagcatacctacagtaacgactaggtttgatagcacgttggaagacatacggaagggcaaaagaactgtcttccctgtgtccggatgcacggtggagtccagttgtttcttggctcgccagaactccggagtagtctcttttagttcaccgtgacgatacgcactgatgatttctctagcatgcgccaggtccttctcagtagttaacaacatagtggggtcggaaatctctgcgcaatggcggattctaccccaatacgtggataagtcatagcgggattcgggcaaatcgatgggccctgggactgatgatgccatatttctctgccttgtttatttttttctttcgatgctgtgtggttttattattgctaacttgcagtggtcgacgcctttgaaaactgtaaagctgatgcgaagacctaacagtctcttatccaattacctcaatctggtacgctccggtaccggacgccagtacgaaagaaaaacttttcgttcgtctcgggcaccattggtataaaaagcgccgaggcagcgatcatttttctagtattactcttctttcattttttagttatctttgattttcggttccgaagaaggcatgatacatattaaacatgccttctattcactgtgccatcttacatccgtaggtgatcagaggggaaaagaagagctagagcaactcccacactcatgagcgtcctcatactgttctgggcgcttctcacaggtgcttcttttagtgtctcccattggcccagatcggtagctgcgcgagtgagatatctttcattcatttatatttatctgtagcaatagcttcctttactattttattcttagggagaactttagcttatttcttgcacaagagggtttgacagttttctgttacccggccagtacttcaaaaatttttcaaaaattttctgaagtgctcatctcatcgcaaaccgtaggagcagtgaaaggcatatgctcatctgtataattgcaaaaagacatattctatgttcgcagaaccaatacgttacctaaagttttaaagacaataccaagggaaactgcacaaattcaatatgacagaagataaatcgcaggttaaaatcaggtttttcacgcgtgagaaagatgaattactacatgtacaagatactccaatgtacgcccccatctcattaaagagatatgggttgtccgaaattgtcaatcacttgttgggctcggaaaagcctgttcctttcgatttcttgattgaaggtgaattgttacgtacttcattgcacgactatttgaccaagaaaggtttatcgagcgaagcctcgctgaatgtagaatataccagggcaattcttccaccatcctatttgaatagtttcagcaatgaggactgggttagctcattggatgtcggcgacggttccaagcatattattagtggttcttacgatggtatagttcgcacctgggatttatcaggtaatgtgcaaaagcagtacagtggtcattctggcccaatccgtgcagtaaaatacatttccaatacaaggctagtttcggctggtaacgaccgtactttgagattatggaaaaccaaaaacgatgatttgaaattaacttcacaacaacaggcacaggaagacgatgatgacgaagtaaacatagaggacggtaagacactggctatcttggaaggtcataaggcaccagtagtctctattgatgtttcagacaactcaagaatattatctgcatcatacgacaattctattgggttctggtctactatttataaggaaatgacagttgttgatccattagaagatataaacaatccaaacaataaaatatccactgctgctagaaaaaggagaaaattgacaatgaaagatggtaccattagaagacgtgcccctctgtctctgttagaatcccatacagctcctgttgagcaagtgatcttcgattctacagataataccgttggttattcagtatcacaagatcataccatcaagacatgggatttggtcaccgcgagatgtatagatacaagaacaacatcgtactcgttgctttccattgctcaattgtcgactttgaacttgttagcatgtgggtccagcgccagacacatcacattgcatgacccacgtgtgggagcgtcttccaaagttactcagcaacaactaattggtcataagaacttcgtttcctctctggacacttgtcccgagaatgagtatatattatgctcgggttctcacgatggtaccgtgaaggtatgggacgtcaggtctacttctccgatgtacaccataacaagagaagacaaatcggtccaaaagggcgtcaatgacaaagtttttgctgtcaaatgggctgaaaaagtgggtattatcagcgctggtcaagacaaaaagattcaaataaataaaggagacaacattttcaaaaactgagaaaaaactgttgttgtttttatgtagaataatgtactgatatacttgaaataaatttggttttgccaacagctttcgcaaatttctgtcaccttcttctttatgtaaaacgacattacttgctaaaaaaaaaaatacttctatgataatgtgtacttgtatgaaacttctataaatttaaattggtgaattttatccagctatcccccaatttactatttgaatatatgcaattgtgatctgtcttaagaccttttcaaaccattctggcggaagcatcggtggccatttccgtatacgaataaccgtcttcattatccttgatagctgagtataaactattggaaatgggttcattacgattttgcgcatgttgcccgtcctcgcgatcaaacgaggcaggaacgggctgcgtatgggtcctgcgcagagatagcctttcacctggtttttctctagtcgaagggtctgtttccatggtccttaacgtggtcatccttgttagattcaattcaccatcgacagcatttacgtcatctataccaccttcggtctcagcctccttttccatggcggcataaccaaattgtgacttgtgtcttaatttgctcccccatttttcaaaaacccatggaattggaatcatcacaacgcaaactaatgcaaataaagtgcttgcccatttgattttcatctttgtgtacatttggatggtaaacaatgggaatacactactcataacgtatcttaatagattattggcagccaaacaggatgccacagttaatggcggatagcatgtagagaagtacattaaaacgctgaaaaaaatcaaaattaaaccaaaaccaaatggcacaccggcagccacaggagccatccagtggacatctgatctagcagtccaggcttgccaaaacaggccgataggcaaagctacagaaccaaatttacaggcaattaaaaatttttctggaacaacgggtagcaattcacctgtttcagcgtctcttgcacctctgtaaggggtagtccttttagaagttctctctttttcggtgagtggttgagtgccagctggtggtttagggaagagatattttctgtcgatgtaaaggtaaaagaaagcacctatccataacccgacaccaataccaataaatggcaagccagatatccccatagacatgtggtaaacaccacgataaatgacagcgtatgcttcgaaaaatccaaataaaatggcgaatatgaaagcgacataaacactgaaaacaaatacaataggttcaacgacaagcatttttaaaggccttaagattgtaatagtgacagtggtttttaaaaattctttctgagcttccctgctgaacttcttcaaggctatatttctcttcttggcacgctttcttaaaataatacctttatgggtctctggcatgagcgcaataaatggcaagattagaccgcccgcaatcaattggatccattcagaccaacgccagcctttggcttcagtagcaaatcctgccataataggagataaaactggccctaagaatggagatagaacaaagtatgtcattgcgacggagacctggtccacgtcaaagatatccaggatggtacctgatccaacggataaggcgggggatgcaaagacacctgataaaaaccttaggggtagaattattctcatgtggccattggataacccaacacccatggtgaaaagcattgacacaggtagggaaaataaatagacaggcttacgaccaaacacttcacttaatggagcgccgatgacagtcgataaacccagaagatagaaagttaaaccagcaagcgccaaagtctgactaacgtgatatctttctaccaattctggtacggaagaaacatatagggaactacccattgtgacgaccaaacaaagaaaagctgaagtcatagtagtataccatttcttcaaagaggaccaattatgcggattgtctgggtcatcgggcccgtcccaatcgagatctcttgggtcaattggctcgccccctgtcatgttattggaatctgcattcggttctgatcttttttcgtcctctgttattgaccctgtcgaagaagaagtcgaatccaagttgccgctattagttacatttttgtccaaggcttttggtacctgctgtatgtttgttcgaggatctgagttagattcggtttttgtcaaagaagaaggcattagtaaaacttaaaatatatgtatacgatgtctatgcttctttgtgtgtgtatgtgtgtgtataagatggtatctttattctgtaattttcaggaaagtgatgactagaaaatcgatgtgtcaggtacaacaaattgacaacctataactttccatacaggcgaatatatatatacacataaacacattcaagcctccggtaccgtttgctctgacaaggacaattagcatgtaagcacgagtgcgggtatgcaatcatttcagtgtttccttcatttggcatagtgtcgtaacacggatttaaggtgagccgtcaggggcttttaagcggagcccctgcagcttcatgaagacggaaccgcacgggcctattacctcggggatagatcaattatccgaagcgggtcacaacccggaaataataaccactatgcccgaccgtaccgacgtggcactatttttgggatccgtggaagtcggccattagtggtaatcggcgaaaacaagtttattgcagctaaagcacgccatacggttgatataaacagcaattaggcactttttctcttattattcatatgccttattggcttgtggcttgtggcttgtagcctatgcaaatgcatttgctgatagcagcataagaaagttgggaagaaacgctaactgtactttttatatccagagttcattagttgatcttttaccccaataatttcttccacttgcggcctgcttcttcgcatttctcccattccgggccgcgactccgtagttcttacagaaacagccgcctccataaccatctatgataggaaaaagatggacaaacaggaaaagagctagggagtataacctgattcctgacatgtataggattcgggtaattttgaaatacgaagctctttgcattccgagaccggtttaggaagatttatttacatatctacttgcgctattgtggtcatgccttcgaaagataaagagcgaattttgctcgtataagctaaaatcaggtaaaagttccttatgttgctgctcctcgatggcaacgtcgatctaagatcttgattactgaatcaggcgaaagcacacgttcatctttcgctcatcggaaagaaaattaaaacagaaaaaaattctaaaatggcaaaaaagaagaaaagctcagtgagggctgtatagtttattagataagctactatacgtacatatcttttgtaaatagaaccaaaaatcttcatgctaaagggaccgcttaaaggttgcttaaatatgtctaaaaaagttatagtgattgctggtacaacaggagtaggaaagtctcagttgtccatacaattggcacaaaaatttaatggcgaagttatcaattcggattctatgcaggtatataaagatattcctattataacaaataaacatccgcttcaagaaagagagggcattcctcaccatgtaatgaatcacgtagattggtcagaagaatactattcccatcgttttgaaactgaatgcatgaacgctattgaagatattcaccggaggggtaagatacccatcgttgttgggggtactcattattatttgcagactcttttcaataagcgggtcgatacgaaatcatccgaacgtaagctcacaaggaagcagctcgatattttggaatcgactgaccctgatgtgatttataacacacttgtgaagtgtgatcctgatatagctaccaaataccatcctaatgactacaggagggtacaacgaatgttggaaatctactataagacgggcaaaaaaccaagcgagacatttaacgaacaaaaaataactttgaagtttgataccctatttttatggctatacagtaagccggagccacttttccaaaggcttgacgatcgtgtagacgacatgctagaaagaggcgccttgcaagaaatcaagcaattatatgaatattacagtcaaaataaatttacgccggagcaatgcgagaatggtgtttggcaagttattggcttcaaagaattcttaccgtggctaaccgggaaaactgatgacaacacagtaaaattggaggattgtatagaaagaatgaaaacgagaacacgtcaatacgcaaaaaggcaggtaaaatggatcaagaaaatgctgatacctgacatcaaaggcgatatatacttactggatgccactgacctttctcaatgggacacgaatgcatctcaaagagcgatagctatttccaatgactttattagcaatcgacccatcaagcaagaaagggcacctaaagccctagaggagctgttgtctaaaggcgaaactacgatgaagaaattggacgattggacacattatacttgcaacgtctgtcgtaacgcagatggtaagaacgttgtagctattggcgaaaaatattggaaaattcatttgggtagcagaagacataaatccaacttgaaaagaaacactcgtcaagctgattttgaaaaatggaaaataaacaagaaggagactgtggaatgaaaatattaggaaaaaggagtttatcctgagtgtatatatctacataagtgaagctgggttttgataatggaaagggaggatgacaagctcaaaatatactttatagatgaatgaggacaggtatcattggtcttcaaatgtcaaactcttatcaagcctagctttttctgctcttcttgctgtatcatattcctgtacctcattgtacagattgctggtagaagtaattaaattttcgtaaaatgctgtgccggcacttaaattttctttcacctcatcaagcagtttgaaggaatatctcagatcttcaatatatagctctctgggatctattcttaccattttctttggttcaatcccgcttctgccggggttattcttcttacttaggtttacttcctcaataagtttgatattttcttcctttgtactattaacgtatcttaaatcttcgtcaaagtattttaaatggcctatgaaaatgggttcaaagtcgactgttccattttttttatacgatgtaatgatctttggaagtattctatattctgaagatttccgcctcgtcctatcaatataatcatttctttcctgtatgatcatcttaatcttattcgttagaggatcattagattccggtaacctgatctctgatccaatcaaatttttatcgatgctttgaaatagttcatttgtttgtttgtcaatcgcactaccttcatcaaggtatcctctcagcttttttagtttttcataatatgctgtgttagtagttgaagattcgggtaaagtccaatttaaggttccgtgttttagtcggagctgattgtcagtaaatgcttcttcatttaaaatttgctcaatgttatcgagttgtacctgcacatttttattattaatgagaagattattcagtgatgcctggtaatgactcagttctgcttcactcacctttgtaagcccttgtggtatttggaaagtagtcaaggactccttcaatagtttatttagggaagcaaggggattggtaacacgttgttcaacgtattcatcttgcctttcattgtatgctgtgcaatattccatcacttctatagggattaggtctttgaataaagtctcatcctttttaatagaaggcaacaatgttgctgaagaagatggtttaaccatgagagctggtttgatcgatggtaattccgaaggaacttcttgtaagtagatgaattcattgtctctttgggcttctttcagagaagattcgacaacagttttaaacttagcttgcgaagatagtgttgattcatttataaattgcaatcccatttgcagagctttcacaacatttccgaactgcttcttctcattaaaagataaggctattctgtaataagtcaccgcactaaagtaagcctttttagcctttaagtggtttatccaatcacttctaataagtttccccctttgggcgtcattaatagcctcgcagtagaagtccacgatctgttgtgacaacttcgcgattaaggagtccttgtgtttatcttgcacggctttaaaccagaagcattcttgcgcttgtgctagcatcagggaggttaaagcgttcaatgtggcgtcatctaccactgggattgtctcaagatttttttggtggtctaaaacatgtttaaagcatccggcggcattctggaagtacagacatgacgttttgagggattcggctgcatcattgttgctatttagagccaacagtgaatacatgcaaccaatattataaataatggttaatttttcccattgtaatgagtattgactagtaccacgagatttttgtgatagcgtttgaaaccatgtaaattctatttgattattgggaaactttttctctaattgcaacaatattacatagtattccttcagtgcagaaagaccgtcgattgagatatcgggtgcaatcgcattgtttcttgcatcaacaactttgagtatgtctgattggaaaaaggatgccgtttgaaaggaagtagtatcaattagttttgacaactccgtggcaaagtccacttctaaagttcgcttaagtggaatggcaagcagttcactcatgtcacactgcctggatctccatagataataatactctctctgcaagggtatagtagtgttttaataaggctttatagtcccttttcttatgctatattataaagccgggtagtagcgaggcttgaatatctcttttcctggacgaaaaatagtgaaaaattggaaaaagtatttggcgtaaagcatattctaccgattgcgatagacattatttgagctgtaacctgaatataggattaagaacttttatttaatttcacgacatgatcaagtatactatcgatgagctttttcaactgaagccaagtttaactttggaagttaatttcgatgcggtggaatttagagccatcattgaaaaagttaagcaattgcaacacttgaaagaggaagagtttaacagtcatcatgttggtcatttcggtcgtagaagatcttcccaccatcatggtagaccaaagattaagcacaacaagcctaaggttacaaccgattcagatggttggtgcacatttgaagccaagaagaagggtagtggagaagatgatgaagaagaaacagaaaccacaccaacttctactgtgccagttgctaccattgcccaagaaactttaaaagtcaagccaaataacaaaaatatttcttccaacagacctgctgataccagagatattgttgcggacaagccaattcttggtttcaacgcatttgctgctttggaaagtgaagacgaagacgacgaagcataagtcattcgctcatgctttcttcaggcagctgtacgtgtactatgtataaattttgaataacattttttttaataaacagtttttactcttttaggttactttccagattgaaaatatacaacgtggttacataaagaaattaaaatgtagaacgaatcatgaccaactgtatcaggtgtttaaaaaggcgaggtgaaagagaaaggcttccccctctaatatcaacagctggagatacatctttctaataattaatctaccatgagccgtacgcactgaagcaacgcccatcaaacatccgaagccacattatgagtacaaaagaggctgacgttaataggaactcatggtgtaattttgcttcacttttctgaattcaaatggaaatagaagtaaaaatgggcagaaaagttacctcatgctttaaatatactcaacttttctctaccgacagtaggagccctaagagataaagcgaaaaattttcacagcgcgctccttggtgcggcgagggtataaaaggcgatttcatttcaattctttgaacttacttcatttgcaggatccttcaggataagaaaaccatcattcaataaactgatcttccggattaccatgcttaagacatcacgcctccatatgtctatataaagcgcaaatggctggaagtagaccaattttttttgttcctagcttttcattattgaaatctaatccagttttaatggtttttcttaattaagaaaacaaattatcattggttcgctctaggtgtacatatcttcacttcattactctcttgtttacattgtatacatcgtacatatacttcaattatggaaataccataaattctcttagtgtgtagttcactagtttttggggttgggttgtgctgtagtcagctaaggcgctttagtgaactttctagtgagttttttgaattttagtgtcaaaggataaggaaacagaaaggtaaaatagaccttgctcgagagatgtctagtcgtaaaaaagtcagagtattactgctcaagaataaaactgtccccattgataaatatgaattggagtgtaggagtaaggcgtttgaacccatattcgtaccgcttattaaacatacacatgtaattcaagattttagaaatgttttgaataccatcccaaactatttgaatactatcaattacattattattacctctcaaaggactgtagagtcattgaatgaagcgatcattcccacattgacaagtgaacaaaaagctgcattgctcagtaaaacagtttatactgtaggccctgctactgctaacttcatcagaagatcaggtttcattaatgttaaaggtggagaagacgctggtaatggttcaatccttgctgatataattattgatgacttgagtacggatattaaggcatgcccaccaagtgaactattatttctcgtgggtgaaattagaagagatatcatcccaaagaaactccatagcaagggaataaaagtaagagaagtggttacttataaaactgaagaattaagcgacggttttaaaagattcatacacgccatgaaagaatgcgatgaggatgaagtattctcggactgggtggtagttttcagtccccagggaacgaaagaaattactcagtatttgggtgacagtaaccgcctaccaggttcccatctacgggttgcgtccatcggacctaccactaaaaaatatctggatgataatgatgtaacctctgatgtggtcagtccaaaaccggaccccaagtcgctattagatgctattgaattataccagcgccataaataatattgatacgtcatatttctctctatttatatttatttacttcttcaaagaagctattgggtagagtcccaatctcttttgcgtatacccgctacaccaccttcaaatctagataatatacttcgtattcttttattcccgacaagttcattaatctttatgctcttgaatgacggtttggtcctcatttgcttttctggtgtatatcttgccttaggagggaggatccaatcagaccttctacgtgactccaaaattttgggtaccaaactctcatataggtcttggattttggtctccccttcatctccgtcatgtccgtcgccttcttcatcttcttctgaccccagtctagactgtgaacgtcttttgtctctttctgatatccttgatgatctccttctaataccatccctttcagttatatctgaagcaatgtcaatattttccacttctgatattggaattggaaatggcaattcacttccatttatttcagaaatagtaacatcatcattgtttgcattcgcttcactaattgagggtaaagatgctggtagactattttctctttgaatagctcgagatctcgtacgtcttcttcgactggcagcaccagtagttgtaggagtgttctcacctgaatattctgtatcgctgatatcagctgatgagtttgatctagtagaagaggaggaggaggatgtgttgcgagggattggttcgccgacttcttgtgtagagttcctcttgattttcttgtagtatattccatattctttatttcttaaactgtcaatatccacatggccacttgcagatattccttttttgaacgtttttatcaggaaataatcctgatacgattcaaactccaagggtttaatggatttattaaagtcttttatttcatttattaacctcctcttatcattgattaaactttgcaaatcactattttttatgatttccgtatttgtactcattcgcactttcttataacaccttcctgttgttctaattaaattcttttaattaaaattaatagttattttatatgcaatgtcttatgatcacttctagctgtcagtgttcctaggatagtgttcaacagcgtttaatattaatatattgagatacttccgccagataaaagaaatccttacgttaaatatatatcattcgtgtgccgcgaaaattctttctttagcaacagatataaatcaggtatagaaaatcaaacgtcaaagaaggcggcagaaaagtcacactattcctttttctcgtcgatattttcaatagttttataaaaattgtatgtagctcatataaatatcaattatcgaattacaatttacccaaggaatcgatcatatctaacaaatcatcttccaattgaggtttgtcaaattgtttccgatctacttcaggttgggcattatgctcttgaccctctttgctagtaattccttggatccaattgcaaacttgggatacgaatggtttcgagtttgggacaaaatgggctccaggatgaaccaacaatgtccttttgttatcgggccatgactcgtacaatgccatgattctagattctgctacaacttcatctaactccccccttacatgtagagagggcacctggataatcctatgatattctttctggtaggattgatcttctaatttgaatccactaaatgaaataaaaaattttaaagcgggctgttgttcatcagtaagatttaatattctgttaaagtcagtgactaagtagcccccaagacctgcaccttggctgaatccaatgacaccatcaaatggtccattttctagcacgtagttacgtaaatagttaaacaccttttgatctatttgaaaggaattgaaagattcgggatttctaaagaaccacccgtatacttcatcactagtcgctgaggtgttgaattccttcgcagcatctctacccttttctgactctgattggaataacgcttttttatcaattgaatgtggggcgcaaggatagtataaatcgtaacctaacttcttcaaattctttcgtaatcctccagtcttcgcagaaaatatcttatcggattggacaaaaccatgtagcattagaactttcttcttttcactcataataataattctggggtttgtggtagaattcagtttgaaaatgcaccgaagtagaacagattactttctgtattactgcatccatagtgttctttatacgcacaactagaaaaagtaaatttctatcctctgacaacaaagcgaaaaagtagtaaaacttgataccagaccatgctccatatgacgatttaaaaggtttattctgtcaagatgtgcctgctcgaacttaataaggggttttattgtatctgtatcctaagtatgcttgacggtaattaaagagctttaattggttgccatgacaacggctcttactaaaatccatgctgcagcgatgttcaatcatacataccgtaatcctcgcgtaaacattcagagaagtacatgacaaagtttgctgttctttatatctgtatatattaaataatggggatagtgacaccacttagcctgtaaataaggaatattcgcactatttagtcaaaaaatccatcatcatcatcattaatgttgccatcatcatttccacctatgccgacattaaattttcctctaatacctgacctgatcgattttttttcaccgtaatgcaattttctctcttccctggattcttcatcgtctcggttcattatcagtctgttgtctccttctgcaacagcgccaacttttaccataaaatcttcaaagtcttccatcttggaattattaccacccagttctagtagcgttatcatgtttttgattacctcaccccggtaatatacaattaatgtcgggcaattggattcgggatagttttcaattgctctattggcaggtatttctacaaattttatttctctgaatttgcatgcagcagattggaaaagatgagacagaattctgctttgtagtttactttgaagcgagagatgaacgaatacgtagacaccaccgtcatcctcttcaccattgtcattggtttgtgcaccttcatatttctttccctgactggccaaagtaacctctttgttgtattcaggtttgttaatgtggaaaacttctccaaatttggaacgttcctgtaatttgcggatttcatttaatcttttgatcttgtaagcttccaagaaatcttcatcttcatcgtcttctagttcttccaaatccgacaagtctttatcttctagtctattttcatgctgcttggcaattgcttcttctaatgcttcttctaactttgcagtgggcgaaggtgcacgttctggtattacacccttcgctcttaaaatatcgttccattcactgtcttcagattcgtccacctggacctgaaacattggttcattctgcattatgtctgctgaatatgcctttcttctcagtgatgtttactcgaaggcgttatcttgtactgcagatttcttcaggtcgatcatataaccttttctttttttcctctagcgggatttcctcttttttcagtaattttttttccagcgatattaatacaatgggaaaatcaggtcgtcacaatattacttaattcttttttgaattgtagaacataaagtattgctttattcattctggttcgaattagtctcatactgtaagatcaaagcggcaacgaagctcgaagctatacaagcacccaaaaatatatttatacccaagaatgactaaggaagtaccatattattgcgataatgacgataacaacatcatcagattattcattattaggcatggacaaacagaacacaatgtaaaaaaaattttgcaaggtcacaaagatacctcgatcaatcctacgggagaagaacaagccactaaattggggcattacttgcgttcaagaggtattcattttgataaggttgtcagtagtgatttaaaaaggtgtaggcaaactacggctttagttttgaaacattcaaaacaagaaaatgtgcctacttcctatacttcggggttaagggagcgttatatgggtgttattgaaggtatgcagattactgaggctgaaaagtatgctgataaacatggtgaaggctcctttagaaattttggggaaaaaagtgacgattttgttgctaggttaactggatgtgtcgaagaagaagttgctgaagcatctaatgaaggtgtcaagaatctagccctagttagtcatggaggtgctatcagaatgattttacaatggttaaagtatgaaaatcatcaagctcataagatcattgttttcaacacctctgtcactatagttgattacgtcaaggactccaagcagtttattgtgagacgtgtcggaaacacccaacatcttggtgatggcgaatttgtcgtcagtgacttaagattacgttagacactatatggttattcactgttgggtttttctcattttgtattagaaatgcggtttaggtagtaatagaaatttcgcatgcgtgtattttattttaaaacatatagttcgtaagggtttatctaaatgcagtagatgttcataaattataggggttttatgtttttatattattgatatagtttttcacatgagatgagaacgacgcgtttattttaaaggaaagaaaactgtgtcgtaatatgtaacaagactacattgatactccatagcagagaaatggatatgttctgtcggtggtaaattcaggtgaattgtatatcagtgaaactatgcaacaaacaaaatttggcaagatgtatttggaccacgattcggtagttgagtactcagaagatgaaattgtcgaagccgatcgtattacattgggctataaaaagagattgtcaatgattgaaaatcaaatgcgacatcttttggaggattttagtttggacgttcagcagattgaacccattcttgccgacttgcagaagtactacgacgcgtttctacaacttttacagaaaaggaacaaatcattacaatgtaagaggtccactcaccagccggtcccatccccaatgaatagccagacatcaacaaatgcaaaggttaatttgagcggaaagcttatgaagtttcagctaaatagtgtacaaaagttcgacgaagaaaatatactaaggattctgcaaaataaaatagaattcgaacattatttccaaattgataaaggtaagaagcaaaaggtgctattacttgccgtatatcaatgcctcaatgggccaacacgtttgcataaagtgcttaatattgagggaattatacataataatagtatcagaactatactgggcaaacaagtgtccagttctaagtggacagtgtttctgtacgatgtaaaactagttttattggcgcatagacaagatgttccgaacttagaaactagcaagatgatcgtcagatatggtgatttatttccctgtgcattgtacttcaaagatcatacagcatactaagcgctttccagggacaccttctgtcgcaaaatatcagaatttttcttgattaaacgcagcatattgagtatatgaaattaacgggacactgtgtgaaaaatttgtagttgtacttttttgttatcccctttggtagacatatggacgaattactactaagattggcttccataaggcccaaatccagatatcacctacggtatgtccttttcctacttgcaatgacaaataatttgttatttatcttggaacctatataagttacatctgattgcttttgtattttttttggagaatattattacccgcggggaaggaagtaaggggagaatttttgaggtgtataaaagagagtggaggcttaatcaatcaaagaattctttctcgtttattttcagggtttgtgactaagaaacgatattaaaatgtggaaggccgtgatgaatgcttggaatggaaccgagagtcaaagtaagaatgtttcaaatattcaatcttacagttttgaagacatgaaaagaatcgttggaaagcatgatcctaatgtggttttggtagatgttagagaaccatctgagtactcgattgttcatattcctgcttccatcaatgtgccatatagatcgcaccctgacgcatttgccttagatcctttagaatttgagaaacagattggcatcccaaaacctgacagtgccaaggagctaatattttattgtgcttctggcaaacgcgggggagaagctcaaaaagtcgcctcctcacatggatattcaaacacctcactatatcctggctctatgaatgattgggtttctcatgggggtgataaacttgacttatagccttgtatactctaggtatgtaccctgtgtattttcgtaagctagtaacgtattatgccatttatgtcacaccgttcataatatttgcctattgcattggctgtgatagcggcggcgcaaagaaattaggaagtataaaaaaaaaaatacaaaacttaatctgaatggaataagatagcgataactctcaacaaatggaagcgagacagaagaaaaagaccaacgatgttcaagcatagtacaggtattctctcgaggacagtttctgcaagatcgcctacattggtcctgagaacatttacaacgaaggctccaaagatctatacttttgaccaggtcaggaacctagtcgaacaccccaatgataaaaaactattggtagatgtaagggaacccaaggaagtaaaggattacaagatgccaactacaataaatattccggtgaatagtgcccctggcgctcttggattgcccgaaaaggagtttcacaaagttttccaatttgctaaaccacctcacgataaagaattgatttttctttgtgcgaaaggagtaagagccaaaactgccgaagagttggctcgatcttatgggtacgaaaacactggtatctatcctggttctattactgagtggttagctaaaggtggtgctgacgttaagcccaaaaaataagccaaaaagaaacaagtataatcgatatatcctgtatatagacaaccttttgtgtatttcaaattttttgttgtcacctctccgattcattcgattttctccttgtggttcgcggataacctcttacttccattagtttatgtgtgcgtttatttttttatctttctctatatattactttaatgtgcattcttttgcttaaatactctacctacgattatgaaattcaaattgtttaaactctttacccaatctcttcttccttttcctttccatgaccttttcacgttgcttggccttcatgtgatcaaatttccacttttgcaccactttacgtttctcagactttttcaaatggtatctcgtattattgtttttattcatatcattttcgtattccttgagaatttcacgctcgagatctttgtttttcattgattgcaatctcgatttcatacttttcagtctttgttccatttcttcacgttctccctggtctatttttgatagaaattttctttcttgtaacagcttctgcagttcatcaatttctttttctctatattcgtccaagaactggtaacgttttcttatgatagaactatcaagggctttaccggtggacttatcaaatctgatgtcctgatagaggttagaccttttattcctcggtatttccagcccagggatatttcggactcgtggtacccttttcttggatgattgttctactggagcgtgtttgctcttcttttttggtactttctgaccatgatgagtttcatcctcactatcttcttcaaagaatccagcatcctcgtctgattggtcctcactgtcctcatcttcatcaaaactttcttctctgtatgtagttgtgatcggttttttgtgaacgggtttcgtatctttgaaatcttcttcatctattaccgtttcagccttcttcaaagaaccaaaagacaaggttttcaactcatcgtcacttgattcttgttcgtcaatttctcgcttacttttgttcgccattatgctctccaataagtttccgtcatcttcttctacgtcggagttcaagtctggcttcagatttttaaagtaatacgacatttttaaccttctagtgcttattgaccctctatacaatttttggatggcaatttaattatactatttagtacttattcttatgccccagttttccggtagaaaggcaagctcatcggttgaaaattttcaaagcgggtaataaacgtgtctttcggtatttaaccgctcagataaaagttattattgcaaataaaagtaaacgtccatgccatcagttagtggactatatagatacatatgttgtgtttaattagataatcattgaatgaggaaacgtaccactacaattcgtcgtgcttgtttcctgaggaggaatggttctttttaattggcttcttgccagtttttaagtaagcaatatattcagaacgtctactaaaaggaccctcattgggggtaatactaaaagtgtcccgcagaaatttggaaatgtcatttttgttgattgagttcccttcatactcccaaaatttatctttgtctgcatcaaaaacgacaagcttacttttatcgctctgtcgctgttcaggaatgaccttctgcaaatatttgaaaatctcaggagttttttcatatgttgggttcatatcggttagttgcttgagttttttgtttgaaattgaataaaaatcgaactttcctaaccaatcaagggcaatgcttttataaaccggtgaaattttgtcttgtttggaaaacaacaccacggaaagtttgggtgactttctaagtaaagagccaagtgtatctatacggacaaactttttgacatatgaccttattcttgaaagagaaaaatcaacaataggcgcgagagttcttgcacctgagtacacttcattggcatgagcgctgaaactttttttggcgttatctattggcttagataggtcaatttttgggggcctaaataccattaacgtgggaaatccgtttacgtcgtatttagcacacaaagccttattcttgttaaggtcacagtttacagcagcaacttggactacaccatccaatctttttgctgccttgcggaacgtactagagagcttcttacaatggccgcaccacggagcataaaattccactaatgatgtgtaatttgtgttatggatcgctttatcgaagctttttggcgttaactctgatatatgaggatcggaatcgtaaaagttttgcgcctttacttcattcataataaaaagtcccaaaaggagcttaataatattaagaaataacattatatgtcaaattttgtctctcctaattgtgttaagtggatgcttactgttgaaaatgactgcgaaaagatatttctcttcatgttatttaacttttacgtgtcaattttaatttttaccaaatttttatacgcctcgcaaggctcgaacaacggcccttttttcaagggataagcacatgacactgggcgacaaaggaggaatataaagagaaatttgcgtcaatttgtatccagataagatcctttgaaaagatggtttttggcttgtgcgatagtaatggctttaaggctatttcgaaaatccagtttttttgcaaagatatcaatggaaggccctaaaggttcatcgccatttgcgttttacgcattttatcaactttattcgcacttgaatccggggaaatcgagcagcctttctttagaagatattagaagaaggctataccccgactttaaaatagattacaatgagaaaacttcgttgttcataacttggaagaaaaagtccaataaacatcacacaatagacactaacgaagagaattatatacttagaggatgtatcggtacatttgctaagatgccgattgcacatggtattgagaaatattccttgattgctgctttagaggataggagattttctccgatccagaaaagggaattggtggacctgaaatgcagttgcaacatcttaggcaacttcaaaactatttttcgaggtggtggtaatccaaatggggacattttcgattgggaactcggaaagcacggtattgaactgtattttaagcatcccaaaacaggcaccacatgtagcgcaacctttttacctgatgttatgcctgagcaacattggaataaagaagatacctttgccaatttaatcgagaaggcgggttactggggcaatattagtgaagtaatggataattttgaaacttatttcattgaagtaataaggtacgagggcaaaaaaagttccataacttatgaggaatttaacaaacagttaaaagatatagaggcttagaaaataaccctcgttagttagtcttagaaacattaaaaaaaatatgcttttatacattgatcaagcttaaaaattggacgcaaccggaatcgaaccgatgacctcttccttgcaagggaagcgcgctaccaactgcgccatgtgccctgatgactgttgaaactgttgtatctcaaaatgagatatgtcagtatgacaatacgtcatcctgaacgttcataaaacacatatgaaacaaccttataacaaagcgaacaacatgagacaaaacccgtccttccttagctgaactacccaaaagtataaatgcctgaacaattagtttagatccgagattccgcgcttccaccacttagtatgattcatattttatataatatataagataagtaacattccgtgaattaatctgataaactgttttgacaactggttacttccctaagactgttatattaggattgtcaagacactccggtattactcgagcccgtaatacaacagaaactcatttctaatgagtggtaaatacatttgtgggaaatatctttaaggccatctcggacctgtatataatctccgagtatttccattaaagatgaatcaaatacatgaaatatctattaaagacatatactcaaggaaaagaagtagtagatatatcttctttatatatattgccctgtgttgctagcagggtgttggaacaaataatttgttccgtattggaaaatttataattaggtccaagaacaagttcactatgatgacgacatattactttgttcaaagagatggtttaaaataaatatgtatagcagaattataagaggcgaaatcgatcaattagttgaacaattaacttaaaatctaatatatataaatatatatatatatatatataggaaatatacggcacgttatactagagatattaaacatcccaactcggttaatgggtacaataaaaaaaagagggattaatgtttgtctacgtataaacgaataagtacttatattgctttaggaaggtactatacactcgcttctgtcatgctcgagtccgcttcatctgtgaaagattcagccacgcttgaagtaacaacaggaggcaagacgaggggtctggtgccatactgttcatcaaattcagtaaagtcgagttgtgagttatcgcccattatctcacagtatttcttcgtaaccactttttccagttctaaagagtcttcgtatactactgaaccctcagtattgtatatcctagcattggaaaatatcagatgaaagtcttgaagggtctctttaagggagttgtaagctagcgtttcaatatgcgtgttaatattatcaaaggcgacagggtacttaataatcatatagtagtcgggatatagtgctttggaaggtttggagaggaaaatgtcagaaagtttccttccagcttcattttcataattgagagcaaagtggtataagtctagagcttgtttagcaactttctctctaatatcaataggactcgttgccgcagcgggcgtgcggacataatcaagcccatttcttgcttttggcggccttcctcgtccacgtcctcgccctcgaccacgaccacgaccgcgaccacggccccttgttgaagttcttgctgatttaacagatgtttttcccgctgtacgtggttttggaatgtccataaaatcctcactgggagagttatcgccagtaactggacttgattcaagcgctggtggttcagaattttcagatccttcaagtttcactttcttaggtcttccacggggccttcctgcctttctctttttagacaagaaatcatcgtcattcattgccaaatccgtatctgcccgatcttcggccgatatattattaattctaggaccgtcattatcagcgtcaatgttttcgcctttaatttctccattcccatcaatcgcctcgctcttatcttccttctttgttcgttgttttcttgcctgcttgtcatttttttcatcatcgctaacttcaaattgtcttaaccactgttcttcagacatattatcgttgtaagttgccgtcttacgttctcttgcaccccttccattgtaaacagcagcagattctgattcttcacgtttgagctcggcaccaatatctctactgtaaatatcaggtaattcactcttttctaagagacggctctttactcccaattcttcctccttctttgatctatcttcatccatccttgtaagaacagccatttcttcgtcatttcgagcaagaatttcgttgatttctgagtcttttaactcctcttcttcttcaacaccagactctcttttctttctacgttcctcttctgcatccagcaaagatctaagcaacgcttcttgttcctccgatgtagatttgttatcgaatttacctgcttgaatgactttaccatcgatatctagcttcttgtaggctctctctaggataacttcttcaactgaattcgtagtaatcaatcttagaattctaacttcattcttctgacctattctatgcgctctatcctgagcttgcaaatcttgatgaggattccagtcagtatcaaaaataatgacagtgtctgcagtttgtaaatttaaacccaaaccacccgctctagttgataagataaagcacaagtattcagaatcaggggcgttaaatagacgtaacaactcactacgttcatcagattttgtatgaccatctaacctcaggtacttgatattaatgtaccttaaaaaatcttccataatatccataatttgggtcatttgaaaaaaaattaatactctatgcccagttgccttaagcttaggcaaaattctatctaatagttcaaatttaccagcaacacgccaaatatcatcattcgtttctcttgttggattgatttggtcctcaacttcttcaaatacaaaaggatgattacagattttctttagttgcatgatttgattattgaaacctcttaaacctaccattttcttattattttgatcaccgataaaaagacgacgatatttcaacatttgttggtacataatttgttgtaaagcgctcattttgcacttcactaccttctcaactttatccggtaattctttttctacatcctttttcaaacgacgcaataaaaagggtctcaagactttatgcaatctcctgataaccaaaagcgtctcttcttcactcaactcaattttatcttgcccaccggtgttggcaaagggtgtattgaaccattcatcaaaagatttcacggaattgaaaatcttgggtaacacaaaattcaataaggcccataattctggcaagttgttttgaagtggtgtacctgtcaaaattaatctataatctgcatggtaatgtgtgttcaaggttaaagaaagcttggattgcgcatttttcattctatggccttcatcaataatcatatggacccacttgaccttggataaaagtgctctttctttaataatatactcaaaggtagtcagaactacatcaaattcacctgcccttattttagcctgtttggctttcctctcatttggcgaacctttaaatgatatagttcttaaggtaggagcccatttcgcgaattcactgctccaatttgacagtgtagataaaggaacaatgactaaatatggcccacgaatattcttcatttcatataaatatgtaagtaaggatatcgtctggatagtcttaccaagacccatttcgtctgctaaaataccatttaaatgattattgaaaagcgaaaccatccactgtaaacccttgatttgatagtcctttaaggtaccaccaaccaatattgaaggctgcttcttgatatcttctttaattctatgtgcgacattgtaataatcgacgttagaattgtcgtcgtcgtcatcatattcttcatccttcatcttggggaccatggacaaatcatccacttcctccgatgcttcctttatgtgggaatcaatcatttctttagtgtacttttgttgatctttcacggctcttgttaaagaatctaaaaatgcgtttgtttgccttagaagatgtgtaattcttgtatctttggtttggtctaataattttatataggcttcctcatcgttcgcctttaaagcctgtaaacgttcttttgcctttttttcagctctcttttgctcatccctttctaaattagtatgcgtagcaatgagtctatggccaaacttcaaccttttattctttttatcttgtcttctattatattgattgatggcggatttattcatcgactttaatctggccactgcctcagtcttcttcctttctaacttaagtaattcatgattcttataaagttggtttgttagcaatgcatcttgaacgttgatgtttcttattttcgaaagaaaatttggatgtgtattggttaataaagaattttgatgccattcaaattgtaatacatgacctcttacggctttttgtaacggtaataattgtaaggcgtagtaatcgtaaagagcattttccctggttgattccgtacattcgtcatttagtagcttatccaaacagtcatttaccgtagtatctaggttcaatgcaattaaagtttggtaaatgtcagtagcggtatgtgtgtcaataccaaccggtagaacgccaggttcaatagtaaactttgcatgatccgaattggccaataaagtctgataatcgatattactatgtgagatattgggcatcgtaaaagaatcaaccatcatatcaggatcatctatatctaccacttttattccttccttatattgatcttgaaggacgtttaaaggaacgggtttctgcggttttggcgggttattttgctcggtgtgggtcttattactattaggagctgttttagctacgtttgaaatggtttcgttttcctcttttttcgattctgtttgcgtgattggagtgccacttacagtttgcgaatttttatcgagggtgccattcttcgcattatgtacactagatggaccagctggtgaaacagatgcaaaattttcgtctttgctatctaaaggtgcatttctggtaagcccagaaacgttgtcagtgttagtgttattgtagtgggaattggtgccgggttgctgcgtattgttgccgccattgagatttgattggttattttgatctgtgggttgtcttcttctcgcaaactcactcaaagacagtaacattcttttgaaatctggaggatggttaatagatttttggataacagcctgaaattcaaacggaataggctttctatttactagacattttagagatgtgatttgggcctttaacagttcggattgctcggcagtaaacattgtcatgggtaatcttctcccctgttgcagtctcgcttgtgcttgttgtgcctgttgtgcctgttgcgcttgttgcgcctgttgtgcttggaattgtgcctgctgcatctgcgcctgctggggcataggagaatttatctgcgaacctggcatcacatttgaatcctgtatgttgtgttcttgtaatgatcgattttgcggttgaagctcggaattattaaggtttaagttattatggtttgagttatctggtttctccgcagcattttctccattgtttgctggtgttggtgaaaaattagttgcatttaatgaaccaaccgaagattgccgttgtggtagcatgttattaccaccattgctatttaatggcatctgtgtttgcatgattggtgattgatgagcagaagtgctaaaggtctcatttccattcaattgcatattcggagctaaatgcggggaagcagaagcagaaatgtgcgaggaagcattattcggcagttctgcttgatctgaagaatttggaacaatattttgctgagaacctgaaatgccttgctgttggcgttgcatttgtaattcttgtcgctgcttggcagcaaattgcaacactttagtcaaatagataaattccggcacactcggagcgttcattccgtgttcatttctcaaatgctgccatcttaaatagcagcggttgacctcttcgttgctaaattgacgctgtggtatgttcatggcagataattaatcgaaagtcgtgaaaatagcagaaagtcgcgattagagaaacaacagaatagctgaccttcccgatgatttatatacaaaaggtccacgtacgtcacaaatatcttctttattgagactagaggtaacctttcttttaacttattgtcctaccgcctcaggatggccccgtttcgtcaatcaatttgttgatatttgtctttcaaacgcggttttaacatatcgcgaacaacggtattcgggtaacagcctatcactatttttaccggcggctatttttcctaaacctagtatatatacgcgaaaattggctacctgcaaaattccaatagtggcgaatgtattggaattaatctgcaaggaaaataagcgttaggaacttcaactgtattttgctcactaattcttcttcatcatgtcttcttctttttttttcaattacttgttagttcttagtgtccttatgttcactcagaatagccattaagaatcgtgtctttttggaagtgaaggagtttcaataaaaagaaaaaagcgaatatttcaacactgtgttctaagaaaaggctctatagctttttttattagttttattaatttgaaaaatgccttgtttgttttatatatatatatgtgtgtatttagggcagccgcggccaacagggggtatgggtatgaagaggtgatagaagagtgaaaaatgaaaaaaaatggaaatcaaggaaagagtagtgaaaaaaagaaaaaaaggaaaaaagggcaaaaagagaacgcaataccatagagttggaggtgttggacttgtgaatttatttttgattgaaaatagttcagagtcaatagattcttctttaaaataaaaaggagcccagacttactgatagatcttgcatatactccggtaatggatattccctcttcaaaccaaattcaacatggccaaaggagtgaaaggaaccgaagaatgccgagggcttctttttcttctacagccactacttctacggcggccacattgacttccgcgatggtactggatcagaacaattcggaaccgtacgcaggtgcaacattcgaagccgtgccaagttctattgtatcattccatcaccctcattcttttcaatcaagcaacctcccaagtccgcattcttcagggaacctagagcagagaggccgccgattgactgaatcagagcctttagtattatcctcggctgaacagtctcgaagctcttctagaaacccttctcattttcgatttttcactcaggagcaaatatccaatgctgaaggcgcttccacgttagaaaatacagattatgacatggcctgggatgccacccccgcttatgaacaagatagaatctatggtacgggcctatcttccaggcgttcttctattcgaagtttttccagagcatcatctctctcaaatgcaaagtcttatggatctttcagtaagaggggtcgctctggttcaagggcaccacaaaggctgggagaaaattctgacactgggttcgtttatcattccgctacacattcatcatccagtttatcgagatatacgaccagagaaagaattcctattgaactagaaagtcaaacagatgaaatactagaagacgagtcttctacacattctttagaatcttcagatagtaggcgatctgcaagcgaaaataatagaggaagcttttctggtcatgatgatgttcataatcagcatagcgaatatctaaaacctgactatcatgaaaagttttatccacagtatgcaccaaacttgcattaccaaaggttttacattgcggaagaggatttagttattggtatcgctgcttaccagacctcaaaattctggtatattatttacaacctgtgctgcttcttgactttcggattagtttatcttttaacgagatggcttccccatctcaaagttaaattatatggcgtgaaagtgccattggctaaagcagaatgggtcgtgatagaaaatgagtttggtgagtttgtcatacaacctatcgatcgacagtggtataatagaccattaagtactgttttaccttttgaaaattaccctaatccgtcatatgaaccaaatgatatcaatttgagccaccaccatgccaatgaaattaatccaaatgtgcctatcttgatcacatttgaatacagatatattaagttcatatattcaccgctcgatgatctctttaaaactaacaataactggatagatcctgactgggtggatttaagtaccgtatcaaatggtttaactaagggggttcaagaagatagagaacttgcgtttggtaaaaatcaaattaatttgagaatgaaaactacttcagaaattttattcaatgaagtgttgcatccgttttatgtctttcaagtattttcgataattttgtggggcattgatgaatactactactacgccgcatgcatttttttgatttctgtactgtctatttttgattcattgaatgaacagaagaaagtatcgagaaacttagctgaaatgtcgcactttcattgtgacgttcgtgttttgagggataagttttggacaacgataagctcatcagaactagttccgggcgatatatatgaagtatctgacccaaatataacaatattgccttgtgactctattcttctgtccagtgattgtatagtcaatgaatccatgctaactggtgaatctgtgcccgtttcgaaatttccagctacggaagaaacaatgtaccaattatgtgacgacttccagagcacccaaatatcgagttttgtttccaaatccttcttgtataatggtacaaatataattagagcaagaattgcccccgggcaaaccgccgctttggcgatggttgtaaggacaggattctcaacaacaaagggctccttggttcgttccatggttttcccaaaaccaactggttttaaattctatagagattcctttaaatatattggattcatgtcattaatcgcaattttcggtttttgcgtcagttgcgttcagttcattaaacttggtttagacaaaaagacaatgatattaagagctttagatatcataacaattgtagtgccaccagctctgcccgcgactttaaccattggtaccaattttgctttgagtaggttaaaggagaagggaatattttgtatctctccaacaaggcttaacattagtggtaaaatcgatgttatgtgttttgataaaactggaacacttaccgaagatggcttagatgtacttggagtacaaatatcggagccaaatggggttagaggccagaagtttggagaactattgagtgatattcgccaagtatttcctaaattttctttgaacgattgtagttcgccattagattttaagtccaggaactttttcatgtcattattaacatgtcactcgctgagatcagttgatggaaatttactcggtgacccactagactttaaaatgtttcaatttaccggttggtcattcgaggaggacttccaaaaacgagcattccattcattatacgagggaagacatgaagatgatgttttcccagaaaattcagaaatcattcctgcggtagttcaccctgatagtaataatagagaaaatacgtttactgataatgatcctcataattttctaggggtggtgagaagctttgaatttttatctgagctgagacgtatgagcgtaattgttaaaacgaataatgacgacgtatattggtcgtttactaaaggtgcgcccgaagttatttcagaaatatgtaataaatcaactttacctgcagattttgaagaagtactacgttgttacactcataacggatatagggttattgcatgtgctgggaagacacttccaaaaagaacttggttatattcccaaaaagtatctagggaagaggttgagtcaaatttggaatttttaggtttcattatcttccaaaataaactaaaaaaagagacctctgaaactctgaaaagtttacaagatgcaaacatcaggacgataatgtgtacgggtgataacatacttactgctatttccgtaggtagggaagctggtttgatacaatgctctcgcgtttatgttccatccattaatgatacacccttgcacggtgagcccgtaatagtatggagggacgtcaatgagccagataaaattttggataccaagactttgaaacctgtcaagctggggaataatagtgttgaaagtctacgtgagtgtaactatactcttgcagttagcggcgatgtatttagactgttgttcagagatgaaaacgagataccagaggaatacttaaacgagattttattgaattcatcaatctacgcaagaatgtcgcctgatgaaaagcatgaattgatgatacagctgcagaagctagattatacagttgggttctgtggtgatggtgcaaatgattgtggggcactcaaagcggcagacgtaggtatttccctttcggaggctgaagcttcagttgctgctccgttcacttcaaagatatttaatattagctgcgtacttgatgtcattagggaagggcgtgctgcgttagttacatcttttgcatgtttccagtacatgagtttgtactctgccatccaattcatcactattactatactttacagccgtggttctaatttgggagatttccaattcctgtacattgatttattgctgatcgttccgatcgcaatttgcatgtcatggtccaaatcctatgaaaagatagataaaaagaggccttccgctaacctagtttcacctaagattttggttcctcttttgattagcgtattcttggtgtttttattccagttcattccatggataatcgtacaaaagatgagctggtacatcaagccaatcgttgggggcgacgacgccgtgcaatcttcagataataccgtattgttcttcgtctcaaattttcaatatattttgactgctatagttttgtctgtgggtccaccatatagagagccgatgtcaaaaaactttgaatttatcgttgatatcactgtctctatcggtgcaagtctactgctaatgactttggatacagaatcataccttggtaagatgttacagctgacccctatatcaaacagttttacaatgtttatcattgtatgggtgatattaaattactatgctcaactgtatataccgccatcgataaaaggttggttaaagaaaaagaagagtagcaaaaagtataaactactgatacaagaagaaatgaaattaaaagaagtttaaagcaaagatttttatctatgtatgtgtacaagtaccatgttctataattaaaattattactatttagacgcatttctcatcgaaaggaagcaattccataccactccaactgaagagctaaaaggtgcttggaaatctctaggcattataaggaaattaatgaattgtaccattggccacaccagatagttacaaccaagcgtagatatatatagcctttggattttcttgccaagggtgtccttatctccaccttccatcacatagtttgagaacataaagaaacaatagagagagattggcgaataaaggagctgatccgaaagaaccctttcaaaaacctgtaccactgtcggatcttcagtgtaaaagaaattcaagaacttgtaccaaggagcctggaaaaatgatataaaaaatccccagaacataaaacacccccacctgaagaagtcaaatgtgtccgttttgaaagtagctaatggcctatcaagttcaggatagtcgtcgttatccgtgtaggagctatgttccgaggtaaaatcattgaagatagatagctcatcactttcataacctcctccattttctacatcacggttgttctgaacatgatgaaaggtatcgttaagtatttgcggtatagggtccacgtgatatgaataaaagcaggctatactttgtgctagtatgtcagatatcccaaataaaagaatgttcgtgcataaagttgcaaaaacagcagaattagcatacagctgtctataatgactggtaaatttccataggctagtaacccatatgactaacagcaaccagtgcgtaagtgttatacgttgtattcgcttgttcattaacgttcttaatgctgctgctgcccttcttgtccaagatccgagaacactttggtgattctggtcatcgttactcatgttgccgttatcataatgtacaacgatctgatccctgccaaaaagttgaagaggcatctacagaattgaaaaaactttcgaaatatatactctgagttcttgctccccgttttgtacgatgttcctaatgcaaacacacgtcctttaaagatcccctgataggtttcattaaaggcaacttccatacacgttgaagtgccaattttttccctacatccaagcattctgggtttgtatgggtgttacaccggtttttcttttttatttccagagaagtacaattttaggcgggtttcaaatttcccctgtgtgcgagaaacgctccggtacgcctaggctcactccggtccttctccccatttctatcagcgcgataggcatactgtgggagagcggcactagggagaccggtgggaagcaccgtatctagtaacgcacgctcttttgcaaaaatatccattaattgcatgtaacttagattaacactggtattaagatttcgcaattttgggctggattattaaggtcgagtagcaaagtttagcaagaacagtacgaactaagtagccaagatgttgatgccaaaggaagacagaaacaagatccaccaatacttattccaaggtatgttttagaataactttcagaaagcatgaagatacacggaaagtcaagcgagggaagttatgcgtatacacagtagcggtagtgtgcattcacatacacgatgtttcaaacacacagatggataccatgcatatgaggttaaaggatttcttatgaatatattagtggattacatagaagaaattacaaggaaccgtgtgacgacattttcgaaaggacagcacaaggccatcgaccctggagacgtatgaaatatggtatacgtcctatatttgggcaagaaaacggtaaaactgttttacgcggagatccaacttttgatccttaccgagtaccacgaatcatctatatgatctttttactaacttatcttcaatttcaacggagagatgtaaacatcattctctcctatgataatttctttttttatacagaaggtgttgttgtcgccaagaaggatttcaaccaagccaagcacgaagaaattgacaccaagaacttgtatgtcattaaggctttacaatccttgacttctaagggttacgtcaagactcaattctcatggcaatactactactacaccttgactgaagaaggtgttgaatacttgagagaatacttgaacttgccagaacacattgttccaggtacctacattcaagaaagaaacccaactcaaagaccacaaagaagatattaaggaattcgtagctccaattgaattttctcttttgtaacattcttctggttctatatatctaggtttatattttgatgtgttgtactttcaattacattgaacttatgtatattttttaattaataaagtgaaatcaaaagcaaagtcaaggttgccgagtaaacggtttgtatggtatttctgtcgtatatagcagataatcaccatatatatatatataccatggtgatagtctgtagcttttacaatgcaaatggcggcgcacgactataatattcagaaatagtaatttcatcatcttttgcttctcttgccgaaatagatacttttttcgcgatcaccctacgcataaaaatttttccaagtgatgagatgagcctttaacaaaaaaagtgcagtttgatttcagaagggtcgtttcttagtgtactttatatcatcgactaagccgtatatccagacagcatatacctatatactattctagatgtcagcagaagattacaagaacttaccagtcaccgttgaaaagcctatcccagtggtatacgatttgggtaacctggcagcattcgatagtaatgtcttggataaaaacgatttagattcttcgaatgctaggcgtgaagaaaagataaagagtcttactcgtgataatgttcagttactaatcaatcaactattatcactacctatgaaaacaacaacggagtctgtaggtggcaccggcggtcaaagttccgtgatgaccttgttgcagcttcctgaccctaccactgacttaccaagagaaaagccactgccaaaggctaaggctatgaccaaatgggagaagtttgcagctaagaagggtattaaaccaaaggaaagggcaggaaagatgatttatgatgaggcatccggtgaatgggttccaaagtggggctacaagggcgcaaataagaagttagatgatcaatggttggtggaagttgatgataaagtaaaaggcactgacaatgaattgatcgatccaagaactttgaatagggcagaaagaaaacgtttagtcaagaagaacgaaaaacaacaaaggagaaatatgaagaatgccttatgatagtgaaagacgttgttgcttcctacttgcgtccccaatcgatccgctaaccttttttttaactacagcataacctcacatctacgtatccttacatctataatatttttaaataattgtaaattagaaaaacatcaaaattccgttctatattttgatacatttttttgcagtagtccaagatgagatcagaataagataggtgaaaattttaacaagtactaaagcgttcgttgacagctttctttgcgttgccatggctgaattaaacgattatagtacgatgatcgatattcttctctctgatatggatttggaaacggtcacaactaaaaaggttaggatggctttgaaagaagtatatgcaatcgacgttgaatcacagggaaaagcaattaacaaattgattaggaaacatctagatcttgtaaaagaaaggccgcgcttcgaaagatctcttgaggatctgctaaaggaaaatgctactttggcgattgagctcaccaaggaaattaccgtaagcaaacgatcatctggagaggaaaagaacgatagcgaaaccaaaggtactcatgttgagaagaaaaaagggactgttagtaagtcacctatttcaacacgaaaagttacactatctaaatcattagcgagtttgctaggagagcatgaattgacgaggaccgaagtagtacgacgactctgggcatatattaaagcgcataatctgcagaatcctaacaacaagaaagaaatactgtgcgacgaaaaattagaattaatacttggcaagagtaccaatatgtttgagatgcacaaaattttggcaagtcatatgacagagcctaaaaaaataagcgactgtcctcctcttatccaagaagtccgtagaaaggaaaagcccatcgtttcagattccgagcaatcagatacaaagggcatttgaatcaaggatatcatgaaaatttcaaggcgttgaaatttgtgttgttaaggcaacactataggaatgaaaaatggcctctctattataaagtccttttgccttattttttcggtagctgcctacaatttgtaacgttaacattcccgggtgaaaagatacatgagtatgtagagatttgtatatatatacctacgtagaaaatagaaaggcgaatagctctgctcctagttgaatattagtagcgttctcacatcattaagaggataagccggcattttatagggcttttgcagctagtgtgaaacttatgaatcgaacagtctccacattatcatctactgtatctgatgtatccgtggaaataccgtcaatatgcaacgtcattaataccgaattaccaacatcagatgtctatctttacactttaaaactaattttgttggattatatcaacgaaccgcgatttaaagaagcagctttgctatcgaataggacaggaacgtcaagggttttatctgacaaaacgaatcatcagcaaacgcaacatgggaagaaactagtggttgacaaacaagacgatatgtcggaacgcgatatagtacaggcaactttacgtatattaaaagggaagttggcacaaatttcaggaaataaaaacttggcgccgaatgagatgcattggaaaagtattgttaagatgtattatagcatgctcgattcttctagtgcagatacattttccaagatgggtcaaatggaggaggtggtcggttatttcacaaatattgccagtaatgaactaaagaaaatgactattaaaaattctcgtgacgagctgttcagtgaagttgcttattttatagacctagtaattgatgtacttccagatagttgtgcaaatatcataaagagactgcttgattataagattaatcttaaaaaaggcgagacaacagtaaagaagaaaagagccgcctcacctgccacagtccctcaatatagaagcatttccgggagcacgattagcaataagcaaccctctttcaaagtccaagatatttcacatatgaagtattttatgcagttattcgaaacagatgaaacaaagcttcaccaagacgtaatggctgttaaggacgattgtacaaatcccatattttgcggtgaactaagatatcttaggaaaaaaatcaagaaagacaacggtactttgacggcttctgatttttcaagtgacagagaatacaatttatggaagaattatgaacttcttgaaattgcaaatttaatggatcgatttgagataggcgaaaaggttacctctcacggaaaccgtcttatacccaaggatgcaaaaagcgtatttgtccgtctcataggccttgttttaaaaaaagagtgttctaatgctgtaaatgccataaatctttctcaagaagctctattcttctttcataaatcagcgaggtattggagaatagaatatccttccaccatctcctcgttggtttattcagcagcaaatttaagtgttctaggagatgaagagctaaatatcccaataactgaaaacttgttttctgtcatccgcaataaatatttatgttcagaggataatctggatccatccgcttggaatgctcaggatcgctatttatgggctgcaaacctttttcatacgactgatcagtctatgaggacaataaataaccttttaactgcgatattttcaggtacaaagccaaaattttctccagttttgtcattttattattcaaacattgttggggatccagtaatggaattctatgaaacgcagtccgtagctgtaaagaaatactggatcaaattatttaagaagactctttttaaagcatcagaggattattttgtctcccttctgcaggatatgctaaaggctaacgcaatagaaattcaaaacgttcagaatctcgtagaaacaattatagaagccataaaagcgattcaaaaacgttacaataaacctttattggacgaaatatctctgcctagacaatgcgcagtatttctatgtgaagtatacggttcggattctttaaatctaataaaaaccgctgaaaagagtaccatgaaaatgactggacaaaagttgggtccaatagatgcgctagatatgtatgatgtactgaaagaactgagacagatttacctgcaggtaaagccaaaagggaaatttttctttaaccttgaaaattatttcatcaaatatttgactcgattatgtgatgatgtgagccgtaatgttcaaaaagttattaaatcttcactagaaagcgagaattggcaacccgtaaatgaccaggaccatttcagtagatcagttttggacatattcaaaatgataaatgaatcaactagcatgttggagaaatttggttggcaaaatgaatttcaactggcacaaatgatcacggtaatattaaaggcgttttcagatggtatgctttcatactcagctcaactaatggaattgatccagagagatttacaggagggtgatgaaccatcctactctttagaaagctcagacactcgatcttcacttagcctgaataacgctaacgtaaatcatgaaaaatcaagaagtagtaggctgtttgaagatttgaaaaatgtagttaaatcaactccgaagatggtagctcctgctccatatcagttcaagaagcgtacgtgcgtactgctaaatgatcttgataaaacactttttctgttagagagcttcgaagaaaaagcagatccatcaaaaatatcctctgttattgcacagtaccactcctcccataatttagaggataatgggaagtcattcgatgaccagaatatgaagcaagtttatacccttcgaattatcggtgctgaaaatattaaaggcttcagcaaaacggggctttcaaacacctacgtttccatgagaaacatcactttacaacgggaaataggtactactaagattgttgcaagatcgattactcccaaatgggacgaagagtttgtgtttgagtctccattcggaaagtcgaacgatattatgtttactatatggcaccacccacacagcagattaaagaatttagcggaagatgatctatgtggaaaagccaatatgaaattcactccgagaaagctcaaggatgatgggtttcctatcgatttttcgctcacattgaatccgcagggaactttatattgccaaatatccctggaaagtgagaaaatagatgccgtttcttctatgggaagaatatatagatcttttagcaggtcaagagatcgtgcaataaacctaatagtcaacaaattttctgattttattgcatttgccttctcgagaaccacattaaaaacagtgtgtggtcaccatggttctgcacttgcgtctgacgaagcagtatatgacgcaattttaccactatttgactatttaaacgcaaatttgaacattctggcatcagaactttcacagagattgttgtttatggtaatgctaagagcgtggaacctcgttttagagaacgctgatttacttcttctacctgcattgaatagcgctaaagttaatatattgcgttcagcaaagaaatctttgtgggaaaatactctttcaaccacaaaaacggtatcaggatacggtcgtcctttgactcaagcggaaatcgaggctgtattcaaatggcttgatgcgctgtgtgtagatttttttcataataaaggagaaggtccccctcttgcagaattgaaaaatgagtattaccaaaatatattgctgatcccagctttttatgataaaagtgtctccgaattgaaggatgaagttcagcgattgattcccctatatgaagagtatttgagatggttttatctgaagaaaactccgattacttttacgaataaatccgctggaacaatatctcgaaaaaagtcgctagtagctaacattgtaaaagagcctaaggaacaactggaacgtgatgcagaagtaatgaatattatattgagaatattgatcgcgaaaggccaacatgattacgttcatcgaattttacatgacagaaaagaacttgttaatactatgaaaaatagaagagcggtgagtagagcggtcactcctacaggaaaaaagggcagaaactgaagtctcttttatatatatacatggggtgctgactaaacagttccaccctatatttgagcgtcgataaaaaatgaatgaacgtgtatcatcgtttattataagaatcatagttttatggacaagttttccgtttagcatttatacccatatagtaaaaagtttcgcagatagtgcgatagttgtattctgattgccttattattatttcactaattctttattcacgtagagcatgacactttttttatgtgtttccttttgattgtgaaataaaggcgaatcctaacaaatattaaaatgtttcaatacattgataaaaattgtaaacattatttttttgtagtataaaaattcgttcctcatcattaaagaaacaaaaagcatacagataataataaaaaaggcactttagacagaatgagaatactagcaatcacgaattcctacttttcctttctgtatccctaggcgtttcactcgacaagaattgatcgtcttgtaccaatccaagcagatcgatatatacatatatatctggatttcgagaagaaggatatattttattgcttatttgtctttttataaaatctctcctaagttaagttcatggggaatctgactctaaaaatgaaatcttagaaatgcaaaaaaaaagaaaaagtatgggtgagtcagtttcttccaaatatatacaaatggtcatcattttcattccaaagtttctttaccaggtcaacaaaaccattatttttcgtttccaattcgtagataccgtacagggacaacatggatcctccatagaggcaataaagggcgagcttatgccatcttggatactttcccttcggtatatagtcaataatacaacttgtgaagccatactgtaaatatatcaaaaaaatggacgataaagacgcatcgagtaaaggatttataaccccgccggtaaaggaggcataaaaaggtaccattgttaatggaatcaaagtatattttgctattctctcatagtctttttgataagagtccttaaattgagagaactctgggggcttaaacatctgcactgaagaggatgcctcttttgacgtatttgcaatatcgtttattttattttcagcatttaaacgattaatgctataaaaggatcttttggttgaaagtactaatcctggaaaaacagctcgtacaggatttacaatgacagtggaagcattaagaacaggcttcaagccaggaaacaatagcattaccaaaggtattaaattactcagttgttgcacctcgcatcaccgttaattaatgtgtgcattccactgtctggaagttttcatttttatccgatcttttgcgagaatggtttgtttttcaaaaaaaccgagtgtcaacaaggcatgtagcgacacaaaatgaaaaattgaaagttaacagggcaagatatgcaccataatagattcattgttaatcttaatcaaataaaatttctcttttccacacagaaaactaaacgaaaggtataactttaagatgggttttgttgatttcttcgaaacatatatggtcggttctagggtccagttcaaacagttagatatttctgattggttgagtctgaccccaaggttgcttattctttttggctatttttaccttcattctttttttactgcaatcaatcaattcctacagttcattaacacgaattccttctgtcttagactgcatttactatatgacagattttggtcgcatgtgcccataataggtgagtacaaaattcggctgctctcgagggcactgacatatagtaaactgaaaataataccaactttagacaaggtgctggaggcgattgaaatttggtttcagctacatttagttgaaatgaccttcgaaaaaaaaaaaaacgtccaaattttcataaccgagggaagtgatgacctaaacttttttaaagatagcaaattccaaaccacattaatgatatgtaatcatcgatcagtgaatgactacacattgattaattacctttttctcaaaagttgtcccaccaagttttatactaaatgggaatttctacaaaagctgaggaagggggaagatctagctgaatggcctcagttaaaatttcttggttggggaaaaatgtttaactttcctcgattggatctactaaagaacatattcttcaaagatgaaacactcgcactctcatcgaatgagttaagagatattttagaaagacaaaacaatcaagctattactatttttcccgaagtcaatatcatgagtttggaactatcaattattcaaagaaaattacaccaagattttccctttgttataaacttctataatttattatacccaagatttaaaaactttaccactttgatggctgctttttcatcaattaaaaacatcaaaagaaagaaaaaccgtaacaatataatcaaagaggcccgatacctgtttcacagagaacttgacaaattagttcacaagagcatgaaaatggagtcttccaaggtatccgataagacgacgccgcccatgatcgtagataattcatacttacttacaaaaaaggaagaaatcagcagcggcaagcccaaggtggtacgaatcaatccatacatatatgatgtcaccataatttattaccgagtcaaatatactgatagtgggcatgatcataccaacggagatttgagacttcataaaggttatcaattagagcaaatatctccgacaatctttgagatgattcaaccagaaatggagtctgaaaacaacataaaggataaggaccccattgttgtgatggtaaatgtaaaaaagcatcaaattcaaccattactcgcatacaatgatgagagtttagaaaagtggcttgaaaataggtggatagaaaaagatagattaatcgagtccttgcaaaaaaatattaaaattgagaccaaataaagatcctgaatcataatatatacgtgtgtacttcactttctatagaggaaaaaaagctaaaaaaaaaaaaaaatgataaaataaacgaaaaaaaccataaaacgatcatgatagaataatgtacattattaagaatgcttcattgatgacatgcagtgcgaaaagaaaggaacaaatgaaagaagacctcttcatttcttctttggagctcccaaaggcgaaccgatgttgttacctctcaatttaacgcctaaggctctttccaacttagacaaaacttgttggtttggaatagctctagcggcttcataatcgtttaccacggttggcttttcgttaattttggttgccaaatccttctgcgacattttcttgtctgttctggcacgcgagatggccctaccgacatttggatccaatttcttgggtttgacaatatctgtctcacggtcgaccttggtcaacctctgaccctcgttgtcacccctcgtattggttgatccgtacttcttgtcaacggaaacaaccaacccctgtcttcttgcagcattaatttggccttgagatctggcaacgttggcccttggcagaaccaccagctcttgctctgctaccaataatagtatttgtatcccagtcagacatttttctttacgattttgctcgttaacttttttgttttctagcttattagcttttacagttatggaagcgtagattcaaccttccctaacacatgaaactattattggttaacgacaggcgcctttccagctacctaatatataccaccaccgtcaaggggcgcccgttcatgaaagaggcaacgatggtgatcgattatttccaggaattgttccatgacgttctacgtggttctcttggtcgggtaatacaatcagggtaacatagtcagggtaacagaatccttgcttctattaccctccaatgcaaagttgactggcgtacatttgggccaagtatcaggcctaccatcttttcatcagtgttcgataaatgagacgtagtgacccaaattcagtatgtcttgatagcttagtaagacttataagcattttcacgcatcttggaagaaagttgcgagcattgccttaagattctgtcatgcgggtgtcgatagcgtcacgtgaacacattccaagtccttttttcttcacctttttcggtacctggtacctgagccaggaatagaagaaggatctgaaaaacgtatgcaaatatagcaagagggcgtaagcttagcctcgaggcaatggcgttttaattattttaagattttttttccataaatagtgctgttattaagttgaagtgtttgagaagggagtgagcgcaaaaaaataaagaactaaggaagaagagcttccctcagatgattacgcagaattctataccagaggtaaaagaagattttattggttatgctttacatgagagaagaattcggttaccgcagtttcaagacttagggccggcagacttggtcacactaacaaagtatttgcccacttcaagtaacacaaatgccataaacagtacgagtagaaatggtgcggccattattcagtcccctgcagccgttgtagccgatgactctgccgcttccatggcaaccaatggcgatgctagtgacaccgccgttaccacaaattatacaaatgcatctatatacagtagcagcagaaatgccaatgatggagccccgatggtcgctgagctccatccacttgataaactgaaggacgaagtagggacatttttttactcaatgggtgtcgatacatccggtccaacttcaatcgcaatttttttgaaggagatttcagaggtcatcagcgagaaaccccaagtttggtttggcaggaagaaaaccttcaatgttgctcgaatttcattttccacttggaatgcgttcaggagatgcgacataaatgtcgtcgttcatattccaggatcgattcagaactttatagtggattgcaacggtgaaagtcaaaatatagagatgtgtgcggattatgacttaatttgggctgaaacgttcgtaagtggcgtagtacggtcaatcatgttaatgaaggaaaacgctgaagagggagaattacaaaatttagtggaaaccttgattttgaacccgtttactgcaggacaaatcgacgatgtaccagaaatgttcattgatctgttccctatagtttaccataagggcccattattgggagctccgtattatattaccaatgtgacgaacactaataactatttggtagaaacactcgttgagatagttaagctgactcgtaatgttagcagggcggaaataatgttgaagaatctggctaccgacaaccctgaggcgatcataatactaatcaagatctttttggtgtgtgatcaagaattagacgcaataaagctcacatacgatatgctttcgcaggataaaataataaacaacactaataaccgcatggattataaatctgaattactgtgcttacaagcgcaatttttgatagacaaaaggcaggattacagcttggcgcaaaacatagcgcaagaggcagtcaattgttctcccagtgaatttagaccttggtatcttttatccaaggtgtatgtaaagctaaatgatattgaaaatgccttactgatactgaattcatgccctatgtctccattaaaggaaaaatacgtactgaaaagagtagctccgttgccttcgaataatagtcttcatttgccattgccaattgacgttgtactggatgaagtgacgtcgttgaatccacaagacgttcagaatgaacaccgctctgcggatccaatgctggtcaatttagctgcgtcgaacttgaaatctactttccaattggcataccgattattgacagaaattgtgcagatcaccggctgggaaaatctgttaaagtacagatcaaacattttcgttatggaagaagagtaccaaaaatcatcatcttcgttaccaaaggacgttaacaaacaagaagaacagcctctgagggctaaacggctgtgtgaacgatggttagacaacctcttcatgcttttatatgaagacctgaagatgtatacattatggcaaaccgaacaactgtacatggatgcacagaataacaaccacaataagttgactttcgaatgggagttatttggcctttgtgcacgtcgactgggccatttccctgaggccgccaaggccttccagaacggtttatcgcagagattttcatcaaggtgcgcgaggaaactgctggaatattgtataaacgaacgccaacgggtcaaaaattttataaactcacctaattcgcatgacatggtccctgaaatagtaagctcacgcataagagagctagacaatagcattatcgacctttgcgtgaagatatgctgctggaaccaccgttggtatacggaattttccataagtttacttgattgtttaagtgtggttattcaagatatgagtctgaccaaagtttcgaatgaaatctcgtcaagatatccagaaactgttctcaacttggtgcaggagaatttgctcaatttcttcactacttgcaccattggatgctacgatgcataaatacgataaaaagacattaatacgtatatataatccaaaaaaaattggcgatacgcttcaacgttgtgtcaaactcttgggtcactttaaagaaaacccagcatacattaatacagagcaatgctggttatgtaacttcgccgcccgccgccattcgaggaaaaatattcgtgtttcgagaatgcgggcaaaacgaaaatatcaataaaacacatacgggaaattcattgtgcacaacgacctctaacaatttctgccaaaaagaaagttcaagagcgtcccattcatcatgaaggaagagctcagcaaagtgagcagtatgcaaaatttcgagatgatccagcgtgaacgattgccaacattgtatgaagtgttaatacagaggacatcgcagccagttgatctctggactttttatacatttctttcacaattcccatatgccatcaactatctggacttttgggttgaccttatgacacatacacgactttgcaaaaactacatagagttggtaagaaaatcattaatcaactttccacaagaacaacagcagaatggaagtacatctacggctacatttgacttgctgaacgcactgatagaagaagggcacctagacccggaagcacctgataaactcttagaaaatagcggcccagacgtgcccttttcaccaaaattaaacgaattgctgggtgattggaagcaccaatcgggtatcggtcaagaagccctgagaaacgaagacgtagcgctgatcgtcgacgagataatgaaaaggcgctcccaacaagacggaaaaccgcagataactacaaaacaactgctgcacagcgcagttggtctctgcaacacctatttagtatcgcccgaacaaagcgaacggtacctgagcaacatccccatggaaacgcggaaccgcataatagaaagcgtacaaatcgagcgaaagtacgacattgagatttttgacgacctaaaaaacctaacttaccaattcctagaaatggattgtttcccaaaatttctaagccgcgtcgcactacacaacatccacgatgaaatatctgattggagattccactcagtgggcgtcaccaacgaaaaaagcaatcgctctcgaggccagacgcacatttctcgctcgccattctccaatcacacgtcaatcagtcgtattggctttggtttgctctggctaggcatcggcttttggatcggatatgttctaatcttcctggcgtatagtcgcgcaatccgtgtcgttacggtcgtgccatttacactgggatgctactgcattgtgtgtggcatgtatcaagtggacattgtgtattcctggtttggcgtcacacagagacttctccacagacacaaaaacgctggcaatgacgaaggagatgcttctagtgataccgatcacgtgccaatgatacttgcggtgttcggcggtaggcgccgtcttacccgcatagagcacccatttactcggcagcttctacgtaagcgtggactgtggtgtctgcttctcgtagtgggtgccactgccgcattcacagttattttcagctgtgttcccggccgtcgtgtatgatgtaatccatcacccccctataaaaacacctgtgcaccgcatatttccatagcgcgtgacgctaagtacaagaaacagcgaggggccgttaagtgcaggctttaccgagggcgccggctggcgcttcccgtggaagggtgtttgactcatcatcgcatcgcattacctcatgatgagtaaatagttgcgatttcacttatcacctctcgcggaaaaaaaaggcgatgacatgatatataaggctctctcgtaagacacttaactatccaacgttcattagattattcggtcaatttcttttttcatgcccctcctttttcttttcttttcttgactcgtcgtttctttttcttttttttttttttttttttcttcagaactataacacatagatacactcgaacatctaattgtttaaatactgcaaagaatacaaggtaatcgactcttctacataccctttttgcagatttgaaataaaaaaaacattatatgtttagcttatcgaactctcaatacacctgccaagactacatatctgaccacatctggaaaactagctcccactaatttcattgcttaataatcagaaattctatcacaaaccactcctaaaaatatttcaaatgtcctccgctgcaacaaaagctactttctgtatccaaaatggtccttcctttgaaggtatatcttttggtgcaaacaaatctgttgctggtgaaacagttttcactacttctctggttggttacccagagtccatgactgatccttcctaccgtggtcagatattagtcttcacgcaacccttgattggtaactacggtgtcccatccggcgaagcccgcgatgaatacaatttactgaagtattttgaatctccgcatatacatgtggtcggcatcgttgtcgctgaatatgcttatcaatattcgcattggaccgctgttgaatctctggcacaatggtgtcagagagaaggtgttgctgctattactggcgtagacacccgtgaactagtgcaatacttgagggaacaaggttcttctttgggccgtattacgttggctgatcatgaccctgtcccctacgtgaatcccatgaaaactaacttggttgctcaagtcaccacaaaaaagcctttccacgtctctgccttacctgggaaggctaaggcaaatgtggctcttattgactgtggtgttaaagaaaacattatcagatgcctagtcaaaagaggtgccaatgtaactgttttcccctatgattacagaattcaagatgttgcttctgaattcgacggtattttcttatccaatggaccaggcaacccagaactatgccaagctacaatttccaacgtcagggaattactaaataaccctgtttatgactgtatccctatttttgggatttgtctaggccatcaactcttggctctggcctccggtgcctctactcacaaattgaaatatggtaatagggctcacaacatccctgccatggatttgactaccggccagtgccacattacatctcaaaatcatggctatgcagttgatcctgagaccctaccaaaggaccaatggaaaccttattttgttaatttaaacgacaaatcaaacgaaggcatgatacaccttcaaagacccatattttctacccaatttcacccagaggcaaaaggtggtcccttagacacagctattctttttgacaaattcttcgataatatagaaaaataccaattacaatctcaggcaaaaagttcaatctcactaaaagtaacatacagtaccgataaatcgagattgcagagtataaatgttactaagttggccaaggaaagagtgttgttctaaaaacaaaatttatacattacgtaacacatacgtacatctaaatacgattcaattcagttcatggtattttgcgctactcgtcgttgcttagtatctactcgcagttgtcataattaacgggcgcttcttgtaattaaatgaacaaaaaaacgtaacgtacgtacaatggctctaatttcatcctgccatcctaaaaaaaaaatcaaataaagcagactcaaaaattttcagcttcagttaaattttgataagtatatttgcataactcaaggagtttgtgcaaacggttttctttctttgtggtttgttttatttactttccaataatacccgtcttgttggtttaagtcgtaacaaaaggaaaacttacaatcagatcatgacgacccagcaagaggagcaacgaagtgataccaagaatagcaaaagcgagtcaccttcagaagttttagtcgatactctcgactcaaagtcaaatggcagtagtgatgatgataatatcggacaaagtgaagagctatcagataaagaaatatatacagtagaagatagaccaccagaatattgggctcaaagaaagaaaaaattcgtacttgatgtagatccaaaatacgccaagcaaaaggacaagtccgatacgtacaaaagattcaaatatttattaggcgtcacagaccttttccgtcattttattggaattaaggcaaaacatgataaaaatattcaaaaactcttaaaacagttagattctgatgcaaacaaactttccaaatcacacagcaccgtcagttcgtcatcacgtcaccatagaaaaacagaaaaggaggaagatgctgaattaatggctgatgaggaagaagagattgtagatacatatcaggaagacatattcgtctcagaatctccctccttcgtcaagtcaggaaaattaagagactatcaagttcaaggcttaaactggttaatatcgttgcacgaaaacaaactatctggtatcttggccgatgaaatggggctgggtaaaaccttacaaacaatttcattcctaggttatttgagatacgtcaaacaaatcgagggaccctttctaataatagtaccgaagtcaacactagataattggagacgagagtttcttaaatggactccaaacgtcaatgtccttgtgttacatggtgataaagacacaagagctgatatagtacggaatataatattagaagctagatttgatgtattgattacatcttatgaaatggtcattagagaaaagaatgctttgaaaagattagcttggcaatatattgttattgatgaggctcacaggatcaaaaatgaacaaagcgcgttatctcaaataattagattattttactctaagaatagattattgattacgggcacgcctctacaaaacaatctacacgaattatgggccctgctaaatttcttattacctgatatatttggagattctgaactttttgatgaatggttcgaacaaaacaattcggaacaagatcaagaaattgtaatccaacagctacactcagtactaaacccctttttactgagaagagtcaaagcggatgtcgaaaaatctttgctacctaaaatcgaaacgaatgtttacgtggggatgacagacatgcaaatacaatggtataaatcattattagagaaggatatagacgctgttaacggtgctgttggaaaaagagaaggcaaaacgaggttactgaatattgttatgcaattaaggaaatgctgtaatcatccatatctttttgaaggcgcagaacctggacctccatacactaccgatgaacatttgattttcaattccgggaaaatgattatattagataagttactgaaaagactgaaggaaaagggatctagagtattgattttcagtcaaatgtcgagactattggatatcttagaagattattgctattttagagattttgaatattgcagaatcgacggttctactagccatgaagaacgtatagaagctatcgatgagtataataaacctaattctgaaaagttcgtttttttgctaacaacacgtgccggtggtttaggtattaaccttgtcacagccgacactgttattctttttgattctgattggaaccctcaagctgatctacaagcaatggatagagcgcatagaattggtcaaaagaaacaagttcatgtttatagatttgtcacagaaaatgctattgaagagaaagtcattgagcgtgccgcacaaaagctgagactagaccagttggttatccaacagggcacgggcaagaaaactgcatctcttggtaactcaaaggatgatctgttggatatgattcaatttggcgctaaaaatatgtttgaaaagaaagcaagtaaagtcactgttgatgctgatatcgatgatattttgaaaaagggggaacagaagacacaagaactaaatgccaaataccaaagtttaggacttgacgacttacaaaagttcaatgggatcgagaaccaatctgcttacgaatggaatggtaaaagctttcaaaaaaaatccaacgacaaagtagttgaatggattaatccttcccgaagagaaagaagaagagagcaaaccacttattcagttgacgattattataaggaaattattggtggtggctctaaatcagcaagcaagcaaactccgcagccaaaagcaccccgcgctccaaaggttatacacggtcaagatttccagttcttccccaaggagttggatgccttacaagaaaaggaacagctttacttcaagaaaaaggtcaactataaggttacttcttatgatattacgggagatatacgtaatgaaggaagcgatgctgaagaagaagaaggagaatacaaaaatgccgctaatacagaaggtcataaaggccatgaggaacttaaaagaaggattgaggaggagcaagagaagattaattcagcaccggattttacccaagaagatgaattacgaaagcaagaattgatatcaaaagcctttactaactggaataagagggactttatggcgtttatcaacgcctgcgccaaatacggtagagatgatatggaaaacattaagaaatctattgattccaaaacaccagaagaggttgaagtgtatgcaaaaatattctgggaaagactaaaggaaatcaatgggtgggagaagtatttacataatgtagaacttggtgaaaaaaaaaatgaaaaactgaaattccaggaaactctattgaggcagaaaatcgaacagtgtaaacatccattacatgagctgataatacagtatccacctaataatgctagaagaacttacaataccttagaagataaatttttattattagctgttaacaagtacggacttcgtgctgacaagctctatgaaaaattaaagcaagaaatcatgatgagtgatttgttcacttttgattggtttataaagacaagaacggtgcatgagctatcaaaaagagtccatacgctattaactttaattgtaagagagtatgagcaacctgacgcaaataagaagaaaaggagtagaacttcagcgactagagaggatactcctttatcccaaaatgaaagcactagagcttcaacggttccaaatctcccgacgacgatggtgacaaatcaaaaagatacaaacgatcatgttgataaaagaaccaaaattgatcaagaagcatgaatcatgtattgtgcattaaaataagtgacgtgagagatataattttttatattactttttcattgaatacaattaaactaacgagccttatagaccgcattatataatgaaccgtagccacttcttgaccactatcttcaagtttgataatgataaatgacaggtaatcatatttcagtcacctttttcccttcaatgaaatgtgatatcgctgcaaaaatggtgaatgaagaggacaaattaagtctaactgggtcgagccgctttaactaattcatatccattctaagataattgaactgctgaaaactaaagcctgctttgatacttgtcatattgtatttatctacaaacttacattaacaacagtgtactgaattataagagagcaattgccaaaaaagtcatttagttaaaacttctccatttcaagtttccaaggataggtgaagtgctatcccagagactccaaaaacatgcgaatatattattaagtttcagttgattaatatttctaaaccatataaaaaagcacgtatttggcacgatctgtagttaattgcaacctagttacgcgatagcacgcgttttcttttttatgaataaaagcattagaagtttccatgttactactcacctgctctcaccgactcattttgttaagcttgtcttcaattgcttgtatactgcgtgaaaactcatcatcattttccttcatttgcctctgaacatcctttagtgatttttctatttcatttgccaggtcaaacacggttacaatattttctgtatctccctttattgagttagtctcagatgtattggccaagggagcctgtggttcctccgaagcttccagtttttcagtactcattacagtgctccttcagaagatgcaagtcacatttacaatatcatttagcgctaaggtaaaatgtacctgtaagccaagccgcttcattggtttgctagttttttttttttttttttttttttcaaattatttatcgaggccaactgaaaagcaaaacaacatggttgatcgatacatagaaattaacgaccaggaagcgaaatactgcagcaaatttctaaagcttcttcctatataaaacacggtaaagaacggtaaaacatgataaaacatgataaaaaactatttgggacgaagatggctcaataatcctgcaattcaagcatatgtgaaacaaaatgctgctgtcgcccattctacggtgtttcaaggaaatctttatgaatatacggtgatgagggagttatctgagaaactacgaatgacaaagttgagaaaaaccggtggcgcccatgatggtggcgtagacataaagggaagctggccagtagatgatatttattggaaaatttcatcgttaatgcccaatttggaaatggctagtaacataaaaagaacgaactcgcaaaatggcttcgtattgaaacctttaaagtataggataatcgaccatacttttgaaccattgaaagtactagtccaatgtaaggctttcactaaatcaaaattatctcctagagaattccgtgagttagtaggaacattcacctcactagtatcacatagtcaacgcaacaaaacagtatgcattatgtgttcccctcatatgttaacaaaagataccttaaatcttatcaataacatcacgcttcctctgatatatttacgtgttgagatgctgaaagagaagactgacgggcactttgacttaatcaattcaggaaaactaattaattattacgagaattcatacgcctctacgttaatgcaagattgcaagatttctgaatggctgaagttgaagttgtacaaaaatagtgactttaattcggaaaaataaaaaaaaaaaaaaaaacataaggaaattttaattaaatagtctatctacacatttcctaaaagaaaatattattgcattacttttttgaagatctataaagggcactgtcttactttttaaaatctgacccacttgaagccaacacagtatgctctcgaaattatgtagcaaacagcgcttacaaaagttgccaaaccggaaaaaataatatagtgttggtaatcggccgttgtcttgatagagataatggcacctgttatcggaatgccgactaaagtaccgaaaccgacaacgaagtacattgtagagtaacgtttaccgaactcttccgttttagatatctggccacagcaaacaggaagtaaggagaaaacgcttccagaacaaaatccatatagggcactaataacgtacatatttgtcaaattggtaccaaatggtaaccaaccaacaaacatgacgataaatagagtgagtagagttgcaattgcgacgttaaacctaccgaacttatcgctcaaatagccaggaacccatctcccgggtatgccgcagacatttataatcataatcaaggtgtaggcgtcattagcagaaattccatggctggtggcgtatgatccataataagtaagagctgaattaatggataactcactaaataccgttcccaggacacaaaaaagatatttcatatccaggaaagccttcgcatcaaaacattgcagaatataaactctgagtatgtatctccaacgtgactcaccatctttggaattttcgataacatgtggtaacctctctttgactaaaatgattgacagagttagcaaagccaaatctaaaaatcctaaagttctaatgccccaaacaaatccataagttggatcagtgtctgacttcatagagaagaaactacgcaacataattgggaaaacgacgccacccacactaccaccaatagtggccattgccaatgcagtaccacgtctcttaaaaaaatagtgggcgggaacacttactaggggactcagtacaataccattaccgaacccgcagacaatggcaaaggacagtatgaagtgccaatatttagtagagttggcggtagcgaacagaccggctacatgaaaaaccgtgcccacaatcataattgtcctaaatccatttctatcaaagtaagtaccactaatgatacatgaggcagagcaaacaaaaagaaacaaagaaaacagccaaccaatggtagaaacactttcactggataattgattgtcctgtagatgactttctatgacccccgttgagtttaataaaccaaagcatgcaattagacccaagaagcaaccaaatgtcacaacccaagccttgaatccaccctccgggaagctttcaatttcttcattggaatcttcttctttgtcactgtcgtgcgtgctcgaggtattttcaccccaatgtggttggctttcaatgtcagttcctttatttacttccttcttggtatacacctttgccgacaccgacgttgacgcgtaagaggcagtagtctctaatgactctaaatcatcagcttctggatcataatgtatgctatcctcatctaaatcaggttgccgcagttggttggtttgttcttctggaactatagtgtctttaggcgttaaactgtctgagctcattatttttctttttaatctatagtaaaatcagagctttttaatcgatagtatgcccccgtgatcttagttattcagatcttagtatgtttttacagatataacctatccttcactaactttgaagagagaattgctatttgagaatttccaaacgtacatcaagcagtttatatatctagtccccgtaactactgggagatctaaccaaatagcttctttattatattcatttctctgagcaaaatagatatttttgaaaaattttcctctagtttcttttcagagatgtctctctattattagcctcatacaataccgcctagggcgattcagcagaacagtaattattccgctgtatttctttttcaggtgcctcaaacgtctatagaacagcgcgcagcaggttgagaaaaatgtcaaaaattcgatcctttcctatcttttctttttcggacgccaaagcgcagtattcaaccgacgatgttcgggaagccacccccgagatcataataacaggtgcgttgtgactctattgttaacacgagggaaaagatggaataattttggagaaacacaatgtcgttctagcgggaaaaaagggcaaaaccaaaaaacacggagtctgtccaatattaatttggttaaagcagttcgtataaccaaactttattggcattgtccgtcgactagtctatttttatttctctcaacctttcgagtacttggaaaaaggagtagatccgtttcagcaatcgaagcaataggcattaggggtagagcaatcctcaaaatccttgtgcctcgactgtgggttctagtatgatcgctattttttcttattctttcctagttaaagcaatagttgttcgttctataagtttttccgcgagatcgtggaaataccttaaaaaagacgcgtgtatggctcctgcatgcgaatcttctcttttgctttgtaatcgcatgtgagataatcaagggattgtagccattgttttcgaaaaataataaaatgaccgcactttatcctccacggagcggaaggccattcccgtacgcatattaatgtaaatgagataaataaccaaataagtaccgccacatcggatttttaaccttgatatggtgcgggggtggggtaacagtttaggatcttgaagtaatgctagcaacagaggtagtagcagtaaataagataaaaaagaccttcgagggttttttttttgattatatatttgatatagtactaagtgtcctaccttgaatgatggtttgtactcaatagtattacttcatattatgcctgacgtccatcttttttggaaagcccccatttgtcataaccgtacaatccggcaattgtcaagataacaccaaacacctgaaaaaaatttaactttgtttcccaaaagagtgccacggatataacaacaatcctcttcatgatgtttgctaccgaataattaatggaagatagtaaaccgatcaactggaaagcaagcattgcttggaaaaaatgggctattccatgaatcgctacaagggctactgtttctagcgttaaatcgttgataacgctaccgccatgcattaattcgccggttaaaaaaggtaatagggttaaagaaaacccaatgcaggagcagtagaacaatatggtaatcttatccacttgcaatggagaaaatcttgttttgtctagactcggttgcccttccttcgacgtgacgtcatccgtagaagaagacggcagtattcctaccttccttctgatggttaaaatattctttgcaaaaatattctgtgctacaaatattatcatggaaataaaggcaaaaagcaacccgattaatgaagatccgcttttgttatctgaagccctcttactgccatgtgttgaccagcaagtagtcataacgccaaaaattaaaagtaacaaggtataataagtcatggaattgtaataacgatgttcgaaaaatttatagtagccaactgttattattggggataatgccttcacggaatgcactagtgatactggtatcatagataccgccttgtgcgatgtgatatgaccaataaattggaatattcccatagggaaagtggtcatcaaaaccagctttgagggaactaaaaacttgtgcaggatagaactcctgaaattgccatcgagatattcaggaaggataccgtcagggaaactattgagtgcctttgaaaacttcgtatgcttcaaacgaggtagtcggaataaatttacgatggaagcaaatccaacacatagaacagcactaacaagaaattgcaattctgtgagagctatgggatggttgaaagttcttaaaatggctttagataggttacttgaaatagatgacgtgacgtaccatatagaacaaataatggttattcttaggtcaacttcaggtaagtacccttgtatattactaggaaatagttgcgtgaatctttttttaaggctagtaatatcatatccaaagacttgattactgaatgtctccttactgtattcttttttttggtgttggaaccccccacgtggtggttctggtatttgatacagtgatggatcaaagaggtttttatgaacagaattacgtcgtttgatcgctgtactttgcgtttgaatcatgttaggccggtattgtttctcctttataaaaacgaatggctccttattaaacacttttatcgtcaatccacttactctctaaatatcgtaagctttgcatatataagcatataataaaaatagttggtatatgctgcacgtgtagtctaatgttcttttcttttttttctttattcttttttctcctctttatgaatacagatattcaattttttgaatatctgattgtttttattttcatttcaattttttttttttttcaattttttttatccgatcgttgcgccaagcttctatcgcttaaaacaatgacacttcgctgtgaaatgacacaatggcttgagattcaggcacaacgcaaaaggtctttacaaatgtatatcacagaatattaatgtttgaaaagtacttccgaattcaaggccaccacgtagccttatacaccaaatacaattatacacaggtttcaaacttgagaaaaacaagatattgaatattaaaagctggggctagtagaatttgctgattaggttaattgtcatcaaattcaaacaaactaccattttcaggggtatttttccttgcttcaattctggatttcatttttgctctctttttcttgttgctttttgtaccatgaaatttctgtgacagttttttatatgcctccttagtagtcagtcgatttcccttttcgtctctgtaaaccagttttatgtcaggatcataatgatcttgtctttttgaatgagtatttgcattggaagagtcactagatgtgaattgttccagtccgtgtagcttatcttttgtataagtgccagtgcccgtatgctctttatttcggacatcccttcgaagtgattcactattattaacatcctttcctggtttcaaatcgacgtctcctgtggtgaaaacactctttttccgaagatatcctagtgttgatgcaagaccagaaaaaaagttcggtgcattttcagcatctccctcgtagtttggttcattattaactgcttcagtcagtgtattgtttccactcccttccttagtatgtccattggtaacatctccgatatttttctctccttcaccatgcactttcactttattctcagtagcacttcgttcggagagactggtatccaaagtatttaaaaaagttaccttttcgtcgacgacaatactgttggaaatttcacgcattttcaaaatgctttcagtgcgtcgcttctcttcgtctcttgccttttcaatttctctagcgaggtcctctggccctttcaattcattgtttgagcttgttctgggatttattatggtgactggctgttcttcttccatccaggataaactttcatcttcatctactaacttaacaatttccatcttatcagtaatttttgacttcctagctttagtagatcttgggtccttgatcttacgttttttaatttttaaaggtttaaagtctccaccatcttcatctgacatattatttgcgctatcgaaattcactttaacttttcccgttggtggttttgctgatatagtattcggtgccttcataacaccctgttctgctccgatgattagatgtgtagttgtaattgagtgtttctctccttcttcttcttcttcaatatctaagctagatacatttaaaattttttttttttgtcttctatctttattcatttgtcgtaatcgtagtttctctctatcagcgttttcctcggcagctttcacattctctaacacttcggtagaatcagtatcatcaaaaatactgctctctttcaaagttagaatcgtatctttctttgggctaagcgcctcgatattatatgatacttgaacattatgcagatcaatattttcgtcttccttcgtggcgccttttcttggcaatgtgctggaacgtttggattcatgtgaggaaggaattgcatccatgttttctagccatgaactgtcgtcatttacattagtttcttcgagaaggtgcgccattcgtaaaggagcgttcgcctttttttgaaactttgttatcttctctcgaagttcatcgattttggatgtgttatgtacattagggggagaagaattgaaattttgttggggtgggataagttttaggccaagggacgccctcaactcattcgtctcttcgattgacaaagactctttatggtctgtattcttttcttgaaaaactggaataggtttcatacccagcttttcccttatttcatttgtctcctcaatagaaaggttttccgttttgttcataaattaattaagggttgatgtgatgattgcctttttattaatatcaaatagtaacgattgcaccatctcatcctttgctcactttcaaaaattttgtatatctttttcgtcccgcgaataattttaagttgcgcagttcacgatatgaatacctataactgctaatggtacaaattttttaaaggttaaacaaaacttttaatgatataaagtacctaaaactatgtaaacataaattatgtatactatttcaaatatatcacctaaaaaaaataataagttcaattcaatatgggcgtacagcactaatttacagattatggaataaaatatgaaatgagaaataggttaagcattggataattatagaaaattttctaaatccaaataaaagggaacgcgaggggtcactaattattaaaatgtaaaatgcatccttatttcttctctttcttctctttcttggacttcttttccttcttctctttcttctctttcttctccttcttttccttcttttccttcttttccttcttgtccttcttttccttcttagcttttttagaatccttggaatcttcatcatcgtctctctttctcttcttttctttcttttctttcttttcttcctcttcatcatcagaatcggattcagaatcagaagcagcctttgcggtatcagcatctgcattgtaggccctagcttcagtcatttccaccttcttagcctcacgaacaacctttggagtagttcttaaatctctaccttctaattgggataatctattttctactttggctcttgattctagaccaatgtcacctgaatcgtctctatcttcagctaaagcatcataacgcaatgagacagcggccttagcagccagaactcttgcaatcttacctttgttcttaccagtagcttgaccaacaagagaggcatgatatagcaaaccatactttggtgtatcatgcttggtctttaaagctctgaataaagccttttcggcacctaatatttggatggtagaagctggtgatttggccaaggaaattaaggaacctgaatgagcgataagtctagcaccaactaattcaccaaccaactgagtcaagtttggagcaatagccttcattcttgcagacaagtaattggacaactgttctctgtaagcggcaaattcgactatttgttcagctaaagcattaatgttgtctagatcggtttgagtgatttcagtacccatagacacttcagcagcggttttgacacgttcttcaatctcttctggtaagatttcactcaaatctgtttcagaagccttggatctgatacccattgttagaataattctcgcataagcgacggaatcagtaacaatcttagctaactcaggaaagtgccacccgtaccattctttacatctcatggcatatgtgtttaattctttatctaaatcatccaataaagcaattgcttgaataatcataacatcaactttgtcagcagaaaattttaatttgtgacgaccgatggaatgagctaaacccaaagacatcttgcttagatcattatcagacatacctggcagcaattctggcaaatattctttgatagctctatagatatctaaggttacagcatcggaaacaacattgaagttcaatcccaacttattaatagcgtttgccagtttagtttcactaacaatcaaggtcgacttcttgtcctttttaatttcttccagaagtttttctaattgggaagaaactttaccttcaataatggagttggcttcctctaaagcgttagctgcagagttgaacttggaaaaggcggcgatcttgaattccttcaagactttgtcagagctatccaagtcttgaattaagcttgaagatttgtagattttcttatcggaagcttttaaaagagcataaccagctgaagtttcagttaaaacgtaagccattgtatgaggaggttgaggttctacagctaatttggtatcgactgctatttcaaaaataacttatatgcgaaatttttgcgaaagcataaataattcttgcttttctgaaaattttcgatgaggttgaaaaattttccaaatttctttttttctgttctaacgtacacaatgatatcaatatcaataaggccactgggcggtaatcgcagataaaccatatatccttgagatgccaagataaatgaacgctggttcaggatcttggtaatcgtatttcgcaggattgttcttttttattgttctctgatatgattgctttgtgacaaagttggggcatgaaaaagcctttttttactgatgaaaatatggtgtaggtttacgattaaataataatgttgcgccccatttggatgcgcttgttggcacatatattagtaacataaatgttttcataaaactgcttgtgtcgaatgtttctaatggcgtgaaaaatacggaaatactgctgaataatttacacaggttctaactctatactcggatatgtaggatatttagaaaaataatttgtggatgccaaagatcgaagaggtgctggatcgttaaccacagataaactgaatcgcgcactccagttactgtaaaaaagacttaccgaagaatataaaacactcctgtttttggtatatatgcttttatttcttgaatgttttgattactgcgttcataaaaagtgatgacaggacaggaatagtgaaattatcatcccagttgaacaaatctataccttcactcaaagcagctaccacaccacctaacaaggatagcatattcaaacttaatctgcttgtttctgggctccattggatctcgccaggtttgttgacgtagctgtaggcaggaacaaaatagccataaaatacccagcaggtgataacaccaactgtaaacgcagctatcgaacctgcaagggatttatttcttgccactttgggtgttaaatgaccatactttcttccaatagttgcggcggctgtatcggaccaacttagcaaaaataacgatattaaggtaacatctttagagaaaaagttaaaagaaaagattaacccaagaatgtaccacaataccccattgtatgtatgaatctccttttttctcattagcgcacccacagttctacagtaaagcatattgaaaaagggccagtttagtcttatcagatccaaaataaacaatatgatgaaggcgtatatcaaaggccataaaacatttttataattaataccctgcgtatacaggtacaaagtaataaagccaatggaagaatggaacaccttacggggaatttcatgtttagttataaaatcgccgaaccattcatgagatttcaaatgtatttctgtcactggaacgtgtgcatcgtcatcgctactactaatttcttcttttgctggaatcgttactttcgccgagacttgatgactcttagatgatagtctttgcttagcttcggtacgcggctctagcgtgctatttggaagggcaatggcatcttcggtccccatattgtctgtaaaccctgtatgaatccaaatgacagaaatgcgtagatatctgtttacgtaatgttcaactgctctacgacaacaccgctcaggatttttataattacgctacgttttatatttatcgcagaaaaaccaataatttgttacccgctatggaccctggattttgtaaagatacatggcatgacattgtgctttcacgctggtagtgcataatgtaagagaagaaacaggatatattttaaaatttccttgaatctacaaaatgaattatacaaaattttattatactaaaaaacgtagaaatatcttgttggcttagtagaaggttgatggtctcttgtaagagaaagtcttggtagatttttggactctgtgaggtaatgggaattttaaatccttggtcaagaattgcttgacgtattgtctcttgacatcagcagtcttttcaatttcagcaaccttcaagatgtgaatagatctaaatctagctctgtgtctagcagccatgtcttggtataaggtttcgacggcagcaactctggatacgtctctgatttccttgtacatgttgtgagtaccagatctggaatcgtatctaacccaaacaccgaagttcttgaccttggttgggtgagcttcgttgatttggttgatggaaacaatttcaccagaagccttcttaaccttgtgcaatttttgcaagaaataccagtaacgagacttggcgatgacttcatttgaagcaaaaattctcattctgaacaactttggttctggaacggattcagttggtaaacgacgaccaatgacttggtattctttgaaatgagccactgttaaagataaaaatcaaaaaagaatttattcttgttagtaaacttgcatatttcaaaaatattgctttattgcagacaattacatgtaaatgaatgtttcaaaatagatctctgattcagttaatttcctctataattcctggatggtagttctatagtcctcatgtgaagacttctcaaatgatattaaccatatcatcagtattaaatggtacaccgccttccttctagaagcaatttatggtaataatcgtattcagtattcggcgtatttcaggaaaaacattcacaggttgcattgacttattgggtattcttcagtattttaaatttccacgatatgttcattcaatttgagctcaccatataaaatagctacattgacattcattccacaagcatacaatacattctattacatactttttctttgcttgattcctttgttacggttctcttctattatcttctgcaaaaataatgccctcaaaaacggttatatctatctattagagttacttcttcgtactgttgccaactcgagcggaaagaaattagacagaatctggcggaaaattgagaaagagctagacagactatgcggaacaacttggaatctgcctctgtccgtgtggcctggccctggcctgggaagtaactgtctaggccgcggacatttttctcttcggtagtaagccgccctactggtcatggggttacctgaaagagataaaaattcaaagatagcatcgcgccgtcggaaacgtaaaatgtacgggtgaacagtcccgaaaaccgtatttattgttttggggaagagcttgtttacttcgtgcctacaaacaatcagcaccttaagatatgacagaatagcttgctatttgattttttttttatctagcttgtaaatatttattaagcctttccttacaaaaaaatatattttcttttacctcttttttatgttgagcgtgtatacattggtaaatttaagttcagtgctttcaatagataacacctattgaatttgcgccagtaggtacaaattgaaattctcgcctatattaaaattattttctatgcgaacttattgtactagatgtggtaaatctcctccctcagatttgttgccaaaaaatctaaacaaacttctatcggtgacagaggcccaaatttcgcgttctaaatcagttatggtatcccaagtacctctcaatacatttttcatttttaaatcggcctgtttgtctaagtttttattataaacagagtttgtatgatatccataggcaatgggaagctttgcaataccaacaacttgatgactaactgcagaaactgctcttgtcataaaattgtattctaaagctagccccctattaaactcacaagaaaaggaatcatttggaactttcttacctttgggcaaatactttaccgttaccttttcgaatgtattattgactggtaacaaaacagggtcaagttgcccccttatcaaaggcttgccctttgtgtctatgaatttttcattatagtacttcctaaatttcatcaaccttccatggacaggttggtaaacatagttgtctccatttcttgctgtcgtatccctgagctgctttccatactttttcgacaaagtatacggaagtgcaatttcctcacctaatcttttataagtttttgttttcaaagaagggacaacgcgctctactgtacttaaagtcgaattggccatcttgtcaaaaaaattgaccactggtgctacggcttgaacgggacgtgacactaccactttatcgattctaggctttgtttgtgctaaaataattctcgttagagcaatcttctttgcaatctcttctgtttcttgcactattggataagtttctatgtgatcaactgttttcaaatttaatctacccctcctagctgcatgttcatttgcactgagattactgttttcggtaaaattttctgtaactgcttcttgtgtctgcgattgttccatttcattgggttcattcgtgtttttgtgtaaaaaattcttattttcttcttgtggttttgtaaccttcactatattcaaatttgatggcatgtttgttgaaatatgttatgtgaaaccaatgtagcaaaaacaattttttatgttcttgttgcttgcctctcaaaaataacaaaggaagaaattttgtcgaaagtgtagtagaaggaggtaaaaagtgaacacttcttagcaatttatagttccaaaatttatgaattaatgacaatgatacgtttttgtggcgcgcgtcaatcggcgataatcagcaacgcgtctgacgctgctgcaggaaccaacaaaaaaaggatactaaaccctcttgagtccttgtgtcttaacgaccgcatagacgaacaccgttgcaaagaagtccagttatcttcattacgaagtctattgtatgctatgattttaaatagaaccataggcagcgagaccggcgttttttcttttctgctcttttcttttcgttacttcggagaggaaagagacttattttactgcttcttctccgtctttttacttaacattacatatttattggattagaacttttgtataggggtaaacaatactgaggatattcataactatcttttttaggtctccttggctcttttaagtagaacaaaaaaatctaggacagttgctttgccttttcaatgtcagttaaaaaaataatggaaacgttagttcccacccagaaagacaacaaaaaagtgttttcttttcgaagtattccaagatttcgttgtcatggcatatcggtacaatcttttggttggaatgaataaaatcagttatcgtcccaccaatgggaatagagcatataatgttatctcaggacagcagtgatgtccaagaaagtaactacgagagttttactatactacatattataaggacaaatagttgcatagcaacaagcttgggggataaacatcaagagaatgcattgagttactacgcaggccttaaagtaaggcgattccacggcagtaattagtttagataacaacttactctactgcgagctcttcttaaaagacgtgtccttttaagattcagaagcattttcttgggtaggggttttttgcgttactctgttttttgagatcgtaattcgacacataaaactctcagctagcccaccctttgggcaagttatacctttctactttcgtccaatccatacatcgcccaattaggataaaagtaaataacatattcgagttttgtaaatatccgaaaggggaagacaaggaaatatctaggcaccaaatccctttttggaaatgcgaaccacgggaatatgcaaaaaaaaaaagaaaacaatcccgctttttcaagatttcaggccgattttgagattaaagtttgacagcctcagtcttaaaaacaaaacagtatgacagaacgattcaaagaaactacggacaaaggatttatgctaaactggtcacgccgttatagacagcagtaatgcatggaaaatcccatggctattctaatcgggtttaaacttttttttttcagctgcgaatatctcttagtgcaaattggtaaacaagagagctcacaacacactaaatacgttgtgtaacgatacatagccttgcttaggtaaacgacagatgcatgcccatttcgataggaaaatcttgaattttaagcccgttaccgtaaatgtcattcgatactgtttacagtttagttttaaagcggtaacattcttgttaatttaaaatggatcaattttgtcactctacgaggaaaatcaagcgaagtattatttaaacgcaacatttctttgtgccttccacacttcagctatatttggaacttaggcgcgtttaggtgataagttgttctgtaaatatgtttgattagttaaacaagagaaatataaaattaagaaaaaaaaaatttcaaaaacatggatgaaatgcattcttcagacacacttttgttgcgaacaccgaaatcaaaaaaaaaaattgggcttgtaatacccagtacaccaagtaaaaaatgtaaatattcatcaggctttatagcagaagacactacgccctccaaacggtttcgtttataccaagccaaatttaagacaagttcaaagaatgtcaaagcccaaactcttagcgtatcaataaaaaaaaatcaaggtgaaatcaccaatccatttatgaccgaaggatataatgattaccggaatattgtcagtcctggattgagttttgataacgactgcttttcagaacatgaattagttagtccattgagtgatatatcttcgataaactcgacatcgcctgatgttgaaaagattgattctttagatccttttggcgttgattcttttgtctggaactgtaagccgcttgttaataaagaagcactggagctccaccgaatgattcattcttcgtttccgatgagcccactggaatccaacagtgatgtgccacttttattgcctaaactcaaaaaaaggttatctccagtaaacagatcgaccttcaagccaacaaggtacgaaccctctcaccgtctattgaagcccaaaaaatcaattctaacagtaccagccaaatctctgaatctcatagtcagttcgtcgcgaggctcattaaatgacgctaccatctttgccaccgaaataaattctactttgagcaatgaagaaaacaaattaccagcaatttctagtatttgggagaagctcacaattccagtaaactcttcaattaaggagaaatacaagaagcttaaagaccaaatatatgggcaagctagtaattttggcgaagatgaagataatgaagaagacaatgaagacgaccttcccgacgcggcagtaataagaggttacgaatttcagtcaggaaggcgcgatgagctgacgcaatgtaatgaactacagagtacgaaggactacaaaaaagttcagtgggcaaaggttttagaacaataactaggttctttttcttctaatttgttgaattctaaacaaaggagtttttttttattatttcttaacaactggtctttttaattaaatgaaaaaagataacagcattattgtgctaagtattgtactcttttttagaagctggagtaatctaaaaaaagctaaacaccattattactattttccttcctcaagttgttgttttgcaagactattgctattatattattattatgatcatcattattatcacctgttttcgcttttcctctttttttatattatctcctatacttcttactgtaacaaaatttatgataaacattgtataaaaacattatagacgactatatatatgtgtgtgtgtgtatgtatatgtaccgtataacgatttttaaaagtatttaattcttcacgctttttcgttataaagtccttttaatgatcctctaagcaatcagctgtgttgcagttggcagcgtcgtcgataagacaagtggaacctgaaatgccagtaccatatgtctttggccttaatgaaagcgggtcattttgtagatgatcaccttgggagtctccggctctttcggttgaagtaacctctctggtaataaattcaggttgcaaagtagcggagtgaatgccatagcggtgaagttttgatctaactattttggccaggtcagtaaattgttccgggctgatatctagttgaatatgcaaagatgcaataaaaatagactctgttaaattccaaatatggaaatcatgaatagctattattcctggtattttcaaaagatcaccttctacttgatcgccggataaagtggaaggtgtcgcttgtaacaatattttggaagccttgcacgatagaggaagcgcagaggaaaaaattataccggtaattatcaatgagacaagcggatctgtataatacttccaagaatagtcggtcttccaaatgaaaaatgcagacaacataacgccgatgttgccaagagcatcgcccaaaacgtgaagaaacacaccatgcatatttaaagatctcttgcgcttgttgtgttctgtgtaatttccgccgctggcaatcgtatggcttgacgttgagtatgatggcgtcttggatgcattttccggtgtcaataatctagtattttcgttcataaaactatctactatagcattaggcataatctcactaatgttatccgtactatccattggtgtagtattctctattccatcaacatgggcatgtgtatgtgtgtgggatgatggcatatgcatctcatggtcggcaaagataccgccatgggaatgtccgtgtccatgtccatgctcttgatcattgtcgtgaaataagaaaagtccaacggtgttcgatatcaaccctgcgacacccacatacaacacaaacttaggattttcaatcacggggggagcaataattctttgtagcgcttctatcaaaattgagacacataaggcaatcaaaaagacggcgttaatcagagcacccaaaatctccgcccttttccaaccataagtgtacgttgaatccggatttctgtttttggcaacatttacggcccaaagtgcaaccacaagagaaattatatcgtttagcatatggaatgagtccgcgattagagccaaagagtgagacaagtacccggtagttatctcgatcccgaagaacactgtgtctagcagcaacaaggatataatttttacctgtttgcttccgagtttcatatttactcaatctttccgtactttgtgttaactttctttctatagctatgcagaactattctgagcaaagtgaaaataattggttactaaatagaaccagaaatgcttttcgagctcccacgtagaatatataagaccaataaattcctttattgtacggatattctgcattacaaatgagtcttctgctttatgcggatcgtcagcttatattgccttcgtacagaaaatgaaaattcactactggaaacgggtgagcggatgtatgagtgtatagtatacacccggttttttttaccctttctaagaccggagctggcgacagtaagtgataagcggccgttggcggccgtgggtgagttatgcatgggaaccagcatgagccagcgatgttcactataaagagattaaatgtagaaagtgctgagagaccgatcgattggtaaacttttcaaaaggtggccttctccacactttctttttccctcgttcactctgccttgatcacatgcttttttctatggttaactttgaaaaattcgttccatatcgcccgccacaagttaaaaccagatatgcgtgggatatagtagggtggactgttaagttagctataatgggcttgtactctttttgaatacaaaaaccacctttctacaccttaatacaagcggtggttggaaagcattcttgatatatataattatatgagttttgaaaaaaagtactgggcatcatttaaataagcgggctaaactttgtttatgtttaggttaacgatagacatatttatttttttttctaggaataaaaatgaagaacgggaagaaaaggaaaaatgaaaatgaagaatatgaagagtaaacctacttaaaaaaaaaaaccatactttagtatttaatgtagctaccacgcgtattcgatacactattatttttcttgacttagtatgtcaattgtaggtagcctcatgatgccctcttgatctaagcgcggtgaaagtccgcaggcaattgctataatactgacaaaatttataaggggagagggtcttttttcggtccgcacggagcgggcgaagaaaacgtagcggtgagaaaagaatacgtcaccaaagtatcagaaacgtcactgcgttgtagatgtaagaccgatccactttgccagctgcttacgctgcggaaagtaaacagacctagctagcggaccgatagagccggctgaactttataacaaatgcgccttctaacaagcgatgaagccatgcttagcgcggcaaagagaattacttagaatatggatgatgcagccctgtcatattcttccataagggaatgacaaggacaatagtaaagtcgatcacgccctgtcaggaacatgatctccgccatgtgaatatttatgcatgatacaggcacgaatacatcatataatacgaatgacacaggggcacccacccatcgcatatcaggagaacttccctgtgcatacgggacagcagagataggctgttctcgcgcgttttttttttttttttgctttttttggttcctttcgcggatatcgtattatcgatattacaacaaaaatgtttggagatctccttcgctgtctttaagtaaaaggctttaaccgcttatttttctctctttttttccttttacccctcacttgtcgtgagacaattgtagtatatttagtaagtatagaaagttcttgttgttaaaaaactcgttaggatacaataaaaactagaacaaacacaaaagacaaaaaaagacaacaatatggttgctcaatataccgttccagttgggaaagccgccaatgagcatgaaactgctccaagaagaaattatcaatgccgcgagaagccgctcgtcagaccgcctaacacaaagtgttccactgtttatgagtttgttctagagtgctttcagaagaacaaaaattcaaatgctatgggttggagggatgttaaggaaattcatgaagaatccaaatcggttatgaaaaaagttgatggcaaggagacttcagtggaaaagaaatggatgtattatgaactatcgcattatcattataattcatttgaccaattgaccgatatcatgcatgaaattggtcgtgggttggtgaaaataggattaaagcctaatgatgatgacaaattacatctttacgcagccacttctcacaagtggatgaagatgttcttaggagcgcagtctcaaggtattcctgtcgtcactgcctacgatactttgggagagaaagggctaattcattctttggtgcaaacggggtctaaggccatttttaccgataactctttattaccatccttgatcaaaccagtgcaagccgctcaagacgtaaaatacataattcatttcgattccatcagttctgaggacaggaggcaaagtggtaagatctatcaatctgctcatgatgccatcaacagaattaaagaagttagacctgatatcaagacctttagctttgacgacatcttgaagctaggtaaagaatcctgtaacgaaatcgatgttcatccacctggcaaggatgatctttgttgcatcatgtatacgtctggttctacaggtgagccaaagggtgttgtcttgaaacattcaaatgttgtcgcaggtgttggtggtgcaagtttgaatgttttgaagtttgtgggcaataccgaccgtgttatctgttttttgccactagctcatatttttgaattggttttcgaactattgtccttttattggggggcctgcattggttatgccaccgtaaaaactttaactagcagctctgtgagaaattgtcaaggtgatttgcaagaattcaagcccacaatcatggttggtgtcgccgctgtttgggaaacagtgagaaaagggatcttaaaccaaattgataatttgcccttcctcaccaagaaaatcttctggaccgcgtataataccaagttgaacatgcaacgtctccacatccctggtggcggcgccttaggaaacttggttttcaaaaaaatcagaactgccacaggtggccaattaagatatttgttaaacggtggttctccaatcagtcgggatgctcaggaattcatcacaaatttaatctgccctatgcttattggttacggtttaaccgagacatgcgctagtaccaccatcttggatcctgctaattttgaactcggcgtcgctggtgacctaacaggttgtgttaccgtcaaactagttgatgttgaagaattaggttattttgctaaaaacaaccaaggtgaagtttggatcacaggtgccaatgtcacgcctgaatattataagaatgaggaagaaacttctcaagctttaacaagcgatggttggttcaagaccggtgacatcggtgaatgggaagcaaatggccatttgaaaataattgacaggaagaaaaacttggtcaaaacaatgaacggtgaatatatcgcactcgagaaattagagtccgtttacagatctaacgaatatgttgctaacatttgtgtttatgccgaccaatctaagactaagccagttggtattattgtaccaaatcatgctccattaacgaagcttgctaaaaagttgggaattatggaacaaaaagacagttcaattaatatcgaaaattatttggaggatgcaaaattgattaaagctgtttattctgatcttttgaagacaggtaaagaccaaggtttggttggcattgaattactagcaggcatagtgttctttgacggcgaatggactccacaaaacggttttgttacgtccgctcagaaattgaaaagaaaagacattttgaatgctgtcaaagataaagttgacgccgtttatagttcgtcttaatggatcaacatttccatgataggaaagcctcatcatactaaagcactttttcagttttttgctttagaactgctaccaattataaaatagaatgcacaggttatcttgtttggtttgttattatccttttttcttctttaccagtcatatcacctcattcacgtatgttcgtaatttataatgttaaaaatggcatatatagatatatttatgaacatcctaaaaaataactaaatttttctacatttcaaaaaaggtaacgttgactgccgcatggcagtctaattaggagcttagtgatacatatatatatatatataaatttcggccaagacacctcacataagaagcattaccagaggtgtcctgatctgagatggaccctgtctcatttgttgagttgacaaaatatcagggaaattgattaccctggtgtgcactgactccttagtactcattttcacagcttcgtacacatcatggaagacaaaccatagcaaccagccgctctcattcaatctcgcatagactggaagaagaagctccagaagcatatccattccttgcaaaacgttcgtttctgcgtgcctgtcttctccacttttgtctcggtcagccaacaggcacgtggtgggtgtgcctggagattagaaattgtagttcctcagattatgtaaattttctcaacaaatttactaggacaaagaaatgacgtagtaagagtactaagtatcaagattgttgaggtgttccgttgttagtacttttttacgagcacgcgaagttgacacattgtgtctggcagatgggaactaatttactaatcaatttgcagcagtacgctatcatgtgatgaaatatattcccgttggattaaccatagtctaatagacagtaatatcgaggactcagggactacgccatttatttacttggaataatttgcctgcccattcaataaaattatgaaaattgtgacgttcatacacatgctgatgaaatgagtatttcttttagttgaaaatccaacaaattcctcattaacgccgttttcccacttctatttactggcttttctttcaaaacgaggggatttattcttggcgttgttgaaattttcacatttccagaagatttattcggcgtttatttttctaatccagatttaacaaagagaacaaaatcccactcgttaccctgccttgaattgtcagatggccttatttatttatttgttacccgcagatgtggatataagacggaaatggatagtaaagctaaaacgactcttcaagcagaaattaccgagatgaggtaaaaatgaatgggcaaaatagctagccaagaacagcgcaatcattctaagattaacattgatgaactacagcgcagactctggtaatacagtttatgtggggaatatagatccaaggataacgaaagaacaactttatgaactcttcattcagatcaaccctgttttaaggattaagtatccgaaagataaagttctacaagcttaccaaggctacgcattcatcgaattttataatcaaggagatgctcaatatgcaataaaaataatgaataataccgttagattatacgaccgactgataaaggttcgtcaagtaaccaattctacaggaacaactaatttaccttcaaatatttctaaggacatgattctacctattgctaagttgttcataaaaaaccttgcagattcgatagatagcgaccaattagtgaaaattttcaataaatttggtaagctcataagggaacccgaaattttctacctatcaaacggaaaattaaagtgtgcttatgtttattttgaggactttgaaaaagcagatttggcaataaaatctttgaacaatcagttagtcgccaacaacagaattactgttgattatgccttcaaagaaaatggaaaaggtaacgcaaaatacggtgatgacgttgacaggctgttgaataaagaagcattaaagcacaacatgttgaaataagatcccgctctcacctagtacataccttacccgttagaaaatgcgataacggacacaatcttggcagaaacattatcaatactatgatatatatatatgcgtttccgactatactaatttttacactttttgaaaattttcacttctcctcataatcaaacgaggcagatttccctggactgtatgtaagaagcgtacaccgagttccaaaggtcacaagcttggtgctctagctttgaatcctccgcgtcttcttctttaacgatacattcaaactccttcattgatggataattccagggcttggccaatggataatccgaaaaatgtatgtacttagaatatgcgacactgtcgtttaatcctaccggaatatcgttgccatcattatccaatgtcttataacccaaaacgtcattatagattatagaatagtgccgtgggtttctcaatgaacccgtcagtaagccgtaccttgcaaatggcaaaaccaatacttctggtttgaaaagttttcggacttttctgaagaaaataaactgtttataaataatcttctttaaattgtacatttcttcattgatcaaatccatatcgtacttttccttcttgtttaaaatcttgggcagcataacgttcacaatttcatcaaacgcctcctttgaaggattaataaccattaaattagaagcaaattttaattttccaacctttttactactttggaaatcaaataacggcgataaagatgatgtagaacttataatgtcctgagctatgttattagaattcaagtacaatgaatgcggcaaactcggcaaatgattataaatcatctgacctttcccaattcttttagtcagcacttttgtatacgactggaggttgattggttgcttttcacggtgtcgcgtttcatggtatgatttttccaaatcactgttagataaaaaccagtatgttaatggagctgcaaatttgatataatttggtaggaaaaataattcgtccaagcttgatcttaaaattgcgtcgttgtcaagataaatcacacggtcaaattctgtttggttaaatactagtaattttgttaaactttcattccaaggtgtagtatcctttggcttcacaatgttatctatcaacttgataactacctggtcctcatctatagcttgaatcttgttaaggagtgaactaatgtaagccacatttgaggaagtgtttgggtctagcagatctttagatatcagaagaactaacttggcctttgtctcaaactcctgtttcagatcattgaatatgatcagcgtattacaaagataatcagcattagtcacataattcacgtatgcaaacttggaccactcgatgacctcaccgtttttcaactctttatctaaacgggcggtatataagtcatctatcgtttccttgggtatttgcttgatttctaatgggttgtaaatttcgtgaagcccatccttcctctgttgaaaatactttttatagaactttatttcttggttatactgaaaatgaacaacaagtcttgatactacgaatacagtgaggacgccgaacaaaataaacacaataaatctgattcttcttttggatatcaacctcataattggaatgatagttccgaagtatacagtttagcaaataatgtcacaatgttgtccacaagtggtcggtatttgtttcccggtgatttcgactaatccaccagcctgatacagtacgatcatcactaatgaacgagaaccgagcactagtttatagtgtaccagatgctagttttgctcaaacggtcgcgtgctgagcggaacgagagagtatacaagtgatattttaaaaagccctacattttatcaaaaccctaaacgccaatgttgagcaaccctaaaacgttgatggcggctatttttccaatttttaagtatcataagcatattctccaaatgaatggatcttaccaatgaataccaatgcaataaacttttgaaaatgcttctggaataaatgtaataattctggtacggttgccggatgttactaaaaaagtaagtaatctgtttacttgaacttcctcataactaaggaatacaaacgtttactgcggcttaaaaattcaacaggtttactctcctaagtagtattctcttaatttctgccttgttaagagaatacttcccttttctgtaagtatgttacatttctttatagtaatcatcctagaggcattacagctaaaaggaacctgtcccgggttagtattccagatgacttgacgaatgtttgcgttaacgaaaatggatatgtaaagaatgaatgagttaccaccctgtaagaactcgtttaagaacaaagctcagatctagattaggcactcgcgccctttaattgaaaatcgcgacgcgaggaaaggcaaatataataggccacctggccggtgtacaatagaaaatctctaaagaagggcattccaactcttcctttcgacataagagtaaaacaaatatttgtgtgctccaaataccggcaaataaaataacagacaatgccgtacagagtggcgacgggctacagtgaaaaaagtactgacgatgatttgatatggagaacgccaatagtaaaagaggaactcgaggatgctgacaactttttaaaggatgatgccgagttgtatgataaagtcaagaacgagagtgcagtatcacacctggataccatagttatgccgatcattttcacggtactgggcatgttcactagaatgtacaagattggtcgtaataatcatgtggtctgggatgaagctcattttggtaagttcggctcttactatctgagacacgaattttaccatgatgttcatccacctttaggtaaaatgcttgttggactgtctggttatttggctggctacaatggttcttgggacttcccatctggtgaggtttatcccgactatatcgattatgtgaaaatgaggttatttcaagcaatgttttcatcattgtgtgtgccactagcctatttcacaggaagggctatcggattttctaggctgagtgtttggctatttaccattctagtaatttttgagaattcgtatgcaacattaggcaagttcattctccttgattcaatgctacttttctttaccgtctcttcttacttttgccttgccaagttccatactatgagaaagtctcccttttcggctaggtggtggctatggttgtgcctcactgggttgaatttgggttgcgctatatctgtgaaaatggtaggtcttttcatcatcagtgtagtaggaatttacaccatcagtgaactatggaatctcctaagtgatagatcggtgtcttggaaggtttatgtcaaccattggctagcaagaatattcgggcttatcatcattcctgtttgcgtttttttgttatgcttcaaaatccattttgatctgctgtccaactcagggcccggcgactctaccatgccatcattatttcaagccagtctgaacggtacaaaagttggtaagggaccacgtgatgttgctttgggttcttctattatttccatcaaaaatcaagcgttgggaggcgctttattacattctcatgtccaaccattcccagaaggttctgagcaacagcaagtaactgtctatggttacagtgatgctaacaatgaatggttttttcaaagaatcagaggagtagagccttggactgatgctgagaacaagacaattgagtttgtaaagggtggcgaaatgtatagattaatgcatcgcctaacaggcaagaatctacacacccatgaagtcccagcgcctatatcgaaaagtgaatatgaagtttctgcttacggagatgtagacttaggtgactacaaagataactggattatagaaatcgtggaacaagtaggggaagaagatccaacactactacacccgctatccacatctttccgtattaaaaattctatactgggttgctatttagctcagtcaggtaaacatttaccagaatggggtttcaggcaaggtgaagttgtctgtttaaaacacgcctccaaaagggataagagaacctggtggaatatcgaaacacatgaaaatgaaagattgccacagggagaagatttcgtatatccgaagacttcattcttcaggaatttcatgcagttaaattcagcaatgatggcaaccaataatgctttggtaccaaaccctgaaaagtttgatggtatagcttcatctgcctggcaatggccaaccttgaacgtcggggtaagattatgcgaatggagtgaaaaatctataaagtacttcttattaggatctcctgcgtccgtctggccctcaagcatcgcagtttgcgcactgataatacacgttatattcttaactctgaaatggcagagacaatgtgttatcctatccgatccagtcgaacgtgacgtgttcgttatggcagccttttatccattgcttgcttggcttttacattatatgccattcgtagtgatgtcaagagttgtatacgctcaccactatctgcccaccctttattttgccttaatgatcttgtcatactacttcgatatgattaccaaacgttgggctacaagaaacactggaaaatttctaaggctaggagcttatattgtatacggatcaatcgtgatcgctggatttttttatttctctccttttagttttgggatggatggtccagtagatgattacgcgtacttggcatggctacctacgtggcagattgttgaagatatacgtaacacatagatatatagaatgatcaaaaacttttcttcaccacacaaaaaatgttaattgatgcgcgaaatatctttttcgacttatgccttcttctttatcataacaaagctatgtacctacgacgaaatgaagatattaatccagtccagccttaagaaaatacgagaaaaaaaatgctcaagtgttaaacaatgcctgtatgtagttatctgtgaaatgcatcaaatcatggtcagggtttgcttattgatcagatttgtagttttcaggtatctaagataaaaatatatggtaaatacctttaacgaatattataaaatctactgggttattctattggaatctagaaaatcggaaaagttttgtattctgatatctcttgtgctatgtggtgtcaacacatgtccacgaaaaggtacactaccctggacactaacaacactttccagtggtggtgactgtactgtggtaagggatctttgcgaagaggaagcaggctggtagtgatgtgcggttggtggtatcgttaatttattttgtgtgatcgttacttcctgtacgttaggaccaggttcgagcccttggctctcatagttcccaatatcttcatcgctgccgcccacaaaatcatcctctgatctaacaggagtactcattgttgaataaagtttatttttgattccattatttatagagagctcgtaacatggtggcgagagcaactcgacatcttggtaaatgggaggaacttcttcgtcccaggagattccaagtccagatctttcagtgactgttaatctgaattgcattcttaaaacacgtgctgcaccagtgggaacactcactatattagagttactagcaccgttagatgccttctccttattagtactatggttggacttattactattcaccggtgttatatcttcaggccccatgcgccgtactttcggtgtatttctatttgcaaaaattggagataattcagctaagcgttgatcaggattatgaacattcatcgtattgttattagtttctttcttgtttttggagtttggtttccgtataggttgcccattggcatattgcaatgtttcttctgcaacaactatttccactgccaagatgtggcttacatacaaacctaaatttggatcctgtatatcgcaagccacattgatgctgggcttcttattgcccgtggaaggagtttgtagtgtcgatgcatgcattaccggattagagacgcctgaattaagtcccatacaatctatttctgtaactagctcaatctttccattattgtcaaaatcggttttccatccactcttcatttctcccttagatattatccgaacctcttccgtaaataaactactgttgttttttagctcttgttgaagttgttgttgtcttgcgcgttgttgctgcattagtaactcctgacgcaaagcgtcgtcactgggatggatgaattcgctaccgggttggtcttcctcatcttcattaacaggattttcatcatcaagtccaacattaccagttgacgctggacccgaagaattaggtgcttgttcacgaccgggctcgcctggaagcctttgcgacggcatattttctaaagagtttactgcaacccggatttgtgggcctagttcaccataacgcttaatatgactgcgtggctttttacttttttctgactcttttattttaacctgctcttctaactgcctcaattcatgcttgtgcactggacaagcatgtgctttaactcttgtagtttcttcaattctccaactcaatttacgcattcgccatctcctatcccccgaagaaacaccgtctaatttcatctccaaaggaaaagtagatttaggatatacaacattaggaagaacagcagcagcagttaactctgtaggaggaaatactcttagagaattcttatcaggcccgcgcggtatacttcgagtcacggcgatgggcatcgctagttgcaacaaccgcttcttagaagagcttccttctttcctgggagtagaatgaccggaagaaaaggaatttctatgaggatctatatacgtcacaacagcgataagttcgtatttgacctgggtttcagccgtagcacctagcgatgaagaacatgggacagaccccggtataagataggaaaatgggtaagagtggcttccaacagaaagatcctgggtattactctgaatttcccagcttttcatgtttgtaatctttgttttacagttcatacaggtttgcattgaggaaatattaggcacaaagggtttatggaaatggatcttctgtaccaaacttagtgttaccgacgtaatggtgatcttggtataaccagccattattcttaaattagcaggcgtgggagaatgcgatatggatgtagaagatgttgaaggagagatatttgacgtcgacgctgacaagctggacaatctagatgaaagtgcagaaccaaatgtactctttctttttaggcttttagaagtagtcgacacattagattctgtattctttaaagatttatcttcagcactactgtagggatcgacaaccgtcacagtaaaaagtccacttagcacagcacctgaggattccatagcagacccataaagaacacatggcggtgattctacatcaatagaaagggttagtggaagactttgtccttttttgttgctattactgtagccgttatgattggactgatgagtagatgtaagacgtgaaaatgccatggtaaaacgtattgtttagtgaaatgtatactaagtaggagtaaaaatcagcaatttctggtgttgaaatgtgaacaacagcgttctcctccgaaaaagcaagctataacgttgctcaacttttgattccgaaatcagaagcttaaataaggaaaactgaaagctaattggatgaagcacacaaacttaatcaaccttattattcaaagtattcggagccctagtaaaaactgcctatgatatgtatgagtcgtgcttttccgtctggtttaataagtgttcgagtcagctcaaatcgcatttttgtcttgaagcttccgccaaaagaaaaaaaaagtcgttaatagcgatacaagtaagcaattaactatcacaccatagaatgagttgacaagagtacttatttgatggctttactgaactatgtatacacgtccttcatacatggaacttagctttatcctaaaaatttttataatgtcacagtctttatatctaaatccttgtgaacaaaagctttgttaccaccagcaccaaggtagtcactagcaacctggccgtcacctcttatttggtattgataactcaccagaccgtccaagccaactggaccacgggcgtgaatcttagaggtagaaatacccacttcagcaccaaaaccgtacctgaaaccatcggcaaatctagttgatgcattccagtaaacaccagaggagtcgacacccttcataaatttttcagcgtttgctttattttccgttacaatagcgtcggtatgtctcgaagagtgtgtatttatatgttgaatggccgattctgtagatgtaacaaacttggcagccaaatccaaggataaaaattccttatcaaaatcttgctcctcatcagcatcaacggttttgcattgaattgcttctgtcaatttccctaactcattcagtttatcaaaatacgcagttttcaaatcttttgtagcgtggatagtcactccgccttccaaagttaagttttccagaacttcccaccacttagagaattttgggttaatcaacaacgtttccatagcgttgcaaccagctgggtagttagtctttgcatccaaactaattctttttgccttaatcaaatctgcgtcttcatccaagtaaattgagcagataccatccgcatgacccaacacgggaatttttgtagtgtccttgatttttctgactaaggcattggaaccacgaggaacaactaagtcgatgtactcatcttgatccaacaagtcggaaacatcctgtctggtttcgatcaattgcacagagcccacaggaacaccagtctcactttggaattgtgcaatggtgtcgttaacgatctttgccatttctctgaacgtgttcacagactctttaccacccttcaaaattgcagcattaccagacttgatactcaatgcggtaatattggcaataacttctggacgggattcaaagataactaacaaaacgccgactggagcggttacttggtacaacgtcaagccatcatctaattccctggccattttaaccttgccaacagggtcttctagttcggctacatccttaataccttgtaacataacttcaaatttgtcccctttaaataggtcgagacgtttcaataaagaatccgctaggccagtctctttggcaacagctaaatcgattttattcgcttcttcaatggcatgcgcattagccttcagggcatcgtgaattttgtataaaatatctgatctgccctcgtttgagatggttttcaaaatattccctgctttacgggcatttttggctatttgttgtgaactggacatctttatattggttgcctgtgctcctttttgttcttactctttttaccaatacgcttttactttttctcttcttttcttgaagctttttgaaaaacgtctgtcgacttttttcattttttgactcattgacccaacgccacaaatgaacaaagaaatttggccactgcatcgcctttcctgccccattgattcaaatgtccatgcgcgttgattgatgtgtgatatatatatatatatatatgtatatagatgtatattattatgttcagaggtgattttatctttgtacgcgtaccatttttgtaaagtgaccttgttttgactttttaacgagtaaaaaaacgagttaacaaattcttgacgtaaacgataaagccgcccatcaaaagaaatgcaataatgtcaatgatgaaatacctatacaggtagatggatttcgtgttgttcttcgatttatttaacacgtttttcagctctatcaaactatccatttcccttagagaggacttttgtttatttaatctctcttggcaaacctccattctcctttccaatccttgtaattgcgctacactttcttcgactgatatctttaattcattaataaacgccttattgtcatcctcgtcaaagtctgatttcaacttgaccaagaattgattaatcaccgtggttcgcaaggtggtcatttcgtctaataaaagggttaactctcctgatagaagatcatacttttggatagttttttgaacgttgttttcattcttgattattgtatcgtttaaatttcttctcatctcattctcgatcttcactagaagtgtcgaaatatgattttgataataattcaattcatcaatgttatcattcaaatttgagttgctcttcgaaatagagtttgagctagaatcaggagtggctgcggagccattattattgttcaccttcagtacactcttgaacctagtggaagaatccgctgacttctgcctattcagtaaatacttaaatcccaaggtatcggtgccaggtgcagtggaagagcctgatgaattccttggtttcctctggttagtcaaatatcctaaagagggatatacaccgtttaaacttcttctatccacatcttctgaatctgatgaggtggatgacgtggacgaaaaggctgatgacgacaaaaatgctggtacattagaacgggaatacagaaatgacgaagaatcgttgacagcagaaccgtccaaatcatgataaaacaaagatgtgctgggggaggagtttacggaaatttgtgattgagaatgcatattccctaatttaatgccgccagcggtggatgagggctcaaacactaccgactccctcaacgtatcaaatgggtctgaatttcccaaagaaggctgtaaaaattggttaaccaatcgtttcctctcataatcaaaagaaccagcggatgatctacgttgcgaagaggaggaaccctgtatttgattgaaagctagcccagtatgacagctttggaaaacggacatcgaaccacgacgtcctttactaaggcaagacaatctggccctattagagttgaagtcggttttcggcgacactctgaatggatcatccaaactggatgccccactatatgatctactgtgtcgacctactctgttatcgatgtcatcttcaaacaaaaaatcgctaaacttcccggttttggtcgatcccaggacaggtaagctagtcatttccaatgaacgttgtcgtaccccatgtgccctattctttgtcacatataaatgtctcctatcatgcagcgcaggctgttcctccttttctttctccctttccttttgtaacaacgatcccaagtttacttcagtgcttggtcttgggaccaccggattatcattcactgctatgacaggtaatctagaagatgatttcgaaaagtgtgcaacatttgttttagcttgtagaggttccggctgcggctgcggctgtagaccggattcttttatcttcactgcgtcgccactggaagcccttcttcccttacaaaagcctcttgggaatgaaggaggtaacagggtacagttcctcgatccgggattctccatccggtcaattagcaagttcattttcacttaatgtatcaactataacttaaaccaaaaaaaaaaaaaaatttagatatgggaaggtcttttcctccacaaatagggtgaactatccgacccagatcaataaataaataggctcgaagacgcctcagaactccggtcactggtttgtcttgttgatatacgatgtgccaagcgccgtttctcgatgcttatctggtttagtttacgctgttaaaaccaaaaccccaacagattttcgaccctaacgtatgtagggctaaaatagatattgagtaggttacaattaattattggcaattgcacctagtgacacatttacgaaaacgtagggcaaaaactattacccgacccagggctattttgtgattttttccttttttttgtttatgatcgcgcttctcgaaaagccaaatatcagaaatcccaaacacgccttcatttgatacgattcgtagcctgcgtttcagagatctatcaactttgcaaggccaatcagagaacaaaaaagtctcgcaaagtcatttcacttttctcgcttgaaattattcgttcgatttctggctgcttgcttgttttttgttttctaaggtactattcgacaccattccattggacagcgatacttataccattgtacatataggacataaaaacagcagatattacagcgtataatgtcttttgaagtgggtacacgatgctggtatccccataaagaattgggctggattggggcggaagtaatcaaaaatgagttcaacgacggcaagtaccacctggagttacaattggaagacgatgaaatcgtgtccgtggacacaaaagacttgaataacgataaggaccaatctctaccgcttcttagaaaccctcccattttggaagcaacggaagatttgacctctttatcttacttgaatgagccagctgttttacatgccatcaaacagcgctattctcaattgaatatctacacatactcgggtattgttctgattgctacaaacccttttgatcgtgtcgaccagctttatacacaagacatgatccaagcatatgcgggaaagcgcagaggtgaactggaacctcacttgtttgccattgccgaagaagcgtataggttgatgaaaaatgacaaacaaaatcaaaccattgtggtaagtggtgaatctggtgctggaaaaacggtttctgccaagtatattatgcgttattttgcttctgtagaagaggaaaattccgctactgtacaacatcaagtggaaatgtcggaaacagaacaaaagattctagctacaaaccctatcatggaagcatttggtaatgctaagactaccagaaatgacaattcttccagatttggtaagtatctagaaattttattcgataaggacacatctattattggagcaaggatccgcacatacttgttggaacggtccagattagtttaccagccgccaattgagagaaactaccacatattttatcaattaatggctggattaccagctcaaaccaaggaggaattgcatcttaccgatgcctcagattacttctacatgaaccaaggcggtgacaccaagatcaacggtattgatgatgccaaagaatacaaaattacagtagatgcattgacattagtcggaatcaccaaggaaactcaacaccaaatatttaagatcttggccgcacttctgcatatcggtaacatagaaattaaaaaaactagaaatgatgcatcactatcagctgatgagccaaacctgaaactggcgtgcgaattgctgggaattgatgcctacaactttgccaaatgggtcaccaaaaagcagatcattacaaggtcagagaaaattgtttcgaatctaaattatagtcaagctctggttgccaaagattccgtggctaagtttatttattccgcccttttcgattggcttgtggaaaatatcaacaccgtgttatgcaacccggctgtgaacgaccaaattagctcatttattggtgttctggatatttatgggtttgaacattttgaaaaaaattcatttgaacaattttgtattaactatgccaacgaaaaactacaacaagagttcaaccaacatgttttcaaattagagcaagaagaatacgttaaagaagaaattgaatggtcttttatagagtttaatgataatcaaccttgtattgatctgattgaaaacaagttgggtattttatcactgcttgacgaagaaagtaggttacctgctggttccgacgaatcttggacccaaaaactttatcaaactttggataaatctcctacgaacaaagtattttctaaaccaagattcgggcaaactaaatttatcgtgagccattatgctctagatgtcgcttatgatgtggaaggatttattgaaaaaaatagagacaccgtatctgacggacatttggaagtgttgaaggcttctaccaacgagacactaataaatatcttagagggattagaaaaagctgccaaaaaactggaagaagcgaaaaagcttgaattagagcaggctggcagtaaaaagccaggtccgataagaacggttaacaggaaacccactttaggttccatgtttaagcaatctttgattgaactaatgaataccatcaactcaactaatgttcattatattcgttgtataaagcctaatgcagataaagaagcttggcaatttgataatttgatggtgttgtctcaactcagagcctgtggtgttttggaaactattagaatatcttgtgctgggtttccttctaggtggacttttgaagaatttgtattaagatattacatcttgataccacatgagcagtgggacctaatcttcaaaaaaaaggaaactacagaagaagatatcatatcagtggttaaaatgatcctagatgctactgtaaaggacaaatccaagtaccagattggtaatacaaaaattttcttcaaagcaggtatgcttgcatatctggaaaaacttagaagcaataagatgcataattcaattgttatgatccagaagaaaattagagctaaatattaccgtaagcagtatttgcaaatatctcaggccatcaagtatttgcagaacaacatcaaaggtttcatcattcgtcaacgcgttaatgatgaaatgaaagttaactgtgcaactttattacaggccgcttacaggggtcattccatccgtgccaatgtgttcagcgtattgagaacaattacaaatttgcaaaagaaaattagaaaggaactaaaacaaagacaactgaaacaagaacatgaatataatgctgcggtaactattcaaagtaaagttaggacctttgagccgagatcgagatttttacgcactaaaaaagacactgttgttgtccaatctttgatcagaagaagagctgctcaaaggaaattgaaacaattgaaggcagacgctaaatcagttaatcatctgaaagaagtgagctataaattagagaataaagtgattgaactgacgcagaatctagcatccaaggtcaaagaaaataaagaaatgacagaaagaattaaagaactacaggttcaagtggaagaaagtgccaagttacaagagacattagaaaatatgaaaaaagagcacttaatagatattgataatcagaaatctaaggatatggaattacaaaaaactattgagaacaatttgcaatccactgaacaaactctaaaggacgctcaattagagttggaggacatggttaaacaacatgatgaattgaaagaagaatctaaaaagcaacttgaagaattagagcaaacaaagaaaacattggttgaataccagacattaaacggagacttgcaaaacgaagttaaatctttaaaggaagaaattgctaggttacaaactgccatgtcgctgggcaccgttactactagtgtactacctcaaacaccattaaaggatgtaatgggaggcggtgcttcaaatttcaacaatatgatgcttgagaattccgacttatctcctaatgatttgaatctaaagtctagatctactccatcgtccggaaacaaccacattgattcattgagtgtcgatcgcgaaaatggtgtcaatgctacacaaatcaatgaagagttatacaggttattggaggacactgaaattttgaatcaagaaatcacggaaggcctgttaaagggattcgaagtaccggatgctggtgtagctattcaactaagtaaaagagacgttgtttatccggctagaatactgattatagttttaagtgaaatgtggagatttgggctgaccaagcaaagtgaaagctttcttgcccaagtattgactacaattcaaaaagttgtcactcaattgaagggtaacgatttaattccaagcggtgtattctggttagcaaacgttagagagttatactcatttgtggtgtttgctctaaactctattttaaccgaagaaacgttcaaaaacggcatgaccgatgaggagtataaggagtatgtttcattggtcacagaactaaaggatgatttcgaagctctaagttataatatatataacatttggctgaagaaattgcagaagcaattgcaaaaaaaggccatcaatgctgtggtcatctccgaatcattaccaggtttcagcgcgggagaaaccagcgggtttttgaacaaaatttttgctaacactgaagaatatacaatggacgacattttgacctttttcaacagcatatactggtgcatgaaatcttttcatattgagaatgaagtgttccatgctgtagtcacaaccttattgaattatgtggatgcaatttgttttaacgaattaatcatgaaacgtaatttcttgtcgtggaaaaggggtcttcaattgaactacaacgttactagattagaggaatggtgcaagacgcatggcttgacagatggtactgagtgcttacaacatttgattcagaccgctaagctactgcaagtccgtaagtatactatcgaagacattgatatcttaagaggaatttgttattcgctaacacctgcacaattgcaaaaattgatttcacaataccaggtggcagactatgagtctccaattccacaggaaatcttaagatacgttgctgatatagttaagaaagaagctgcgttatcttcatcaggtaatgattctaagggtcacgagcatagcagcagtatatttatcactccagaaacaggtccatttactgacccattcagtttgataaagacaagaaaatttgaccaagtagaagcctatataccagcgtggttatccttgccctcaactaagagaatagttgaccttgttgcccaacaagtcgttcaagacggccactaaaactgatggcgcgagaaacaaaattgtacatgaatgctaaaaaaagaaatgacaaaaaaagagaaaaaaaaaaatgaaactacatagttaattaataatagaagtatttgtcaatagtatgataatgaaatcgatattatggaagatattaaccgcgcgccgtattagtgtacactatattaaactacattttgcttcttactgaatttataaattatgattatattattattactattatgactactgtatatattttttagaattagcatcgggaaccgatgagcgttagctgaaatggacgacgataggaacgataattaccactagtaaaataataacaactaagaataaacacattctcatttttagatctttccaccacatttgctttctgaccctgttggcgcctctcttgaatccttgtgcggagatagccaagttatcagctttgtcctcaatggatgttagcctttcaccacgttcagcaaccttgttgatattatctctcattattcccaccgtgtcatcaatctcttgtctcaaagcagcagtcttgttttgggaatttgggtttgcgcctgagttactctcctctggaggcacatatggatcgtatggcactgatgacgacatcgttgcgcgttcttattttgtatttggaagtgtttcgaatgtatgcctgacttacagatactattcactgagcagatagtttacctttctataaaatattaaaggctgtttcaaccaaaacttgaaggaaaactaactggctccccgcttttgcatcttttgggtgcgacaactggtgtttgtttggttgcgctgcaccattcgcgctataatgccaaaatccgaagaattttgagccacttttgcggaagacagggagaaaaaataaaaaaaaagtcacgcgtatatcatgtgaccaagatcactataaacgctccgtggaatgcgcttttagggcgactgaatgattccatggtcattgttacagccgcccgtggctttgttccacggactgataaagggatacgctaagaccagaaaaacccttaatattcaatatagtacagtactactacagaattggtcggcatatttttattttgttcgtattaataatacacctgctgtcatcagtaccaataatttgataggttttccccacatagtgcgccttatgtaagtatataaggaaggacggttgggcaagcatcttactttcttatctctccccgtgacagaaccatagaagatatctagcgttattatatttctatacttagtaaacgtttccggtatagtagaaaaatcaaacaataatttctggtcttacatagttgttaggatgttgcaagcgccctcaagttcaaactcgggtttgaatcaaggaaatgctgcgccggacggcccacctaacgaaacacagccgtacgaaggcctcgacgcggcagctcaagaagaaataaaagaattggcaagaacgctgacgagccaatcttcccttttatcgcaagaaaagcgtattaccggcactggcgacccgaatacactaactgctgcttcttcatcgtcattgagccggtcaattttcgctagtgatatcaagggagttaacccaatccttttggacgtcaatgatccagactacgatgagacattggatcctcgatcagaaaatttctcgagtgtcagatgggtacgaaatatggcacaaatatgcgagaatgattcggatttctataaaccgttttcattaggttgcgcctggaaagatttgagtgcctccggtgattctgccgatataacatatcagggaacatttggtaatatgcccatcaaatacttgaaaatgagttggaggtgcatatcccgacgtcttttccaccggacacatggcaagagtgaagataatgactccggtttccaaattttgaagccgatggacggatgcatcaatccgggggaactacttgttgtgcttggacgacccggtgcaggatgtactacgctgctgaaatctatatctgtaaatacacacggattcaagatttctccggacacaatcatcacgtacaatggattctccaacaaagagatcaaaaaccattaccgtggtgaagtggtctacaatgcagaatcagacattcacatcccgcacttgacagtattccaaactttatacacagtggcaagactgaagacaccaaggaaccgaatcaagggtgtcgatagggacacatttgccaaacacatgactgaagtggcaatggcaacttacggactgagccacactgcagatacaaaagtgggtaatgattttgttcgtggtgtatccgggggagaaaggaaaagagtttccattgctgaagtgtctatatgtggctcgaagtttcagtgctgggataatgccacgaggggcttagattctgctaccgcgctggagttcatcaaggccttgaaaacgcaagccactatcacaaagtctgcagccactgtggccatttaccaatgttctaaagatgcctatgatttgttcgataaagtctgtgttctttacgatggttaccaaatcttctttggcccaagtaagcaggccaaaaagtactttcaaagaatgggatatgtgtgtcccgaaaggcagaccacagcagattatttgacctctattactagtccttctgaaagaattaaggacaaagacatggtcaaacatggaattatgatcccacaaacggcctatgaaatgaaccagtactggattcaatcagaggaatacaaacaattacaggtgcaggtgaacaaacatttagatacagactcttcccagcaaagagaacaaataaaaaatgcacatattgccaaacaatctaagagagcacggccctcctctccttatacagtaagtttctttttgcaagttaagtatattctaatcagggatatatggaggattaagaatgacccaagtattcaacttttcacggttttgagtcatgcagcaatggctcttatcttgggatcaatgttttatgaagtcatgctttccactaccacaacaaccttttattaccgaggcgcggctattttttttgctattctgttcaatgcgttctcatcacttttagagatcttttcactctatgagacgaggcccattaccgaaaagcacaagacttactcgttatatcgcccaagtgctgatgccttcgcctctacattttctgatgttccaacaaaattagccacggcagtaactttcaacataccatattattttttaatcaatctaaaaagagatgccggtgcttttttcttttactttttaataaacattataacagtttttgctatgtcgcatttgttcagatgcattggctcagtgtcgaaaactttacctcaggcaatggttcccgcatctgttcttctgttagcttttgcaatgtacactgggtttgccatcccaagagtccaaatgcttggctggtcaaaatggatttcttatatcaacccattgtcttacctttttgaatcgctaatgattaacgaatttcatggtagaaatttcccatgtgctcagtatatacctagtgggccaaattatgtcaacgcaacaggtgacgaagtcacctgctccgccctcggttctatcccaggaaataattatgtaagtggtgatgatttcattcaaacgaactacggctatcgacataagaacaaatggcggtctgttggtattggtttagcatacattatttttttcttatttctgtatttattcttttgtgaatacaatgaaggagcaaagcaaaatggtgagatgttagtatttccccatagtgtggttaaaaagatgaagaagaagggtattgtctctgagaagaaaaagaaaaaccaaccaacgttgtcaacatctgatgctgagaaagatgtagagatgaacaacaattcaagtgcgactgattcaagatttttacgcgattctgatgcagctataatgggtaacgataaaactgtcgccaaggagcattattcatctccttcatcttctgcgtctcaaagcaatagttttagtaaaagtgatgacattgaattgtccaaatcacaagcgatttttcattggaaaaacttatgctacgatatcccgattaagaatgggaagaggagaattttggataatgttgatggttgggtcaagcctggtacactaactgccttgattggcgcatctggtgcaggaaaaacaacgttattagattgtcttgccgagagaaccacgatgggtttaatcactggtgatgtattcgtagatggtagaccgcgggaccagtctttccccagatcaattggttattgtcagcagcaggatttgcatttgaaaaccgcaactgtgagagagtcattaaggttttccgcgtacctgcgtcaagccgatgatgtatccatcgaggagaaagataaatacgttgaagaagtcattgaggtattggagatgaaactttatgctgatgccatagtaggcgttcctggtgaaggtttaaatgtggaacaaagaaaaaggttaaccataggtgtggagttagctgccaaaccaaaactgttggtatttttagatgagcccacgtctgggcttgattcccaaactgcatggtcaacttgtcaattaatgaagaaattggctagtcgcggacaagcaattttatgtaccattcatcaaccttctgctctcttaatgcaagagtttgataggttactatttttgcaagagggcggacaaactgtatattttggagagctagggaaaggttgcaaaacaatgattaactatttcgaagctcatggtgcccataaatgcccaccagatgccaatccagccgaatggatgttagaaatagtaggtgctgcaccaggaactcacgctagtcaagattattttgccatttggagagattctgaagaatatagggaaatgcagaaagagttggactggatggaacgagaattgcctaaacggacggaaggttcgtcaaatgaggagcagaaggagttcgctacgtcaactttgtaccagatcaaattggtgagttatcgattattccatcaatattggagaacaccattttacttatggtcaaaatttttttcaacaattgtgtctgaactcttcataggcttcacttttttcaaggcgaatacatcattacagggcctacagaatcaaatgctggccatttttatgtttacagtggtattcaacccaatattgcaacaatatttaccacttttcgttcagcagagggaactttatgaagctagagaaaggccatcaagaaccttttcgtggaaagcatttattgtatcgcagattctcgtggaaatcccttggaatttactggccggtactatagcttttttcgtctattattatcctgttggattttacagaaatgcttcttatgcaaatcaacttcatgaacgaggagctttattttggttatttgcgtgcgcgttttacgtctacatcagttcaatgggggtattagtgatttcatgcattgaaattgcagaaaatgctgcgaatctcgcttcacttttctttataatgtcattatctttctgcggtgttctggctacgccaaatattctaccaagattctggatttttatgtatagagtatcgccactgacatacctcattgatgctctgctatcggtaggactggccaatgctagtgtcgtttgttccagcaacgaacttttaaaaattgttcctccaagcggtatgacatgctcggaatatatggaaccttatatgcaatccaccgggacgggttatctgctcgatgggagttccgaaactgaatgtcacttttgtcaattcagttctaccaatgattatctggcgactgtgagttcttcgtattcacgtagatggatgaactatggcatttttagtgcatatattgtctttgactattgtgcagcaatatttttatactggctggtgcgggttccaaagaaaagcaaaaaattaaagaaataattaaatattactggctacattcattgtatatgcaaaattagttaactattgttcagaggtttacgccatgttgctaaatgtttggtgaaactaaaagactagctcaataatcaagacaataaataatgctagtaaacaggtgttcataaattacatcacttttgtgactttatgtacacatatacctacatatattatctttcaaaactatacacctcgtttagcttacgatactatggtctcctattatattggatttgtaaagcatcgacttgctgctgcaatgactgcaagttacccaaaatatcgcttgaattggatctattaacatctgcagtgaatggaaattgctgctgctgttgctgttgctgttgatgaacttgctgccctagcattccgtaattaggcttgttaggttggctatgtatatcactgttgtttaagtgaagttgccccggatgttgttgcatttgagaaagttggccaccatatattcgttgttgagtttgttgttgttgttgctgctgaatatacgtctgatgagattgagtattgttcattgccgcactagtattttggaatgaacttatgccattactggcgttattgccattaacagtagacgcatttgatggcgtaggatttggagatggtgaagaagaaagtaaagattgaaagtaactattagcagcattctgaggtgacaaaaaatttggagattgtatgcttggtgaatttgtataggagggttgggtcggcaccaaattattctgcttttgcacgttagagtacatatgttgaggtggcacaatggccccttgttgctgctgctgagcgcgtggaggtggaggaggtggaagatgttggggctgctgttgattattagtatacgtattctggggggatatcattgttgcttgattattggaataagtatgttgcggagaaagaatgggctgattttgagtgaaggtattttgtggagatatcaattgcgaccgttggtgctgcgggatcgtattttgaggagaaagcaaatgcgattgctgatgttgaggaagagtgttttgaggggggaatgcaccagttatttctactttcggcatggatacgatgttaccattattaatccgaacattgttagagtaggtgtgttgaggcgatatgttagatggttcaattttcgcttgagtcggattaacctcttggtaaggttgctgttgattgctttgaggaagagtaatgttcggagaattcagaaatgctggtcctgtactttgtggagatgaagattggttcgtaaattgcgcctgaaacatcgaagatactgggttattaactgaaggtgagatatgctgtttcatcaagtaatttgcagaacctgtggcggtaggtttcaaaggttgaagtcccccagagtttgtaactgtttctggtgtactcgaaggtttgatagactgaggttgttccatatgacttcgcatcaaataatttgcagagcccgttgctgttggttttaaaggttgtaaacctgtttggatggcaccgttgcttggatgcaacccctgattatattcttctcgcaccaggtgattagctgaacctgtggcggttggcttcaaaggttctaacggaagttgctgtggaacagtggtgttattcacattgctagttggtagagtattgccattctgtaaaaataccgatgaaattggcaatgaggcagaatcaacagtctgtatttgtttgaaatgggacaaggaatccttcatatcctccaaaactttcttctcctcctcagtttcttgttgttcgctgggcaaactcgaaactaatccgctgttttttctccgcttatatagcctctttaataattgatccatgggcaatgtgaaatccaaaggactgtcattattagaatcctgatcttcatcttctgcatcaggatcttgctttcttgcttcactattattagatgattcttgattgaggtttggagggtcttgaaatgttatatgctctgaaaacctaaccttcttactcttaaaattcaaatttttgattcttctcctgactctttttctcgttgtcttaccagtcaacagcaatgaagcaaatgagtcaaaatcgaccttttgatcaccagttttggcagaactatcatcgtcttccacctcctcgtacacctcttcgtgattctcactacttaggataggacgtggtttgggaacaggtgccttttccaagatcatgcgtcttagaggtaagatgccatatataatagctctagaaactaatcttaaaacagcgaaaaattgaccaatatttaacgcatttttacagctacggaaaatttccacaattctatcttttactttttgtgataaattaaaattggtcaagaacctaaacacgtcgttcaatcttactagttttccatgggttctcaaacatatatagtggtaccatcttagatatgtccttatttcttcatgggtaagttggttttgtgataaagacaatgggacttgcatgtcttctggtgactccgcgtacacatcgcctccagaaagtgttcgtacctccccattaggtggattatccttttgaggagagctcacgttagtggcattatcagctgctgtatttgagtgattatttctgtaagacaaagttgtatcactgtgacttcttgatccctgatcccaaaagctggaatcatgtggagcagcagtatttataccaaaatcaaaagacacactgggtggtcctaatccattcgatggcctcttttctgcttggtccccgctgcttaagtccaatcccggaacattaagccaatcaaacgacatgtttcgttaccatgtaaaatttatcgagcctgcaatgatctataaaatcttagctaacgagaagatgcagataatttgggttttgaattcctattttgaattctaccttttgttttgtccccgtttcctaatgttaactctttttctaataggggcaacttacttttgttttctcatttggcgaaaaaaagtaagtagaaataaataaaaaaataatattataatgtgctgtatatataaatacaaatgcgaaagctaatgcagattttgcctagtactctctagaaatagtaatgtccctttccagctcaaccaaatttctatttgtagtgcttgacttccttgccggcaattttttggaatgtactgctttcgcagtctttcttattggcgatgatgatgccgttcttgcttgtgatggtttctttttataattagatttgtcgttcagaacgtcgtcaatcactccatctataggaatattaaagaattgtttttctgtctccaaagtatagtctaacggtttatttgcacattcatagaacgcttcaaatgccttcctgccaccatacactcttttgtacttcctttccataggcgtggtattcttttttctggttaattttttcttattttcgtcatctatcctgttttccttctttctcctgttctccagcaattgcttttctgggattgctgaatcgttagcaattttatgaagtgtgggataatctggcatattgacaggtaatctgattcgttgatcagctttggcatttttggtaccatctaaaaaattggatcccataatacgtactttagtccttttgcccttctcgacatcctttatatagtctaggaggctgtactctgcagtgttcccatctctagcgtattctttggatgtacactcccgcagatactcatcttctagccgattcacatcgcgcttatctgactggacttgcatcgcaagaaaatattttaagaactctggagtataagatttattatattcttcaaatacaggttctctgtagttataggcatattgtgatactttgctgtcgatatcgagatttggtttacccaatttactattggatttgtctagcagttgattgatatcaagcgcctccccatgaggaatggcggttttgttcgagggggttatgcagtccatattgacttctttacgtatgacagaatcaatatctacttgcgagaaaaaggcacagttttgcggtaattcatttatccccatttgctggcaaaacattgctctcgtccatatgttgctgatttgcaaagccatagcagctctgtatttgtccttttcgctcaccaaaaatctaatctcatcatggatggaaatgcaaagccttgcctcaaggttatatttcttaataatatattccatggagcaacaaagaagatgtagataatccactccagatgactggatggcccaattgattcttgaaggtagaaaggaattcgccctcagatttttcttcataagtgaataggtaataccacatcccagtaccggtgtctttggagtttcttgttccgcgatgctttctaatttattgaatagaattgactcagatccaccataccaaaattttttgaataattttgatcttttcgttttacctttcgtattttcatataacttattcgcaattttttttgtctcttcatcagttagagatgggttaaaccttttaagtaactgactcgcaaatttagcaccagcgccgtaaattctaccataattaaaaattttcgcctcattacgagaacaccccaaaatttgagcagtcttcgtgtgcaaatctgtaccttcgtttttagtgccttctaaacacatccaaccaatggcggtaccaccatgaacattgaaaatggagtcaccgactaaagatgctatccacaattcctcactatccacgtccgccccaacaaaacaataacctggaggagctttgacttgagttttcaattcggaacctatcctatttgcttttgcattggatgcggttaaccacgcattttccacagctcttctagtgattgtgcccatggggacgattttcggtataattatggcaagatcatttgtcttctcattatttaacgacgattttgcggacaaagactggaactcattagggaatttacaactggggactacaaattgggattggattctttcccttgctgacatccaataagaccctgaagagttaatttgtaaagcctgatgagccaattctgactcagattttagtacgcccttttcaaaaaaatggttatacgatttggttaaaagattagtgcaattaaaagtcggcccattgggatgaggtactttgaaaagaacacctgtgcattgcaatcctaggttatgcgttcttatttcctcttcctcttgagatacgctatctgccaaaacataatttttagccttgtatgtttctacttgttcatggggcacgttgaagcaccatccagactccttcgaccatattacgggggaattctcccacgataacttgaacaaaatcggaattattcttgatttaatagtgatcttaggttctacagtgtcctttgagggaaaaagttgtctataccattctggaaagccgggcagcttttgacactttgcaggaacacctttctttgtcaatcttaaaggtttggtggtccaatccaattgtgataaccagggatccttgagataaaaatctggtttgtccttcaacaggacgatatcttttatgatttgaacaattttggattctatctggactttggactgttggtacaaagactcagagctgttcaagtaatcattccagtcgtttagcttcgtcggcagaatgcatttgcttaaggactttaaacctgcaaacgaaactggatgaggacactttttcaggaaaacagggaaaatctcatcaaacacttggcttgtggccgttacgtcagtggcgcagtagttgaccagtttttggaaattttctattatcgttgatttatctgtggaagcaaagaaatctctatcagtcttatcaagatctatcttgcagtgaaatttcgctacatcctttagcgagtttaaagcagacacatttaaccaagggtcgtcataatcttctatggaaatttctggatgtacttccgattccacttctgcctcttttttcttgttattcttcatgaacatcggacgttgtcttgaacacagcccgaaagatgcaatatgcagagattgagtgtcgaggaaaaacgccttcgagtccctgaagttgtattcttcgagaacccgtgccctatcatacgcaacattgtgaccaattattacttgctctttattcaatgtgtttaggggtatcagtgcagcaggatcatcaccaccacatatgaacggcgaacaccaaaggtaccacgccgtcgatgacaaggccgtggccaaagtcggatagtcagagacgttatagagtgtttctacatcaaacaccaccagctcttcgtctgggtatgccacttcgacgggtgccattccaggtacgtatttaacccagcctggcttccgcagccattccgccggtcgtgccaccatctccgtgaacttgtcctcgcaaaaactcttgtacggttcagaattgaaacgcccaatcttctggaaatgctcatctagcgacctgccttgtagtggcggcagaggaaacgatattggatccgtgatgagcgtcttcttcccccacaacccatggtcctttagcgactttttcgataactccataagtttgtcgctttgctccacctcatctttaccaccgcaactaccaaatacctgtctttgcaaagactcacctaaatactgtatccccacaggattaatcctgggtgcttctgcggtattcttctttgtggagaaccatcgagcacaaaactgcacacgcagcggccgccgccgcaccattcgcagcatgcattcagatctaaccatcaatttcgtcatacttgtccctcgttgctcaacaactacatataatccccatctcgacctcttctttagaaccgttctttcgtagtccatacctattgttgtttactgagtatcggctaaaagtgcgcccgaggtcacccgccacggagaggggcgaaagcggccatttcgataagaactcacgctatatatcagcaaagaacaatagcagttgcaagaaaagttgtttgtaactgttttacaaaagaggcacagaacaggccacgcaccatccgatacagcatgtcctccgctattactgctttgacaccaaaccaagtgaacgatgaattgaacaagatgcaagctttcatcagaaaggaagctgaagaaaaagcgaaggaaatccaattgaaggctgaccaagagtacgaaatcgagaagaccaacatcgtaagaaatgaaaccaacaacattgacggcaacttcaagagcaagttgaagaaggccatgctttcgcaacagattactaagtcaacgatagcaaacaaaatgaggttgaaggttctttctgctcgtgaacagtcgctagacgggatattcgaggaaaccaaggaaaagttgtcaggaattgccaacaaccgggacgagtacaagcccattttgcaatcattgatcgtggaggcacttttgaagttgttggaacctaaggcgattgtcaaggctcttgaaagagacgtcgatttaatcgagtcgatgaaggacgacattatgcgtgagtatggggaaaaggcccagcgcgcaccattggaagagattgttatctccaatgattacttgaacaaagaccttgtttccggcggtgttgtggtctccaatgcatcagacaagattgaaattaacaacactttggaggaaagattgaaattgttaagtgaagaggcattgcccgccatcagattggaattgtatggtccttccaagacaagaaagttctttgattgatcgaccagcagcttgtatacctacatacttacatatacactcctaacagatttttttttgtatgttgttctttcctctgtggtggtccagtcttttgtctctttttttttttcttcttttttttttttttttttttttttgcagcattatgatagaacaatagggctcaagatcgcaccaaggctaacagtaacggtatacgcaatcgtagtgaaagtgattttcaatcaagcatctcatgaatcggcgtctcctggtacgttctatatcttgtttccaacctttgtcgagaataacttttggaagaccaaacacgccatttcttagaaagtatgctgacacatccactgctgcaaacaccaacagcaccatattgcggaaacagttactatcgttgaagcccatttctgcctctgattcactgttcatttcgtgtacggtattcaattctaagggaaatattatctcaatgtccgagaagtttcctaaatggtcctttttaactgaacattcccttttccccagagacctgaggaaaatagataactcctctattgatattattccaaccatcatgtgtaagccaaactgtattgtcatcaacttattgcatatcaaagctcttatcgaacgagataaggtctacgtcttcgatacaacaaacccttccgccgctgccaaactgagtgtacttatgtatgacttggagtctaagttgtcctccaccaagaataactctcaattttacgagcatagagccctcgagagtattttcatcaacgtaatgagcgcactggaaacagatttcaagcttcactcacaaatctgtattcaaatcttaaatgatctggaaaacgaggtcaatagacttaaactgcggcatcttttaattaagtccaaagatcttacgcttttttaccaaaaaactttattgattagagatctattagatgaactattagaaaacgacgatgatttagcaaacatgtacttgacagttaagaagtctcctaaggacaatttttcggacttggaaatgcttatagagacgtactacacccaatgtgatgaatacgttcagcaatcagaatctttgattcaggatatcaaatctactgaagaaattgtcaacatcatattggacgcaaatagaaattccttaatgttgttggagttgaaagttaccatctacacgttgggattcacagtagcatctgttctgccggcattctatggtatgaatttaaagaatttcatcgaggagagtgaatgggggtttacttcagtggcggtattttctattgtttctgccctttatatcaccaagaaaaattttaattctttaagatccgtgacaaagatgaccatgtatccaaactcacccgcaaactccagtgtgtatcctaaaacatcagcgtctattgccctgacaaataaactaaagcgaaggcggaagtggtggaaatcaaccaagcagcggttgggagtgctactttatggcagcagctacactaataaggctaacctgtcgaataataagattaataaaggtttttcaaaggtgaagaaatttaacatggagaatgatattaagaacaagcagaacagagatatgatttggaaatggttgatagaagacaagaaaaattgaaaggcgattatcatgataaactatacaatattattagcataaacctgtatatatacatatgtaagaaaaaagggtatttaaaactctttttaacagcaaatcttttgtccttgtaaaaacataaataattaaactaagactaattatacaatgacacttttttattaagagcaaaataaacaaaaagaactcctatgcattatttttcgttttattttaacttcttaaatggaaagcttctccttgaacaaactttccaaatcatcaactgcatcctttatagcggctggtttatcacccataccttggaaaacattacctttaccaccagccttaccgccgatgatactggacacctttttggcaagcgcagaaccatcaatacccttggctaaagcagcattggagatgtaacaaccgtgagcaacacgaccttcagggtcattacctgccaataaatagattgacttgtctttgacagaatcattggatttcatgtagttgatcgcttcagtgatagctttagcatttggagaaatatcaatgaatttaactaggtatggagcattctcattggtttcgaaaaatgtcttcacttcatcaagagtttgtttgttttcttttttggcccttgacttaacttcatccttcactgctttttcaattttgttaaatttctgcttcagttcattttttgtgataacagaaattgaaagttgaccaagtttgacaccaagttccttcaacttcttttctttgattggagagaacggcagcttgtctgcagcatccaaatcagcagcaaactgttcagccaatctttgagcttcaaaggcttcagttccagtaacagcaacaattcttctgataccctttgcaataccgctctcttctaaaatgacgaagtatttaatatcgcctgtcttgttgacatgggtaccaccgcaaaattcaatagaatacttggtccactcttcgttagctgggttggccaacaattcttcgattggcttaccaacagaaactacacgaactggatctgggtaagtctcaccaaagacagcacgaacaccatcaatggatttggccaagtccaatggaatttccttgtaaaacacttgtaagttttctttaatttgctcattacagatatcttcaacttttttcaattcttcatttgacacagcctttttatgagagaaatcgaatctcaatttttctggggcaaccaaagaacccttttgatcgacatcattacccaaagtttccttcagagcaaagtttaagatatgtgtaccagtatgattgttcttaatagggaaacgacgtagttcatcgaatgaagcgataatcttgtcaccgacagacaacttaccttcttctaaagacccggtgtggaaaacaaaaccgttatacaattgaacattttcaacattaaactcagcagcgtcatcaataacaattttaccagtgtcatattcttgaccaccttgttcggcgtagaaacatgttttatccaaaataataccgtacttcttacctggttcagtgatctcatcaacaaagttggtaccgtcatgcagtttcaaaatggtaccttcgacgttggcgctgccgtatttgaattcatcattagtcttgggcaccttagcatcgttcaactcggataattcatggacgtttaacttaatcaaatcactttggtccttcttaccacctcttttggatgcttcgtatgactcttgtttggccttttcgaaaccgggtccatcaatcttcaagccttgttcttcagccatcaattcagtcaagtcgactgggaaaccataagtgtcgtaaagtctccaaacttgtttaccgtctaaagtcttagattcagtcttagaagcagcagaagcatatttttcaaatagtctttcaccacgatccaaggtcttagcgaaagaagcttcttcttcatccaagatttcaaagaggaatgcaggatccttggctaattcgggaaagatatcttgaacctgagaaattaaagttggagccaaagtggagaaaaagttaccgattgggtaattcatgtatttacgggcgtaacgggcacctcttcttagaatgcgtctcaaaacatatcctctaccttcattgtttggaacgccaccgtcagctaaggcaaaagtcaatgtacggacatgatcagctaaaactctgtaggcagtatcgataccgtccttgtcattctcaccaaaattgccagaatatggtctaactgaagtgatttcttggatacgctcgaacaaaggtgtgaaaacatcggtatcatagttagatctaacatcttgcagaacagaaaccaatctttcgaaccccatacctgtgtcgatatgcttggcaggtaaaggcttcaaagacccgtcttgttctctgttgaattgaatgaaaaccaaattccaaacttccaagacatcagggtcgtccatattaaccaaggaagcagcatttctaccacctattctatcgtagtgaatttcagaacaaggaccacatgggccttggtcacccatttcccaaaagttgtcctttgcattaccaggtaatatatggtcatcgggaacaccaacatttttccatagttcacgggcttcagtatcaggttccaagcctaacttttcatcaccttcaaaataggtaacgtataatctatcctttggaatgccgtatacttcagtcaacaaagtccatgagtaagtaatagcttccttcttgaaatagtcgccaaacgaccagttacccagcatttcaaaaaaggtatgatgataagaatccttaccgacatcttctaaatcgttgtgtttaccaccagctctgatacacttttgagagttgtaagcccttttcaaggtgtagaaatcggaagctggatcgacagtacctaaaaagataggcttgtattggttcataccggcattagcgaaaagtaaagttggatcatcaaatggaactactggagaggatttgacaaacttgtgttctttagatttgaaatagtctagaaaggtattacggacattagtagcggtccatttttgcttatcaccgatcgtcattatggttctagttgatgtagttaattgcttcttgaaagaaagagtcaagttccttaatccggtagttgacgtcgtcttgtcttaaataagaagatgttggaagcacgccttttttgtaattctatttaaaaaaaaccgactttgttcaatcaaactgctttcatatctgatagcagtcgccaactgcgtttttcttgttttactcatcatccatcgagcggatgaaaaaaaagagaaaaaagaaacggccaatccgttgatcatgattaaataaaatatagggttctgaattgttaggtttaatctgcaaattattcaggtcatcgttgacttttttgcagggcactaaaaaccgctaacataggacggtatattgctgattttagacttaacttcttggtgtagtcgtctctgaacatggcatgatacagctttggtgggtcactagaacaatttgaatcttgctcagcacgctctgtcttacgtatatatccaatttcagttgattcgaaagacatgaaagattattaatgtgtgcattacccggattgtcaataactcatatagttagtatactaattaactaactatataacgtggcatattaaagattaattgtcctggtagaatatagacgtatcagtgtgagtgcctctgttgattatgagactacttgcgttggtattgttattgttgtgtgcgccgcttcgtgcatggacttatagcttacgatatggcatacccgaatctgctcaggtctggtctattttagttcatttactgggcgatgttgataatcagctgttaactaatttatatcctttggttaccggtttggatgacgagattgatattcaagaaaatcttgtggcgctaacttccaatgtattaagggagcgatacgataaagaggatgtggctgatttattggaactgtatgctagtctttaccctatgggtatgatacagcacgatatcagttccaatgcagaacaagacgatgcaaatagtagctatttcgttttgaatggtaataggtacgaaaagcccgacgacgtgttctacttgaaatctaaggatttaacaattcaacagaaagtcccagatgttgatgttatacaaccttacgatgttgtcattggtactaactcagaagcgccgatattgatcttgtacggttgtcctaccgttattgactccgacttcgaagaattcaataggaatttatttatggaagcaatgaatggagagggaaaatttagatttatttggagatccacatgttcccttgatgggaaaagcgtggagtatcccttaactcatccgcttgaaattactttacaaaatggttctagaatgagctccatacctcaattaaaaaaaatactatatactgtacccaaagaaatattggttggagcagacaacgatgatcagctccatgatctagaaccagaagaattacgtgaacttgatttgagagtaacatcgttaatctcagaattttaccaatataaaaaggatatcacagccactctaaatttcaccaaaagtattgttaacaactttccactaatctctaaacaactgattaaggtttcatctgttaacaaggatataataacaagtaatgaagaactcaatagtaaaggcttcgattacaacatgctaggtctctatattaatggacagaattggaaaattacctcactgactccgtacaatttgcttactgctttaaaaactgaataccaaagtttactgaaaattacgaaccttttgcaagaactcgagccatcgaaatgcatactagattccaagtttttactcaataagttttctcaattttcattggggaagttgcaaaacttacaaccaatcaaaatggatctccacacaattccagggttctcagaatcagtaatatacttcaatgatatcgaaagcgacccgcaatatgacgaattagtaaatagtgttcaagcattttttgataaatcgaaattcggagagttgcctgaaataaagcaaaactggtcagagatcatattcgttatagatttcgcccgtttagaagatagtgaggtgaaggaggcattgggtgggttggttcgtgccgttaatgttgtctcccagggatatccgcaaagagtcggactattgccatttagttcagatagtgacaagtccgttgttaataaaatttacgagctgaagaactcaactgacaatttaacagaattaaaaagttttttggagacaatgctgcttgcagatggcctttccgcgaatgcaaaacattcaaaacacataccagttccagatgttttccatctacttgatgaacttcaaattgacgaaacatcaattataatcaatggagagatttacccatttagaaaaaatgcttggaattatttaattgcaaaagttatcaaaaaggacactgaatttattcgtaaagaattgagcaattcttctccgaaaaacaaacaaattagcgtaagggacttattgcattacaaatctgcaaatctgagacataataaatatacaccaaattattttgctgattcggtatattcttcggtcaacaatactgcattggaaagcgtatgctcagaaagaataggctactatactaaaaatgaagaatacaatttattacacacaatcacattagtggatgattttggctctattcatgctttgaaaagattgagaaacttgttgcatacttcctttgttggtgttaggatcagaatcattcacgtaggtgatatttctgatatttggtatcaattgcgtggaagtctttcccaaaaagatccaataggctcaataaatacatttattgatgctttgaaacttaaaaaggtaaaaagtcacacgtacaaaaaaagcggcttaaaccagttaggccttcataaatggcttcctgacattccattatttgaattgcaaaagggttcatttattgctttgaacggtagatttattcatcttgatcaaaatgaagtgccagaaacagaacatttcgaagcaatcataaagagagaagctctaagaacgatcgattcagttttcgccctagatttactttttccaggtttctcacaggaaataatcaatcctgatttgatagaaatgatctcctccattttaactaggttgttttaccaaggtacacatatatacaataatggtattgattataccactgaaagtagcttaccaagaatggatttgagcgagttttttagacctaataatttaacgatgtttgaagatggaaaatcagcttctattgatttactactaattttagatccacttgaagagagaacgcaaatgattctttctcttgttgagcaattcaggcctttgaaatttgttaatattcaggtaattttaatgccgacactggaattaaacattgtccctattagaagaatatacgttgatgacgcagatattgtcaaatcaataacttctgaggatagcagatcagatccagaagtagatattgaaatggatgttcctaattctttcattgtagataataattatcggataaaaaaattgctcatagaattacattccttctctagcaaaacagtcctttcaactggcaatattgatggtatggggggtgtatgcctagcacttgtcgattctgcagggaacattattgacaaaactacaacaatgaaaacctttggctatggacaatttcataccgacaaatttttaaagggttgctatataaaaagttgtgattcaagatataccgttcagtcattttctactgacgggcatcccgactttataccatcagattccttggatatactgtcgtacaatccacaaaaaatcgctgtaaaaatttcagaagagcctacacacgaggaagaatacgaggaaggtcgcaacaatgatacaataatcaatatttttactattttagagtccgggccagatgaggaagagaggtacatgcaaatgattttatccattttgtcaaagtgtcccgaaacgcaaaaggtgaattttttcattttagatcagccgtttatctccgacactttaaggaaatcatgtgagtatataaattcctctgatgaaatgagaggcaatgtcatttttttgaattatgaatggcctcaatggttaagaccgcaaagattttcttcaaggagaagggatgtctctagatttctgttcttggatgtccttttacctcaaaacatctccaaagtgttatatatgagtccaactgaagtaccgctggatccttttgacatttttcaatttcaaggcctcaaacgtgcacctctaggactattccgaatgagtggtgatggttattggaaagaaggatactgggaaaaaatgttaagggagaataatttagaattttattctaccgaaccggcctttttagtaaacttagagaggtttcgggagttagatgctggtgataaatacaggattcactatcaacgtatttctacagacgccatgtctcttgtcaatatcggccaagatctagttaacaacctacaactcgaggttccgattaggtttctcaagggatcgtataagaagaaattagttattaatgatgaatgtgtttctgaatggaagaaaaaaataaataagttcgcatcctctcctggcgatgaagacgtacctggagaaagtgttagcagcaaataccaagattccgacaatgccgctcctctgcatgacgaattataactactcgcaggaagagttcattacgcgacggttccaagagcgtgaaagaattgcttctgcgcataagtcttcttccataatagatttttatatcatttttagaacataaaatttctcgccaagagttttttaagtaaaagcagattatccagtaacatgggttccgctttttgagcgaatactatgaacgagttttgcccgtgctccccatgactcattagattctttgatgacaaaagatcactggcagaagtctgtttcgcttcttttcttttttttttttttttttttttttttcgagcagattgcaatcagcgatgagacaaaaatggaaagtaggtatgggctgacgattgcctaaacggttatcaattggttactataaacgcctctattatatgaatatacctatttattgaatcccttcattaatatttaagaagacagaggctatatatcatctggatcaaaaaatgacagcgccattgtggccaaacaagaatgaaaaaaaccacacagttaaaagagcgttatcaacggatatgaccagcaatattttgagtagcacaaacgcgagctcaaacgaagaaaattctaggagttcttctgcagccaatgtacgctccggaacaggtgcaaatacacttactaatggcggcagtactagaaagagacttgcgtgcactaattgtagaaatagaaggaaaaaatgtgatttaggatttccctgtggtaactgttccaggttggaattggtttgtaatgttaatgacgaggacttaagaaagaagcggtacactaataaatatgtcaagtctttggagagccatattgctcaactggagaccaacttaaaaaacctagttcagaagatctaccctgacgatgagcaaatactgaaccgaatgatggtaggtgatgtattatcagctctaccagacagttcacaagtctcaatcaattatactgaccaaactccctctcttccaattcccgcaaccagaggtacattcattattgaaaacgataaggtcagtcaacctctatcgtcctttaaccaacaaacagagccatctactctaaactcgggtatcttcaacacccaaaaacaaaatttcgaagaatcccttgatgatcagttacttttacgaagatcgttaacaccgcaaggtgaaaaaaagaagaaaccgttggtaaaaggtagtctttatcctgaaggacctgtcagttacaaacggaagcaccccgtaaaatcggacagtttattgcctgtgtcttcgttaacagctgctacagacccatctactttttctgacggtataactgctggtaattccgtcctagttaatggtgaactgaaaaaacgtatatccgacttgaagaccaccgtaatagtaagaggactaaacgatgataatcccaactctatcaataacgatcccaggattttaaaatctctttccaatttctataagtggctgtatccaggttattttatttttgttcacagagaaagttttctttatggattcttcaatcactccaagaataactatgaagactcaagttactgttctgtcgaattgatatatgccatgtgcgctgtcggttcgaggcttacaccggatctacaagaatattcagaagtgtattatcaacgaagtaagaagactttattacagctcgtctttgatgagcaaagtacagcccgtatcaccaccgtccaagcgctattttgcttagccttttacgaactggggaagggtaataatcaattagggtggtacttctcgggcctggctatcagggtcggctacgacatgggatttcaactggaccctaaagtctggtacgttgatgataacaatctgcagctgacccaaagtgagttggaaataagatcaaggatttactggggttgctatatagcggatcattttatttgcctgatgttgggtagaacgtccacattaagcgttagtaactcaaccatgccagagtcggatgagctgccagaagtcaacggcaccgaagagttcagatttattggaagacatgttttacagatatccttgcctctgaaaaacttgataattctatcaaggcttgtacaaatcttcacctctaaaattttcatcgagtcggaagatatagcacgaaaactaaagtacttgaacactttcaattctcaggtttacaactggagacaatctctaccggaatttttgcaatggtcgaaaacactcatcgagaacgatgacgtatccacagaccccactatatcttacttctggtattgctactacatagtgcggctcacctttaacaagccatttatagaagactctcaagaatccgaaacggtagtcatagagatcatcgatgatttgaagactttgctggacaatttcgggaaaaaattcggaaactacacgaagggaaacctttaccaactttactcatgcctgttggccatcaactgtttgaagaagttgaaagagatacgttccagtgagcaagactcatggaatgcacaattggattttttcaatcacatcttctacacacaactatatcccgcatatgatctgccgaaaaagctgcaggaggatacggagctggaaacagaacaagaaaaccagatgttgaaccaagttggaaatataaactacacgcacgatttttcactctcccacgaaattgacgatcttatcagagaactgtttggggtgggcacacctcaaaaactctgacgatctttatatttgtcaccttttccgtatcggcggctaaaaggcgatgcggtgcacaggcgcggggtccctgggaaaaagaaatgttcaaattaacatttctttttcttgttttgtggctcttctagaaggatttttaatcagcatagcctgcgttaaaattttttaccggatcttatatatctaagacatctactctgtttaaatacttaacgaacatcatagagaatcaactaataatatagattagaaaagagaatttttttcgactgcgatgctagataacatgcaatttcattctccagcaccggaacatcctcaattgaatgggggtattaacaaaattcccgcttcccacaaaataggttacaaattaaaccagcaagtgcagagattggctgtggtcaggaataatattgaagagagattgaactcgatggaatcctcacacggacagatatccgatagtagcgttgtccgtgctatcgatgcaagtatcgatgacttcctaataccttcacctccattatcgccaaagctgaggcaatgccccataataagccagcctcagctggttaatgtggaaagcgaccatagggagctgatcatgttgacccccgtttgggaagcgggcttgaactctcagaagtacaaccataatacaaggaatttcttatcgcaatatagcttcttccgagatatgaaaacaacgaaaaggattcctaacaaagaaaataggaaattgaaagtggtaaaatctgttgtgaactcagaagctctgcccaagagaagaagatacgataggaaaattaagagaagatcaagggagttgtacgaagatgatggaaacaggtcagaaaactatgatgaagaaagtgctcaagaagttccagttagatcagtgactccgatacgtcaagttaaaaggtctcttcatactatttcttcgccattggcctcacagggcgtagtgaataatgtccccaagtatattccaagcatgtcgtgggaaaagttgccggattactcacctcctcttcacactttgccgaatagtaataataaagttttaaaagtggaatggaaaggctctccaatggacttgaatcatgatcctctcaaacagcgtctgcatcctgcagaactagttctcgcacagattctgagacttccatgtgatctttatttggactctaaaagaagatttttcttggaaaaagttcatagattcaaaaaggggttgccgttcaggagaacggatgctcaaaaggcttgtagaatagacgttaataaagcatcaaggctatttgcagcatttgaaaaggtaggttggttacaagataaacattttgaaaagtatttgtaagaaagaggcggtacgcctttgggatagcgtatcgtttcatcgtttaaacgagcaaatttgataagtacggaatatgacagtctcattgagtaatacagaattgaggcgtttaaatggttatggttaagggttacggttacggttttttattcttagaacacatttgatatatttttatttatggttttttacatatagatttcgttcatatatgaggttttctttttatattaattatatttcttcggttgttacgttatcaattttgttattgaattattacgggttatgaacgccgtagaaaaatagcattggagtttgagagtctgtggcttttctgtcacatcattttttcgtctaacttaggttaactcagtaatcgtcgatttcttcataacaggccaggaccttttttctgtattcctccatatctgcatcccaaagttctgctgccacagcgttcagcggagatctgttatttggttcgccaagtaatgactgcaatgacaatagaattgtttctacattatacactgcagaccatttctctttcagaatgtccaaacaaatgttgccactcttatccacgtttggatgccacattggactcaaaaatttaatcattggcggatggaaaggatagttttgaggaaacttcaatgaaaccttgaatttaagtccactatacggtgtgtctttagggcctgtaatataccctacccagtatgttaaatcattatcgtctacgggaaacgcactaatactttctgttgtagaactaagtagctgtagcagctcattttgtaaacgtttcgtcacgcaaccaccctcttctactgccattctatactagcaagcctcgaatcatacaggttttgtagcacctataagatgtaaaatatgaaaaattttttctgatatctcatttatccagtgtcagaagcatgttttgtgtcgctattagtcaacgctttttccttgaaaatctctttctaataatgacatcattaaaaagagtccattaacgttataaaggaaaaatatttcaaattaagcttcattactgttgatatattgtcgaatttgccacggtttagctacgtatgcaggactattgattatcagcactgtaataatgtacaattatttatattatcctatatcaataacgtatatctttatttgttttgattttttctcatttttcccgtcctaatcactatcactcgattcaccatcattgctttcactggtgttttcctcgtatacgatctctgaaccattatcttcttttacttcaggtaagtctagttccttgtggctctctttgttttcgattgaaacttcgtcatcaaatacaatttttttgtttgaaactataggtaaactttcagcttgggaacgagagctgttatagccattgccttcttcgtcggcgtcacttattaatgtaccgtccacagaaacaactcttcctgtagtatgaacatttctcactgtgaacctcaatttaccgtcaatgggttcaccattagaatctacccagtggcccaaagatctgtttccaaaggaaaatttgcccaaactattgcttccaccattgctatccttgttatcttcgttattattgtttccattattttcatctgtgtttatcacgtcagcatcttcttccacgtcgttatggacaaaggtccaatccacagggatattattctttttgatactagcattaaacgcatcatgaatcaaaagaccaatgtgtgaggcggattgaatgaaaatgtaaccttccaaaacatctccaacttgtggctgccaaacgtataggtttacatggcaccaagtaaatccaaaaggggtatcgggtgtgatttttattagtttttctgatgtatcttctttgcttaaaggatcagcatcaagaattttcaacccttcataacctagcacaacacctccaactttgttgttatatttcattactaatgggttcaagtgctgcttcatgacaccttgcaagggattttctaaatacattggtgccaaagaaacatagagagcaatgggaacacgcactatacagttggaagttccatttttctcatcaattgggtttgtaacctgttttttgtgtttcttgatgaaccttgcggtttcgcggttctcattggctctttttacttgtgacataatccacgtttgtctcttatctttctgatattattatatataagcaaaaaaacgagggagtgtataacgatagtcccttcggctctattttattgtaaacctccactacattgtcatatttgcgatgccattagtattttattgcagaaaaatttttttcaaaccacccatacaccctcatcggaatcttttcatttcaaagcgacagtaatattttctgtcaagaatacacaaaggatacacttgcagctggaataagcaagattccaccaagtttcttctacctgaaatacatctattacggggccttgattaaaagtaacttaacttcgcagttaaatttaactttacaagaacggcatatgatcagatcgtatccttgcccgctatcggagggtctcagaattacatcttatactgtttcgagtttcttatgtctcctcttatagctaaaatgatttgaacttagaaattatcgaggatagaagtaaggcgttgcatttccttataactatcgtgtttattttcttagtggtggttcttttattattacccgttttcttcggtaatattttatagtgaaaaattttggtaaaaaaaaaaaaaaagaaaaaattttttttatttcaaatctcatctcatctcttaaaaaggtttattctgtttactcaaactcttcatcaaaaacaaaagtactgcgctaataattctggtcttaggtatccattaactatacagtgaactttatcctttttctgctttttttttgccgtacttcgattataatcaaagccagaaagaaaaatggatatttctaaaccggttggttctgaaatcacatccgttgatttcgggatcctaacagctaaagagattagaaatctatcagcaaagcaaattaccaatcctacggttttagataacttaggtcatccagtatcaggcggtttatatgacttagccttaggtgcattcttaaggaatctgtgttctacttgtggtttggatgaaaaattctgtccaggtcaccaaggtcacattgaattacctgtcccttgttataatccattgttctttaaccagctatatatttatttgagggcatcatgtttattctgtcatcatttccgtttaaagtcagtagaggttcatcgttacgcatgtaaattgagattgttacaatacggtttgatagacgaatcttacaaactagatgaaataactttgggctctcttaatagcagtatgtacactgacgacgaagctattgaagataatgaggatgaaatggatggtgaaggaagcaagcaatcaaaggatatttcctccactctcttaaatgaactgaaaagtaagcgttcagaatatgttgacatggccatcgctaaagctttgtcagacggcagaactactgagagaggctctttcacagctactgtaaatgatgaacgaaagaaattggtccatgagtttcacaaaaaactattatctagaggtaagtgtgataactgtggtatgttttcgccaaaatttagaaaggatggttttacaaaaatcttcgaaactgcgttgaatgaaaaacaaattacaaataacagagtaaaaggtttcattcgtcaagatatgattaagaagcaaaaacaggctaagaaattggacggttctaacgaagcatctgcaaatgacgaagaaagttttgacgttggtagaaatcctaccaccagaccaaaaaccggctcaacatatattttatctactgaagtgaagaatattctggacactgttttcaggaaggagcaatgtgttttacaatatgtttttcattcgagacccaatttatcaagaaaattggtcaaggctgactctttttttatggatgttcttgttgtgccaccaactagattccgtttgccttccaagcttggtgaagaagttcatgaaaactctcaaaaccaattgttgtccaaggttcttactacgtcattattaattagggacttaaatgatgatttatctaagctacaaaaggacaaagtttctttggaagatagaagggtgatcttcagtaggttaatgaatgcctttgttactattcaaaatgacgtcaatgcttttatcgactctaccaaagcacaaggtagaaccagtggtaaggttccaattcctggtgttaaacaagcactggaaaagaaagaaggtttattcagaaaacatatgatgggtaagcgtgttaactatgccgctcgttctgttatttctccagacccaaatatcgaaactaatgaaattggtgtcccacctgtttttgctgttaaattgacttatccagaaccagtaacggcttataacatagcagagttgcgtcaagctgttattaatggccctgataaatggccaggtgccactcaaatacagaacgaagatggttctttggtctctttgatcggtatgtctgtagagcaacgtaaggcattagctaaccaactattgacaccatcttcaaacgtttctactcatactttgaataaaaaggtttaccgtcacatcaagaacagagatgttgttttaatgaaccgtcaaccgaccttacataaagcctccatgatgggtcacaaagttagggtgttaccaaacgaaaagactttgagattacattatgctaatacaggtgcttataatgcagatttcgatggtgatgaaatgaacatgcattttccacaaaacgaaaatgctagagcagaagcactaaacttagctaatactgattctcaatacttgacaccaacttctggttctccagttagaggtttgattcaagatcatatttctgcgggtgtttggctaacaagtaaggacagttttttcaccagagaacaataccagcaatatatttacggttgcatccgtcctgaggatggtcataccacaagatcgaagatcgttaccttacctccaactatcttcaagccatatccattatggacaggtaaacaaatcatcacaacagttttgttgaatgtcacccctccagatatgcctggtatcaatttaatttctaaaaataagattaaaaacgaatattggggcaagggatctctggaaaacgaagttctcttcaaagacggcgcattgctatgtggtattttagataagtcacaatacggtgcctctaagtatggtattgttcattcattgcatgaagtttatggcccagaagtcgctgctaaagtcttatccgtcttaggtagactatttaccaactatatcactgccacggcattcacttgtggtatggacgatttacgtctaacagcagaaggtaataaatggaggactgacatcttgaagacgtctgttgatacaggtcgtgaagccgctgcagaagttactaatttagataaagacacgccagcagatgacccagagttattaaagaggctacaagaaatactgcgtgataataataagtcaggtattcttgacgctgttacatcctccaaggtcaatgctattacttctcaagtcgtctccaaatgtgttccagatggtactatgaaaaagtttccatgcaattctatgcaagctatggcactttctggtgctaaaggttctaacgttaatgtttctcaaattatgtgtttgttgggtcaacaagctttagaaggtagaagagtgccggtaatggttagtggtaaaactctgccttctttcaaaccttatgaaacagatgccatggctggtggttatgttaagggtcgtttctactctggtataaagccacaggagtattacttccattgtatggctggtcgtgaaggtttaattgatacggccgttaaaacatctagatccggttatttgcaacgttgtctaacaaaacaattagaaggtgttcacgtatcatacgataacagtataagagatgcagatggtacgttagtgcaattcatgtatggtggtgatgccatcgatataaccaaagaatcacacatgactcaattcgagttctgtttagacaattactacgcattattgaagaaatacaacccatcagcactgattgaacatttggatgttgaatcagctttgaagtactctaaaaagactttgaaatacagaaagaagcatagcaaggagcctcattacaaacagtctgtaaaatatgatcctgttttagctaagtataatcctgccaaatacctgggttccgtttctgagaacttccaagataaactagaatctttcttagacaagaactctaaattgttcaaatcatcggatggtgttaacgaaaagaagttcagggccttgatgcaattgaagtatatgcgttctctaattaatccaggtgaagctgttggtattattgcttcacaatctgtcggtgaaccctcaacacagatgacattgaataccttccactttgctggtcacggtgccgctaatgtgacactaggtattcctcgtttaagagaaattgttatgactgcctctgctgccattaaaactccgcaaatgactttgcctatctggaatgatgtttctgatgagcaagctgacactttctgtaagtctatctcaaaagtcctattatccgaagtgatagataaagtgatagtcactgaaactaccggtacttcaaataccgctggtggaaatgcagctcgttcgtatgttatccatatgagattcttcgacaataatgaatacagtgaagaatacgatgtttctaaagaagaattacaaaacgtcatatctaatcaattcatacacttgctagaagctgctattgtaaaagaaatcaaaaaacaaaagagaactacaggaccagacattggtgttgcagtaccaaggctacagacagatgttgcaaatagttcttcgaactctaaaaggttggaagaggataatgatgaagaacaaagtcataagaaaactaaacaagcggtttcgtatgacgagccagatgaagatgaaattgaaactatgagagaagctgaaaagtcttctgacgaagaaggtatcgattccgataaagaaagtgattctgactctgaggacgaagacgttgacatgaatgaacaaattaataagagtattgtggaagctaacaataatatgaacaaagtgcagcgtgatcgtcaatcagcgattatttctcatcatagattcatcaccaaatacaatttcgatgatgaatctggtaaatggtgtgaatttaagctagaattagcagcagacacagaaaagttgttgatggttaatattgttgaagaaatctgtaggaagtctatcattagacagattcctcatattgaccgttgtgttcatccagaacctgaaaacggaaaacgtgtccttgtcacagaaggtgttaatttccaagctatgtgggatcaagaggcatttatcgacgttgatggtattacatctaatgatgttgctgctgtgttgaaaacgtacggtgtagaagctgctagaaatactattgtgaatgaaattaataacgtcttctctcgttatgctatttctgtttctttccgtcatttagaccttattgctgacatgatgaccaggcaaggtacttacttagcctttaacagacagggtatggaaacatccacttcatctttcatgaagatgtcctatgaaactacatgtcaattcttgaccaaggctgttctagataatgagcgtgaacaattggacagtccttccgctagaattgtggtgggtaaattgaacaatgttggtacgggttcatttgatgtgttagcaaaggttccaaatgcggcttagaagcaggcaaaaggtcccataattattacgatttaatattagtttatttgaaggagaaggtcagaagaaaagagagaaaaatgcacaatgggtagcgccattaaaaaatacctcttttggtatttgtctggtttcctatttcttcttgcgcgtgtgttatgtaaattaagagagctagggtattataaagtgcatcatcatcaagcggatatgtaacgcatatacattatatatgtgtagtgagttctttataccctacaaatttgatattgtgtttatttatatattggcattttttctcgattacgtgctggtatatgtatacctcatctgtacatcctagactagacgcatttttttttccaggtacaaaggctatatttgaaggaacggccaatcactgcaagagatagctgaaatgttatttcaaaaaaggcatgtatttaccatgcaaatttggtattgatagagcaggaaatgtgcttacaatgtaataaggtagtttgtcattattatggtacataattatggagcctgtcaatgcttatgcatttatttatgtatacaaatatatacatttataaattttcttttttctttttttcgaaattgttcttagtgtcatttgaatagtgttgtagttcgttaggtatggacattgatttggccttcttcttcgtgaaactaatcgcagcgagcccttttaggtctctctgttgagcagaaggggttttgtctctgttgtggtagctttgatcgcatgatattctggtcgtcacgtcttctttgttttctttccactttcgatattggggacgcaaaggacgtaagtttgcgacccttttgcgaacctaggccccaatacatttcatttttcttgattaattcttgatagttgataaatcctgtgacccataagattttttcatctcttaccgtatcaggaattactgcaatagacttaacgaattggagggcctggtaaacgttgaaagttgggttttctttcaatacggtagacatcagtaaacttatcaaattttcatcggtgctgccgttttctgagagaacaagtatgttactattggtattcccgccttgagcgatagagtatttgaaaattgtaattaggtcgttgaagacttgaaacttcgcttcgttggtaacttggaaaatatttgtacgcgagtattctgacttattaccatataaaagtttatctaatatcgatactgagtcacttggatggtcgaattgaacatacgcatttctgtaatgagattctggtggtggagttaatggttcgccgtgattattaataccgctgagaaaatcgagatgatggatcaattgttgcaaaagggaagtgttgtgccaatggaaggaacgcaccaaatcgctttctattggtatttgagagtcattgtcgatgttgacaattactatttcatgggcaaactttgagcggacctcatgatagatatgtgatattagttcagtcgataaatcaacgtttatgaaaaacctaatgttattttctactaggaaatctgtatgcgtcagtgaatgtacggagccgaaaaatatgtgattatctagcctctgaggaatgcttgaatcattaagctcctctagaatagtcattttttcttttctatcgaaaaatgcaggaaacaagcttgtatttagcgatgctgtattaatgtaaattggctaatagggacgccactaccatagatgagcaatagattcgtaatatcaacctcaagaaaactcattaggagcaagaaatgaaaagtaaaaaaatggttgaaagtaaaatccatgcaatgagataaggaagagaaaactaatgaaaaaaatttttcaattaaggcatggaaggatcttgaaatgaagtgaaaggaaaaatggaaaaacatgaaaaactacacaagcaaagaccagcattatggatgaaatttttttttttttttcacgtcagaagttaaggccatctttgagttccagggtatcgcatctcaggtcttcccacttatgctacgcattcatgaaaatttttcaactttttcttttgaccgtggtgaaagaagatgcgcgtttatggggagaaaacccgtagaaaacgcgaaaagccgctgaaaatacaaagggaaaaagccgctctcatttcttatttaggaaaagaaatgagcggggtaaacggagatcgctgcggacggaaggcgcgaaatacccactgccctgaagtccagcaggtactgaggcttggatctcaaaagcgtggggtgcgtgggcgtgcgctgctcgaggcattttagccgctgatagtgctggctccaggggccactgcgcttgccatacccgcacacggggttctttgaggcacttaattgaccggagatttaaacgatattgtcgtcggggattagaagacattactggtggggaacccttgatgataataggaaatatatgcgcagtatgctccatcgctacgagatgttagcagcctcagagcatcctaatgggaatatcaatgcatacacaccggagcttggatatgataaacgaaatattcttgaatcgtgagatcgcctgttttcaaaaccgttggaggcagaaacaattttgtcacaagatgggcattctaccccatccttgctgtattattgtagtctcgctttcttttatgctggacaaatgagactactgcacatttttatacgttcttggttttttttaaaggtgtggtttcggcattatcctgccgcacgtttcttggataattcatcctgattctctattttaaacgcttcagcctatcaggatttggttttgatacatactgcaagagtgtatctcgggaacagtcatttattccgcaacaaacttaattgcggaacgcgttaggcgatttctagcatatatcaaataccgttcgcgatttcttctgggttcgtctcttttcttttaaatacttattaacgtactcaaacaactacacttcgttgtatctcagaatgagatccctcagtatgacaatacatcattctaaacgttcgtaaaacacatatgaaacaactttataacaaagcgaacaaaatgggcaacatgagatgaaactccgcgtcccttagctgaactacccaaacgtacgaatgcctgaacaattagtttagatccgagattccgcgcttccatcatttagtataatccatattttatataatatataggataagtaacagcccgcgaatcaagctggtaatccgttttgacagctggttgcttccccaagactgcttatattaggattgttgaaaatattgattaacttttgttaattcctacatactcggggaaaggttctagtatattctgtatacctaatcttacagtctttactaatggaatcccaggaattatcaaaaaattcacctatctttcaaaatattactattcactctgctaagattatcggaatagggaccaactatcatccgctaattactgacattaccaaatgagatctgtgaatgggcaagataaaaaacaaaaattgaaatgtttgacgttatgtaaaactattaattccttcgctttcggcggtcacagaatttgcgtgtagctgactcttgttcaatcaatatcatttgttactttatttgaaagtctgtattactgcgcctattgtcatccgtaccaaagaacgtcaaaaagaaacaagataatttttgtgcttacaccatttatagatcactgagcccagaatatcgctggagctcagtgtaagtggcatgaacacaactctgactgatcgcacatattgccgttatcataaatactagttgtacttgtcaatgcgacgaatggcatcatgcctattattacgttcctctttttccgtttcatgtttccagaatgctattgaatctaacacttcaattataaaaaagaataaatccgcaataattttaggctaattgttgtactgtcaagcgaacctaatggttaaaattcagaggaaccttcgacgtagtctgatcgctacttctatatcttatgttcccagtcaatcaaaagttgatactataatagctgccatttatacctgttagttatggcgatcgtttatcacgacaagcccaattttggtcgagatgcagccagttgccatctattgtttccaaagcattcgtttgattcgtatatgataggaaaacaaattaaacgatgtatcaatttgctcattcatcataaattgtgtttgaggcattactaaaagagcagcagatatcagtctgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaacgatgataataatatttatagaattgtgtagaattgcagattcccttttatggattcctaaatcctcgaggagaacttctagtatatctacatacctaatattatagccttaatcacaatggaatcccaacaattacatcaaaatccacattgtccacatggtagcgcctatgcttcggttacttctaaggaagtcccatcaaatcaagatccgttagccgtttcagcttccaatttaccggaatttgatagagattccactaaggttaattctcaagaagagacaacacctgggacatcagctgttccagagaaccatcatcatgtctctcctcaacctgcttcagtaccacctccacagaatggacagtaccaacagcacggcatgatgaccccaaacaaagctatggcttctaactgggcacattaccaacaaccatctatgatgacgtgttcacattatcaaacgtcacctgcgtattatcaaccggacccacactatccgctgccacagtatatcccaccgctgagtacttcctcacctgatccaatcgattcacaggatcaacactctgaagtacctcaagctaagacaaaggtgagaaataatgtcttaccaccacacccacacacatcagaagaaaacttttctacatgggttaaattttacatcagatttttgaagaactctaatctcggtgacattattccaaatgaccagggtgaaatcaaaagacaaatgacttatgaagaacatgcgtatatatacaataccttccaagcatttgccccatttcatttattgccaacatgggtaaaacaaattttagaaattaattattctgacatccttacagtcctttgtaaaagtgtgtccaaaatgcaaactaacaatcaagaattaaaagattggatagctcttgccaaccttgagtacaacggaagtacatctgctgatacatttgaaattacagtcagcacgatcattcaaaggctaaaagaaaacaatatcaatgttagcgacagattggcctgtcaactaatacttaaaggtctatccggtgatttcaaatacctacgtaatcaatatcgtaccaaaacgaacatgaaactttcccaattattcgctgaaattcaattaatatatgacgaaaataaaatcatgaatctaaataaaccgtcccaatacaaacaacacagcgaatacaaaaatgtttctcgcacatctccaaacacgactaacacgaaggttacaactcgtaattatcatagaacaaatagttcaaaaccaagagcagcaaaagctcacaatattgctacatccagtaaattctcaagggtgaacaatgatcacattaatgaatcaaccgtttcatcacaatacttaagcgatgacaacgaacttagtcttaggccagcaacagaaagaatctaagccaacacgcacaatagactcgaatgacgaactacctgatcaccttcttattgattcaggagcttcgcaaacgcttgtcagatcagcccattatttacaccatgcaacacccaattctgaaataaacatagtcgatgctcaaaaacaagacattcctataaatgccattggtaatcttcacttcaactttcagaacggcaccaaaacatcaataaaagcactacacacaccaaacatagcctatgatctattaagtttgagtgagctgactaaccaaaatattactgcctgctttaccagaaacactttagaaagatcggatggtacagtactagctcccatagtcaaacatggagacttttactggttatctaaaaaatacctaattccttcgcacatttcaaagctaacaataaacaacgtcaacaaaagcaaaagcgtaaataaatatccatatccgttaatacatcgaatgcttggacatgctaacttccgaagtattcagaagtctcttaagaagaatgcagttacatatttgaaagaatcggatattgaatggtctaacgctagcacatatcaatgtcctgactgtctaatcggcaaaagcacgaaacataggcatgtcaaaggatcacgactaaagtaccaagaatcatatgagccttttcagtacttgcataccgatatatttggtcctgtacatcacttaccgaaaagtgcaccttcttactttatatcgtttacagatgagaaaaccagattccaatgggtgtacccattacacgaccgtcgtgaagaatctatcctcaatgtttttacatcgatattagcatttattaagaaccaattcaatgctcgcgttctagttatccagatggatcgtggctccgagtacactaacaaaactcttcataagttctttacgaacagaggtattactgcatgctatacaaccacggcagattctagagcacacggtgtcgctgaacgattaaatcgtactttattaaacgattgtcgcacactgcttcattgcagtggtctaccaaatcatctatggttctcagcagtcgaattttctactataatcagaaattcattagtctcaccaaaaaacgataaatctgcaagacaacatgcaggtttagctggactggacattactactatactacctttcggtcaaccggttatagttaacaaccataatcctgactcgaaaatacatcctcgtggcattccaggttacgccttacatccatcacgaaactcttatggctatattatctatcttccatccttaaaaaagacagtagatactaccaattacgttatattacaaaacaatcaaacgaaattggaccagttcgactacgatacactcacttttgatgatgatctcaatcgtttaacagcccataaccaatcttttattgaacaaaatgaaacggagcagtcatatgatcaaaatacagaatctgatcatgactatcaatcggagattgaaataaactctgatcctctagtgaacgatttctcgtcccaatcattgaaccctttacaattagacaaggaaccagtccaaaaggtacgtgcaccaaaagaagttgatgccgacatatctgaatacaatattcttccatctactatacgatctcgtacaccccatatcattaataaagagagtaccgaaatgggtggtaccattgaatcagatactacttcacctagacactcgtctaccttcactgcacgaaaccaaaagcgacctggtagtcccaacgatatgattgatttgacctcacaggatagagttaattatggacttgaaaacatcaaaactacacgtttgggtggtacggaggaaccatatattcaacgaaatagtgatacaaatatcaaatacaggactacaaacagtacgccctcaatagatgaccgttcgtccaacagtgactccactactcccatcatctccatagaaacaaaggctgcatgtgataatacaccctccattgatacggatccgccagaatatcgctcttctgaccatgcgactcctaatataatgcctgacaaatcctcaaaaaatgttacggctgattctattcttgacgacctcccacttcctgacttaacccataaatctcctacggacacttctgatgtttcaaaagatatcccacacatacactctcgtcagactaattccagtttgggtggtatggatgattctaatgttctgactactaccaaaagtaagaaaagatcattagaagataatgaaactgaaattgaggtatcccgagacacatggaataataagaatatgagaagtctggaaccaccaagatcgaagaaacgcataaatttaattgcagcaataaaaggagtgaaatcgatcaaaccagttcgaacgaccttaagatatgatgaagcaattacatataataaagacaacaaagaaaaagacagatatgttgaagcttatcataaagaaattagccaactattgaaaatgaacacttgggatacaaacaaatattatgatagaaatgacatagatcctaaaaaagtaataaactcaatgtttatatttaacaagaaacgtgatggtacacacaaagctagatttgttgcaagaggcgacattcaacaccccgatacatatgattctgatatgcaatccaataccgtacatcactatgcactgatgacgtcattgtcaatcgcattagacaatgactattatatcacacagctggacatatcctctgcttacttatatgctgatatcaaagaagaattatacataagacctccaccacatttaggtttgaatgataagttactacgtttgagaaaatcactctatggtttgaaacaaagtggtgcaaactggtatgaaaccattaaatcatatttaataaattgttgcgacatgcaagaagttcgcggatggtcatgcgtatttaagaatagtcaagtaacaatttgcttattcgttgatgatatgatattattcagcaaagacttaaatgcaaataagaaaatcataacaacactcaagaaacaatacgatacaaagataataaatctgggtgaaggtgataacgaaattcagtacgacatacttggattagagatcaaatatcaaagaagcaagtacatgaaattaggtatggaaaaatccttgacagaaaaattacccaaactaaacgtacctttgaacccaaaaggaaagaaacttagagctccaggtcaaccaggtcattatatagaccaggatgaactagaaatagatgaagatgaatacaaagagaaagtgcatgaaatgcaaaagttgattggtctagcttcatatgttggatataaatttagatttgacttactatactacatcaacacacttgctcaacatatactattcccctctaggcaagttttagacatgacatatgagttaatacaattcatgtgggacactagagataaacaattaatatggcacaaaaacaaacctaccaagccagataataaactagtcgcaataagcgatgcttcatatggtaaccaaccatattacaagtcacaaattggtaacattttcctactcaacggaaaagtgattggaggaaagtcgacaaaggcttcgttaacatgcacttcaactacagaagcagaaatacacgcagtcagtgaagctataccgctattgaataacctcagtcaccttgtgcaagaacttaacaagaaaccaattattaaaggcttacttactgatagtagatcaacgatcagtataattaagtctacaaatgaagagaaatttagaaacagattttttggcacaaaggcaatgagacttagagatgaagtatcaggtaataatttatacgtatactacatcgagaccaagaagaacattgctgatgtgatgacaaaacctcttccgataaaaacatttaaactattaacaaacaaatggattcattagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaacgatgataataatatttatagaattgtgtagaattgcagattcccttttatggattcctaaatcctcgaggagaacttctagtatatctacatacctaatattatagccttaatcacaatggaatcccaacaattacatcaaaatccacattctccacacagtcatactcgtaagaattggttgaatttgagataattgttgggattccattgctgatagctttaatattatgtataaggaatatactagaaattccgaaaactgcttatatcaagacttcaaggaatctggtattactcgagcccgtaatacaacacgtttgatattttgtgcgcttcagtagctcagtaggaagagcgtcagtctcataatctgaaggtcgagagttcgaacctcccctggagcaatatttttttgctaatatgacagcccaatatctcgcttcgaacaaattgtcgtcaatcagaggggggaatacaaaaagcccaaaaaacttctttaagaatataatgctgtaaatatatgtttcgtacttagtttagttatggcgtgacataataacgggttgtgaatgtaatgaatagaaaaggccgtaataagataataaaataaaataaatgagaaaagtttgagaagagttcgttcgtataaatcattaaggtgtatgtgtttgttgaaataaaaaaaattgatttttttttattttttcggttttggcatacatatccgtccgtagctgaaacggaatttcgtcatgtcttgtgctttcttggctatgaaccacgcgtcattaatgtgtataaaggaggaataaaattagaattttttttgaataatacgaaatagaaaagaaaaaggtatgaaaagtgcgcatcacgatttatcatccttctttagtggggattttttttttttatctttttgtatgttttttccaacttcttttttttttttgtattcttgtctgctatgttatggccttgttattttttgggcttgttttttaaagtacttcgctaagaaagaaaaaaatgtcgcataaacaaaagaggagaaaggaatttctatcgtaattttataatattggtgtttaagcaagcgtgcttttatttttggtcttgtttcaaagtgtcgatttcacttttcaacctttgaacttccatttcgtatagtcgttcgttattttgtagatatagaatatagtcaacagctttttctaggatcatgcttttatttagcttcgtgcttgtagcagcggcagatggaagaggagtagtagcggcagtttctgcgccgtcttcgtcctgtttttttacagaatcacctacttcgaaagctgtttgttcacttgctacccatgggataatctgctgcagtcttgcaatctttgtgttgatgtttattctgtagcgtttttcaatcttgttgtgagcttgcttttggaagggggtcagtctttttcttggagccctctttttcgtttccttagcatctagatttgtttttataaacgagtcgtttagctcgatttcattcttaagtggggtactatcgtcattattatcagtatttatcatgttaggcattaattgcaaagaagccggttcaaaatctgccaacgaaagggcattgtcatcctcttctctttttatcgagctgctaacctcgggagaatgcgagtatgaggaaggattactgaaaaactgatctgttggaaaaagagcagattcctcgttgttggaagatataaactggtcttcgattggagagcctatcgaggagctggatgcagaggagataatgttttccaatggttcgaaccatgtggaagaagatgcagaaagaactgacgaggagtccttgttgacgttgatatgactagctccgtcattttcatccgacaaccaattatcaaattcagattcaggtttaattaaagtagtttcgctagatctaacatttctgtctaaaatagagttcataattgttaaacttgaagagatttgatagtgtgttatttgtctttatttttatttttgcactaaaagtttatgaagtgaacaaaaaaaaaaaataatagtaaagtagagagactttagatcggtactgcttgtggtgctttacgcttaataagaaagaaaatgagaaaagagagaaatatgtaaagaataaaggttgatggttgggaaatataaaataaggatgtaattaagatagctttactttcccatgaattgatatatgaagtgaaaaaggatgtaaataagtttaaattttggagataacaaaagaagtttatataagtacatttgattgttgaggtgagaaaaaaaaaggaaacagaggtgaaaaaaattaatagcaaacgttgcgttttgcatttctactaagaatggaaatgtcgcagacacggtatcatctacactgtgaaaaagaaatgaaaatgagaattgttatttggcgaactgtgaacgtgcgcagggcagaatcccattgtacggttcgtacgtgggcacaatgaattactactagggtaagaaatgaccgcagcagcatgaacattctagaacaaaatttgattccttaccgaatggagagaggccacgttgttaggggagtaacagcgcaatgaagtgagctcaatcccactccagaagggcttgtgtacggccggaactgggctaagcagtatccgcgggtgaaagtcaaggtcagcttgttccggtttcaaaaggaagattttccgggatacctctgggtgtaacattcagatgcgtgcgtcatttattctctacccatgtggtgcctgccagatccggtaagtaccgcccagcatagcgtatacacaaggatgaatgggttctacgacaccgcggtttaaggaagttgccgcatttggcatggtgtggtgatgtctcttttcctaaaccagactgagacaggtttatttcaccgatttttttttgctttggcataatagaatgtccaagaagggtattttactatcttacacgtgtttgtaacataaacgacaattttgtagcacaactagggcatgtcagtctgagtcgtattagcgccctcccccttacttcaacagtatcgtaggattggcattgcatatacgccgattttagcgttgttaattgatcattgctggcttgccacgtgatggcaataggctttctctcgtgctcgacccctaatgtcagttcaagcagggaacgtgccaaacatggctagtgcattttttacgtaagccgcaaagaggttcctcttttcttagtgtttcgccctactgataagaatgtgaaaaagtaaacgataagattaatataattaaaaaatgtttcaattctagacatcgtacccacaaaggctgcccatatcatatcgtaatacagatccgcttttcagattacatccgattttcagactgaaaagcagcatagcggcagtatgatgaatacaagcgcgcttatctgtcgctcttcttacttggaaagggaatcatattacccggcagggcgctgacgggagccgcattaaataagcatacgaaaatcatcaaggttatcggcatttaattttttagaggcttctttatatcccatagttagattattcaatcaaaaggttgtaaatgcctattaagttgcctcttgtcatggtcccatattccctgaggcattcctgccaagaataatggatttctttcatgcataattattgagtatttgaatcatctacatcgcacccaaagaaatttgatatcgtataattcagcatattattatatactgtgtaaaaagatgacatgggaattaagaaacaatcatcagatttagtggatgccgcaatacaaggactgataatgtaaagaaataaaagagaacgcgacacaaaatgcaaggaaaaataataaatgttacgtagaaatatcggtttcctttccttgatttctatatcttagtaatgaacttcaagaatatgcttattttacccaattatagctttaatcatcaataggatcttaaaaattattctaatatccaccgaattttcgaaaagtatactaatttaaacatttggtgtaagcgtttaggttgctaacgtagcagcaaacgttggtatcaatcaccacttattgcgctacatttcaacaatgttcttgagaaatgggtgaatgttgagataattgttgggattccattgttgataaaggctataatattaggtatacagaatatactagaagttctcctcgagggtctaggaatccccataatggaatctatatttctatataccaatattacgattattcctcattccgttttatatgtttcattatcctattacattatcaatccttgcacttcagcttcctctaacttcgatgacagcttctcataacttgtgtcatcatcttaacaccgtatatgataatatattgatagtataactattagttgatagacgatagtggatttttattccaacagttctcttcaaccattcgtttttgggactgaggaaaatgaatataaaattataatacttcatcttgaactttgagaaatcacaaattgtatgggcgtgtggtctagtggaatgattctcgctttgggcgatccccctgatcaaacaggaggaacaaagcatgcgagaggccctgggttcaattcccagctcgcccctttttttgcaacttcgttttagacagttacttaattttgtttcttaggcacaacaatatttataaaagaagaatgtaagtatgacgacgaaaacgaaaagactaatagtttcatataatactaaacgatttcaattttcgttttatatccttcctattcataaattttatttcgctatgccaataatgagtggatgtatagttgatatctgtttcgataattttaaagtagatagtaaaatcttactgacatgaataatccgtccaaaactagattactgtatacaagcatatttaaaaaaataatgaaactatgatcaaaaaactgtgctactacagcggtgttgttatccgatacaaccggatatttttcttttaatgagtctaaaccgtgatagcttcaggttaatacaatcaaaaaaagctcaaatattcttttaatgccgcgttcacagattccaattgaatacaactaggtagttcattatatgaagcctttgctactatttttcactatagtctgccttcaccttaatgcagacatccacatattttaatcactttaaaataaaaaggaagatatattagaagctatgatccaatctgtaagccagattaaaattcacgaactcttctttcatttgaattgaatgctttgagttggggtagattatcgcaaattactcatcacatttattgactacgaacttgctgatgtcctttttttatttatatttttcttcagtgaagcgattttttttttacacagaccaagacggaaaaaagtagctaaggaagaaaacaaaatcatgaaaaaaatgtgaagtgatcatgcacatcgcatcaacttaaacattggcttagagatatatagagttagagtttacggcaacctttaagcaccaataccttttggcatagtctaaagacctggttcttaattttaaacaaatttaactaaagatttccctatcaaagaagtaacgagttgacagattttctcaaaataaatcgatactgcatttctaggcatatccagcgatgggtgaacatggtggtcttgtagatttattggacagcgatttggaatactctataaatagggaaacacctgataaaaacaattgccttagccagcaaagtgtcaatgattcacatttaacagcaaagaccggcggcttgaatgcaaggtcttttctatctacgttaagcgatgattccttaattgaatatgtcaaccaactctcccaaactaataagaataattctaatccaactgcaggtactttaagatttactactaaaaatattagctgtgatgaattacatgctgatcttggcggtggcgaagattcacctatagctcgtagcgtcatcgagatccaggaaagtgatagcaatggtgatgatgttaaaaaaaatactgtgtatactagggaggcttatttccacgagaaggcgcacggacaaaccctgcaagatcaaatattaaaagatcaatataaagatcaaatttctagtcaaagcagtaaaatattcaaaaattgcgtcatctatataaatggctacaccaaacctggaagactgcaattacacgagatgatagttttacatggcggaaaatttttacactatttgtcttcaaagaaaacggttactcacatagtggcttccaatttaccattaaagaaaaggattgaatttgcaaattacaaagtagtcagtccggattggatagttgatagcgtcaaagaagcaagattattgccctggcaaaattactcgttaacatctaaacttgatgaacagcaaaaaaaactagataattgtaaaaccgtaaattcaattccattgccctcagagactagcctgcacaaaggatctaaatgtgtagggtcggcattgttgccagtagaacagcagtcaccagtaaatctcaataatttggaggcgaaaaggatagtcgcttgtgatgatcctgatttccttacttcctattttgctcattcgagattacatcatctctccgcatggaaggccaatctgaaagataaatttctgaatgaaaacatccacaagtacaccaaaattacggataaggatacctacattatctttcatatcgattttgactgtttttttgcaactgttgcgtatctatgtagaagttctagtttctcagcatgtgattttaaacgggatcctatagtggtatgccatggtactaaaaactccgatatagctagttgcaattatgtagcaaggtcatatgggattaaaaatggaatgtgggtgtctcaagctgaaaagatgttgccaaatgggatcaaactaatatcattaccatatacctttgagcaatttcaattaaaatcggaagccttttacagtactctcaaaagattgaacatattcaatttgattttacctatatctattgatgaagctgtttgtgtgaggataatccctgataatattcataacactaataccttaaatgcaagactgtgcgaagaaatacgccaagaaatttttcaaggaacgaatggttgcacagtgagcattggatgttccgattctcttgtgttagcaagactagctctcaaaatggcgaaaccaaatggttacaatatcacgtttaagagtaacctatctgaagaattctggtctagtttcaaactagatgatctgcctggagttgggcattctactctgtcaaggttagaatcaacgtttgatagcccacattctttaaatgacttgagaaaaagatatactttagatgctttgaaggcgagcgtcggctctaagttaggtatgaagattcatctcgcgttacaaggccaagatgatgaagaaagcttgaaaatactgtacgatcccaaagaagtcttacaaagaaaatcattatcaattgatatcaattggggaatcagatttaaaaatatcactcaggtagacttgttcatagaaagaggttgtcagtatcttttagaaaaattgaatgaaataaacaaaacaacgtcacaaatcacattaaaactgatgagaagatgtaaagacgctccaattgaacccccaaaatatatggggatgggaaggtgcgactcattcagtcggagcagcagattaggtattccaacaaacgaatttggaattattgctaccgaaatgaaaagtttgtatcgaactttgggctgccctccaatggaattaagaggtcttgctctacaattcaacaaattggttgatgtgggtccggataacaatcagctgaaactgaggttaccgtttaaaacaatagtgacgaacagagctttcgaagccttaccggaagatgtaaaaaatgacattaacaacgagttcgagaaaagaaattataagagaaaagaatccgggttgacttcaaactcattgagctctaaaaaaaaaggatttgccatttccagattagaagtaaatgatttgcccagtactatggaagaacagtttatgaatgaactaccaacccaaattcgagcagaagtaaggcacgacttgagaattcagaaaaaaatccaacagacaaagttaggaaacctacaagaaaagataaaaaggagagaagagagcctacagaacgagaaaaatcatttcatgggccaaaatagtatattccagccgatcaaattccaaaatctgacacggttcaaaaaaatttgtcaattagtgaaacaatgggttgccgaaactttaggtgatggagggccgcatgaaaaagatgttaaattattcgtgaaatatttgattaaactttgcgattctaatagagtccatttagttcttcatttatcaaacctaatatcaagggaattaaatctctgcgcctttttaaatcaggatcattcaggcttccaaacgtgggaaagaattttactcaatgatataattccacttttaaacagaaataaacatacttaccagactgtgcgtaaacttgacatggactttgaagtttgaattaaaaaaaaaaaaacatttcagcatacagtaaacacgcagtttgcgaacattacctgtaatatctgcatgattattaccaaagaaaaaaaaaataactgacacaatggacaattaaataaaattaagtaaaaaaaataaggactttaatttttactagaattcttgaccaacagtagaaatgcgtaaggtattggaatggccgactcctcctttgaatccttgaatggaaacaacagtatcaccgttgtccaccattccgaaagacctcgccatttcaacaccaaactttaggcgcctatgaacatcctcaccccagtcgtctaggcgtttcggttcatacagaaatgggaaaacacctctatacaaatgcgcaattcttgccgttcttgcgtgtcttgttactaatatgatagggcagcttggtctatacttcgacagtagccttgccgtgttccctgtagtagataatacaacgatggccttaccatcttgctccaagattgctgcggtagctgcagctgctacagtttccgtagtggaagtaggtttgggagtggcgtctctgagatcgtcataaagagccaaatgagcgatagtactttcagcaatcagagcggtcgccgccataatattaactgcattcaccggataatcacccttcgccgtttctccagaaagcataacacaatcagcaccatccaacacagcgttacccacatccgatacttcagcccttgtcggtctcggattgtgtgtcattgaatccagcatctgagtcgcgcaaatgacaggtttgcccgccaaattacattttgcaatcagctttttttgaatggctaatacttcaggtgccaggatttcaattcctaaatcgcctctcgctatcataacaccatccgtgacttccaggatttcgtcaaaattatccaacccttgctggttttctatcttggatataatcttgatatcttgcccttcagaacccaacgcttttctgatagacaacacatcttctgaagttcttatgaaagaggcaaatacgatgtgaatgccattgcggactccgaattgcaagtccttcatgtctttggcggacaaggggggcaaatcaacgtcggtattaggcagattaacacctttatgagatgcgatataacccgagtttaccgcttgcacccttaaattagattcgtcaatgatttggagcactttaaaagagagaatcccgtcgtccacgtatataaatctccccggaacgataacttttgtcaggttagcatagtctatatacatgattttatcattggaggtgtttgcaaaacttgcgtcagtggtaaagatcatttggtggtctacggggatataaagatcttggtcatttaacgtgcgacctgttctgatctcgggacccttggtatccagggcaatggcgagcggcctgccagggaattgctgttccgatttcacagcattttcgattactgattgatggaattcgtaggagccatgggaaaagttcaatcgaatgatgttcaaaccagcttttctcagagcagtaatggcctcgcagctatttgtcttgggcccaatggtacctattatggaggtgcgtctgagctgctgcggagttcctattttcaaattagctagtctctgcaatctggactctggcatcgatagtgcttttgttgtaatcttacaatggacgtagaggatgaaagtaaaatatagttgcgtttcaccgctctgcttcaaaatgttttatgttctttgttttctttctccatttatataaacgtgtgcatattaatgatatatcattttctctaaaaagttatgacactttacccctgtttcctatgctgcgtcgctaaataaaagcgacgagaaagaaaaaaggaaaccaaaaggaagaaaaaaaaagtaaaagagaaaaacacgtgtggagaacttttcattgactttttacaaatctcttgtatgtaagaatacgccagcattcattttatacttttatatatgtgtttttacttccatccatcgcggcgaaggagaaagatttttcgaatattagtatcgtgagagatatcggaatatgttcataaaagcgttacaacaaggcgtccaagaacttgtctttgaaaccggtggggggtaatctcatctcctcaatttctcttgatttctcctcgatctcgactaaccctgtagtaacatcgatctcggacacagggagccaccattgtctccacgtccgagtatacagcttatggccgaaccacaaaaccaggaagatgggtagggtgatgtaggcagcaatgaaatctgctactctccagtacttagggatgaaaatggcatacccgttggtaatggtgatgatgcctataacaatgagagagaaccacacggtgtaaggctgtccccacgtcttgaaaggcaatctgtcgtagaggccattgtagaaaatagccttgcggaatctcaggtacgcgatgcagccgcacatccagcccagaaacccggaaatggtgctgatattggaaaaccaattaaacacgtctgccgtggatgaagacacgttcagatatgccaaacaagaacacaagaaggaaacacccacagccacgtatggaacaccccatttgttgattctgcccaaacatttgggtgcctgtcccgtttgcgccatggtcaacagtgatctcgtgctcgcaaacataaacgcattggcggcagaccacgcgctggtcaagatacacccattgataatgtggggaagaaccttaatcccggcgttttgaattccgatcacaaagggtgacgagccggctcccggtttgccctgcgccagcgcatttaccaatgttgggtcattgtatggaacaataacggagatggccagcgtccccagaacgtagaagaagatcagtctccatacaaagcggcgcgaagccttagcgatatttctacgctggtccgcgcattccgcggaagtcatgcacaccagttccggaccaagaatgaaggcgaaggcgcccttgataatcccagtgtagatatctgtgaagttacccagcgatccgcccgtgaggtgatgcgcaaaagcgcccggatgttgccagtatctgaagccaagacggtcatggttggggccaccaccccaaaacaaaataaaggacagaatgatcagtcccacaatgcataatatcttgatagacgcgaaccaaaactcggattcgccgtacactttgaccgcggaaaagtttagtataacaaccacgcatagaaagatcgtgatccaaacgcccttgggaaccgcggtggtccagtattcgaccacaccggatgccgccgtacactcggcggccactaaaatgacgtagcagtagaagtaattccacccagtggcgaagcccaacgaagggtcaacgtacctagtgaccagattggccgtcgacccggcactgtcagaaccatcaccgggcaaaaagcacaccatttcgcccagcgcgcacatgatcgggtagatcaccgcggaaataataatgtacgatatgaacagccccgcgggaccgcacgtatgaagcgtggatgaagtccccaccagcaaaccggtaccgatggcgccgcccagcgcgatcagttgcacatggcgcgactgcaaaccttgttttagtttgtgcggctcgctatcgccatcgacggagggcgatttctccaagtccacgtccataatcaaatcctcgcggatggtgccgttggacgacgcggactggttcttagatattttctccatacggatggcgtcatctttttcattgtcgctgcgatgattattgcgcgacccggacgatggtgattccgttacctggacaacatcctcctccttcttggtgtcgccgccgctaccgtcgccgctaacatcgtccgcgcaggtgacgactcccgcgctgtgtctattgttcttgtggaagggcagtatatttaccatgatttattcattgatggtgtgattcttcgaaacagcaaagaataaaagaaactggaagggaagagagaaaaaaaaaggaaaggaagaggaacacaaaccccctatatatatatagaagtacatcagtctacaaatattcgagtgtataagtatgtatatacatatatgtttatgcgtctgtatcagtacatggatggagatatgctgtgcctacattcatggaatattcagattggggcatgtacataaacagacataattagtattttggccgtaggtcctgccctaccctgcaaggttcttcttgttatcagcactggatggaggggtgaagcagataaaaccccggtgtagttggcgataggcagagtgcaggcacgatgatagcgaggggttgaaaacgtcccattttcctttgataggaaatatcgggcagaagttgaaaagcgacaaaagcgacaggcacacgcgaaccggctaggccacccaaacgtcatagctagcgcaatgaaaaaaactaacgtcgcttcccttttggtttgatgatgtttcaactcgcagcgcgggtacccgggctgccggaacaaagccgtgcaagtagcggctgtcgtcacgcaccatgggtaccatcttgtgccgtgccgtgctacctcagatttaggaccctggagatttggcagacatgacaagcaattttgacaaacttgtgacaagatttgaaccgcgcgggaattcacattgcagtatggacggacatccggccatcgcgcgcgggcccggtatttgatctccgttttagaagcacagaaaaaaataatatgatgttatgatgtttaatagatggattcatatcgtccgggtaaaaacgcttttggagaaatcaaggaaaatcgccgagatcactaggaaatactattactattgaaaaaaaaaaaaagaaaaaaaaaggaaagacgataatatttttggaaagaacgccaccacacgcactttacacccttcaatcatgaacaatattcgggccttgctggactcgatacaatctggagttcagaccgtttctccagaaaagcaccaacagacgattgccgcgatcaacaaatttcaagatgatcctgcacttctagacaccatactaccgagatgcgtgcctcttttgaccaagtcgttcttttgtatgtcacagcgtgatcagaaacttgttgcggagcttttctacaatcttgacaagatctcccactcaaaagtccttaaatcattagatacaagtatttttagattaaacgaaattttaaactatttacaagatcgagcctcgccctcttctttcagcgatgtcttgtgcgtctatctaaacctttcttggctaagcgtcattctgctttcaccttacgcattcaaagataaattcaacaaaacgcttcaagtatcttccaggttcgagaactaccccatttgcatacctccaattaacaagatcaaagccgttttatatttcaaaaacttcacagatgcctttgaccagctaccggaacgggaacaggcaaatgtgccgtttctcaaccaatttttaaagctgtttattcagtcttcggaaaaggcaaactactacttctccaatgaaaatctaagacacttacaacaagttgcactgtccaatgacggaataaagctgctgccaaaattattccagatttcgttcaatcatggctctcatgatatcctagatgctatagtagaattcttccatgaccatttaagttcgaattccacagacacaagattccaattggcacactccttcgctaaaattgccaagttcctgcaccaggcagatccagcatcttttatcgagctcattgattataccatcgaaaatacggtttccctattacaggctccttgcgattctatcgatagcaatgagctgcacacttcccttctgatcatcgccgaggtggctctggccaaaattctgcctatagatctagtcgaccgcgtattgactctgatcatccctaaaacatgtcattttcagaaatctcactttcaaatcatcaagggccaccatatcagggactcgacaaacttcattatctggtcagtaataaggtcaaaccgtagcaatagtttatcgccgcaggttctacaatcactactttctcatctgttaataaacgccttttttgaccccgaattaataatcagatactcgagttttgccgcgctccaagaattattgggcaggtccaacaaatctcttgcgctaaatcaaaatgacattgctttgatattgcaagcaaattggaaggatctaccgaggtctttcgaggagaactctggtctaattcgtaggctgttcaaccccgaaaacacctccaaaagtgctgtttgcgtatggaaggtattccgcgattggtccttcaattggaatttactagagaatttacatttgaccacaatgaaactcaacatagattataacctagttccattaatcaagtcgaaattatcttcacccgctttattgcaagaggtattaaacaaggctggcagctcagttacacaaaattgtcaaattttgtacttgtacttgaaactattcgaaaatgacgtaaattgcccgaaaataagcgagatttgtatcgacatttaccagaaaaagataaaattccaattaactactcaagcgaaaagacaatttaacgataattcgcccgaactgtttcaaatttttgtcattttgaaatactggcaattaacaggacaaaatgatttcaatcaggaattgttttggaaatttgtagacatagtatccccacaaaagaagttaaatctgtacaacgaattcatccctataatacagcaaataatatctcaatgcgttagcctaaactacacaaggattgttcaattaattaaatcagataacgaactgacttgccgatcaatatgtcatatgcccgatcaagaaaagatgtgttcccttttcttctcccagttccccctattgtcacctcaatccagatcgcttttgataggcgaacttgatcatcattgggatgttagaataagcttactcccgtcgaattcgtatcgaaaatttcgcaacatcattatcaactgtctcgatgattatacaataactcaacagggtgatgtaggacgtctggtaagaatacaggctttaaaacttatgcaatcccatcccgatttcttatctggtgattgcgactccatcaatccaaaattaacgagattgctggcggaacctgtaccagagatcagaaaactaagttatcaattacttgcttcggccacatcacaaatcactgtgttatctgactcttcgatactcaatttccgtcacaagcaaggtttaagtgaagaattctggaaaggatatgcagtgagcgctggagcaatacattttacagattctcagcttacttcatcaatagattcatttatcgtatactacagatctttgtctccttcacaacagctggaattatgccacgatttaatcagaataattccaagcgctaaacaaatcgctgaatcaagaatacgcgatcgtaacaaggatccattaacaggaggtatgagatttgacaccatcaaattcaccattcattgtgtaaaattttggactagaatcatggaatctgggttggttgttctacatccaaattttaattttcagggtgttttcgccaagttctataacctacatttattagattgtacgacattgagagtaagcgtgatcaaattcttcccgttcttggcaatatcttgttaccacacaatgagagaaaatgctgaccagaagaatctatccaacataatactgaaaaggttgttggttcttgtgaaacgtgaatacgccgcaacaaaatcaaaatttatgactgatcaaaatgtcgctttacaaggtatgttccagatatttttggaattaggtgtcaccaggcaactccaagctctacaagtggcctgccagaaacatgaattggcgaatatattagagtctgatatcactttatagaatgtaaacggcaaattttacatataatcattatttttgttgcatttgcttagatcttatgtaagaaaatagattttctactctctttgcataggatacatccgcagcaaaattatattccgcatcatttgcggtaaataaagcttcattccgcatttctttatctctttttgctttagatttttggaaaatttctgaatccatatgaaatagagtttttcgctccccaaaaattttgcgcaattccattatgtttattggttgaatggtccctttttctgacttaaatggtttattctcaacataccattcgccgacgtcatctgttatctgcaaaactctatcggtgttttcttgtatatcaatttctaagctggatagccattcagaaattgcatctccgatttgtattggcaacctccacgaaaacttatcactaaacttatcgaaaagaaaaaatttgtgactttgtgtaaccaacaaattatagaaagcaaaatagaaaaaatcagaatcagagtagtttttgcagactttcaacatcgagagaaaatcgtgggaggtaaattgatagccgatttcattcaactggttatacaatgccagtagagtaagtttggtagaaatatcttgagaggcgccatgaaagaggcaatgaaaagtggaattttctttgtttccaactatattatctgtgagtaataatggctgccataaatttttttcgtatactatgtgctcgaccaatgaaagcataaaatcgaaatccttgcgcacagataagtgacacagtagcatatcaataaaaaaagctcttaaggaatgcaggttggactcagcctgcatttggtcatcaacctccttaatgtgctttttccatacttctaagttcagaggcaaatcacttaatttaaacgatagaaattgaagaaatgaatcttgcttgagaggttcgaaattatcttttgataaaatatgtatgctctgcttcaaactcacgtcagttggtaatttttcaagtccgaattgcctagtgacagcggtagttgatgataatccattcatggtttcaataactttgaggcaagaatggttctgggataattgtatcaagttggaggaatcatgctgatcaaaatgaaagttccattcagacaagctccttaaaatctgacaagcttcattctccatattttgtgctatcattacttttagacttttgactaggcatggactaaataactccaacaattgaatagctctttcacgctccttcgaacctcttaaaccagaatccggtacacatgaggataaaatatccaacatacttgtccattgggaggtctccacataaaatgccagctgggataaattggctaataattgaccctccgaattttccgcgaacaaccgctgtattgcccttaagtagtagttcgattgggatttaacaattaaaagagtacaattcctcaaaaattttatgtttgcccgaaattttccttctatagttaaagatttggttttaagaaaataatagcgatccaataattgcaatgaaaatttagctagtgcaattttgtcatttgcggaccgaagcgatagtttatagagcatattagatagctcatgataaaattccaaaggcagccgatcaggtgggaatgcatcaatctgtcggccacttttatttagccattttatgtgacctgtgccaatacgattcaacaacgcaaaatacaaagcaggattatcggatgtacgaagcttctgtagagtagtcagtaccacatttaatcgtaaatttacattttggagcttatcttcattcagtttatcttttcttgttagcgcatccttcaaccatttatcagttattgagttagttcttttgttatttggtaaacgtttatgcgatgatggctgtcgccctagctgtggtagtatttcaggagtgattaaagagtccttaatcagcttaccaatatgactagacgaatatcttttaaaaagtaacttcatattcttcttggcacactactatcattttttctcgccgtttctagtagaaaagggcaacttttacttaaaaatcatacaattgacttacttttttttttttacacagatacctttttattttgaactacgcgcagtttgaaagaggaagagataatcctatgattactccaaaaccttcttctttttcggtattgcctgagaaatgataacacttttgggtaacttccttttccagtctgaatttatactttctagtttagggccttcgttattgcacaatatctttttgtaatataatctctctaattgacttaagtgttttgcaatccaaatatgtttgagaccttgcttactatttaatcgtttaactacgtcagtttgcaaaaggtctttgacaaaactcttggcattatctgaaacaatatcccactgcttcagtttgaaattcagcttcccaatttttgcattttgaataatactcctctcagaaccatctccataaaaaggcgagatccctgttaacataatgtgtgtaatgacacccaaagaccaaagatcacatttactgtcataacctcgttgctctaacgtagctgctcttgagaagctttgatatgcttttctgtttgctctgaatccaacttctggagcgcagtattccggagtgcctacgacagtatgcattctttctttgttggaatttaaatctttagctataccaaagtctgccaagacgattctagtgcacggttctggcgtacataacaaaatattgtctagtttcaaatcgcggtgaacaatgtcttgatcatgaaggtagtttaaagcttgcaaaatttgaaagacgatcaatagcgattcagtttctgacatggaagttagacagtcgcctttagctaggtaagaaaacaaatcaccaccagggataagatcctggaatatgtaaaggtgattgttcctgtcacagaaagtatggtagactttgataatatttgggtgatccagtctcaaaaggattcgagcctctttatcgaatttatttggttttagtttaatgatcttcacagcataattttcagggtgataacagacatcttcatcacgttcttttgagttatgcgtgatcagaacatgaccgaaagtgccattacccactattctatttgttatttcccattggtctacttccctcagaaaacccatttgatctaaaagttttgggtccagagaagattgtaaatcatcattaatcataaaaactagtcgtgtttttttaatgtcattttcttcacttccctgcgataattcaataacgtcgcaatgttttaaaagatacgttttgtcccttttcaaaagcaaaccgttcaaatacgttccattaagagaacaatctttaacgtagaacattggaatactatcctcatcaaaaaagacacaccaaaacacgcaatgaacagaggagatagagggattcgttagaacgagttgacattccttatcatttctcccaactttcacgagctgatgctttactataggtattgtctgctctgtattatagccgcctacattaacttccaggtgagcaggagctacgccacctgccatctcaatatcatctttggttgcaaggttgcagctatacaacggtctcattccgctcttcttctttctgttgtatatttggtccttaataaaatttgaaacgtacaagagcactccagaaggagctcaagtaaaaaattagtcaaacctctcccttttatacttgaatgaatgaaatagccgccgaaatttagccgccatcattcttcttttccccggctaaattaccacggtatgctttatgattggaaaatacccataaagtaggaataaactacaaatgattccacttaatgaaagataagcagacaaatatactgcatataagtgaaaaatagtgaggagatcgctatcagtcaatattgtgaaggacctacctactctttttctagatatatattttttatttgcacaggacccctcttgcataattgttcctactaatacggtaggtagcacacaattttacaccacttgctttacaatcatacctcatagggccttcttattctgataatgccccttttagaatggctaaactgcttacgtcccgctttcttacgcactgcgcgcaacatgcaggaagaacaaacaacctcgccctgtttccataatgaaggtccttgaaatagaagccccacaaaagggtggaaatgtggcagaataaacagtaagctaactgttgtagagactccaagccctggtaaggaaagaaatattataaaaataaaagatttcaacacagtattttgatgtctgagccaaacacaccattacatgctcaaccgaatgagcaactggacttgaacaacttaaatgatctagatgaaaaagacattgatgatttaaacttggatccaaactcagatgtagaaattagtgcagactcaggtgatgtcgtaaattctaacatagacaacgttatatggcagcgtaattgtaataagaaaagaagatatcatacaccagaattcaatgatgtttacaatgaaactaacaacacaatcaacgacgtaactatgctcgatgatgttgacgatttccagcctagaataaacgtgtcttctcccttttcgtctgccacaaagctgagtgaattattgccaaatgatcacaatggaacgtcacacccgagaagattgtcaatgtctcaacaatccaaattcatctcttacgttgatgatcagcttttacaaattcaaagaaaatttgttcaatccaggggcctgaatatcaaaaacggctatgccagtcttactccgctgctgcaggatttaaaaactttagttgacttcgtttggtattctattgcccatgttccaaactcagactatttacttcaatcagaagaaaagagacattgcccagattcccgaaacccaaaagatacatgcggatattctagttattttggtcaagggtcctatttaataaaaattgcggacgatctcatcgattacgttgaaaaatttacattcaaaaatatggaagactcagagattaatgacactttatccaaattattcaaactcttcttcatccttgacaggatatttgtaattctaactgatgataatgataattgcaaagaagtccctaaaacgtcttcagccagcaagaacatagcaggattgaatgggactgatattgtgaggttaaaaggtatcgcggaacgaacaagagttcgcctacccatatttttggaatcccagggtatccatggttaccattatgaattaagcaagatttacgagggatttttagaccatgccaattcattttaacatttacattcaaccagtggcgtgtatcttttatacaataaatctgtaacttttaaaacttctgtttccgaactcctcatttttcatgcataaatatataaatatatatatatatatatataaagcatacatttcagtaccatggggtatatgatcctcccattacgtattctaaagttcgcgttttctcacaatgcaagtttttatattactccggagagttggcgcttactgatacagccttgtatgaactcaagtccaatatcacagtgacatccttggtaatcttcgccaagttggctaggttaggtctcagctcattcaaattaggcacgtcgctcattacgattttagtattagccagaattgatattattacttttaagaacgaattcattatctcccacgttttcagcttctccaaagatgtcagatacttctctgaatttgaatcgttcggtattaatacatttaacctttcattcaattgtttggataaatccatcgcttgacgacatgtttccgtcaaatcacgaattttaggtgctagcgagtccgtcaaaatttgctttcccatggtgctagcaatggctatcttggatatctctgaagttaactggttatatacaacgctcaccattttaactactgtggacaacgtttgatacagttgaatgtcaatatttgtctccactacattagcactactgttcgcggcaccaccaccattcatcggtggtggggttatattaacattcgagacgttattactatttgatgcgttaattattgaagaagtcataaccggatgctgtttaggttcatgcgcctgtgactcttttttcgaatcgctgatggatttattgtgctgaagcagctgttgccttggaatagtatcgctagtagtttttacttcattcatgttcgtttgagaacttccattgcttattgcattttggtgtcccaaaattggaccatgggtgtgtgcaccatttagatttggtgataaaagaggaacagcagtggtatcacccgtcagaatattactatttgaaagcaatgcagatgcagatggtgttcttgtgctccttgttttcggcagtaattttatgtttccgctacaatgtgtactggtcgtacttgctgcgggtcctccaccgcttgtgatactactggacgatgtctcgtgcctcgaaaaagaatgtttcttgggtgccttacttgcagaaccggacacttgatcatcttctttgataaaagaccatgcattatacatttccatataagcacacattaatgtcatataaaacatccttatgaagcatagatcgtcttctttgaaaaaaatctcaaaattttttctcaacaatgttataatttgtttaaaatttgtgatgatagtgaggcacagcttgattaacgcctgatcatgcgattcgtcttcgttctctgtttgctgcaagacctccaccagattatcagtatgtgatctgacagagtataataatgatactacattaaccgctacggccttctctttacagaaagaggcgatttttctgatagcttgttggcattctgtaaaactaaataggagcttccgacaggaaacaaccaactctgcatgcgatattttttgatgcccgttactcattgactcttctggtaaaatcgacaacctcttgaagtagtcattatatttggtgtgattgtatagttccgtaccattcactgccccactttgttctgattctgcattgactgtaccactgaaagatgttgcagaggtttgattagatgagaccattgcagtagatgcacttatagttgtatttgcacttggggcaagtgaaattatattgttttcattcattgctccattagacaagttcgtatttatgaatcccattcttttcgctgctctagatattttaggttctggagtaggtaggttaggatgatcttttagatatcgtgatatcgcaattgcccaatattcttctttggggatgcccgtatgaaatggagtataactctgtacttggtcaagctcttctttgggtattttattatcctctaaatccaagatgctcagcttgtttaattttgtgatcgatttcaaattacgtatgctagtaacgttgttgtctttcaatgataatacacgaatattatcttgccaaaacgatgatatttcatctggcaatgcttcaatctcattggaggacagatccaagatctctaattgagggcattgtgtcaaaatatatgggatttctttaaaattgttattatgcaaatccagatattgcagccttgataacctcttgaaactcgctggtaaggatgttaagtgatttttccttaaagacagtctttcaacattttggatatatcccacatcttcatctgatatggacttgatattaagagctattaattttagtgtagtaccactagagctggatttctcttgtgttgccaactcagatattatagtgttgcttgaattagtggatgttttgtcagcaggcaaatgttcctccttcggatccaacgtcctctttgaagatgtcgctaccatacgttacggatacttatagacttaactccccccaataagttcaggtgaaaagtagcatggagttttggcattaactttatttgcccacttatatttagagatcttgaaatactttttgttacccgacttgtagcttcattttttcattttttttttttttttttatttttattttgtattgttctttgaaagaatcatgcatggaagcaataactattatacggaagttatatacaagaaatcattatatagttacagcatcatatgtgcagaaaattggttctgagcttttcttattgtcttcttatgacaagtgtattaagtcaacttttctggaacagtaattccatcacattcttttaaaatttgaatatccttagggttgggacgaaaaccctcattagtgcctaaatctcgcataaactggttaataaaagcaacctctttgtcagataactgctgagtattgcgtgcaaatgtggccaagttgaatagaattttcgaaacggccaagttcgacaccctgatacttgaatccttagctagattgtagtacttttcgatgtagggaacgtactcgctatgtttactcttgtaaagtttatcacagaaccccaataataaagcatttagaggcgtattatccacgtttctctttctagtcttttgatatgagagaaaatcagaaaacaaattctttgcctcggccactgtgccgtcaggcttattaaactctgcggaaataaagtctgcataattcctagcatttaagtgagttcccaattgtttgtaaagttgacgaatcggctcgacagtggggcacactgaaataaaggctttcgtaatcttttcaaccttttcataatcggtgggattaatggaaacactttgcaatagatcgaattgtgggcgtgtatcttctgcctgaaatttataattagcgtacattttaatgcttagagtatccaaagtagggggtaacacaccatctgatggataatggttatagtaaaatgtgttgaattgttcttcgctcactttttcatcatctaacattagcaataaaactttattgaacaacttcttggttttaacagtctctgctaactcccctttgacttggtcatactttagaggcgaagtttgacataaggccaggagaaatgcttccttcacgatgggatctttcttgaactttttaggaagttcttcttcccaaaattcctttaaatggttgaaatttccagaatcagttagtgcgttaactagcgtcgcataagatgtgtttttaatattatctcctggtttgataacactgttccagactgctagaattctgtccaacttctctttactcgatttagctcgtaagtgcgacacagctcttaaaagacaatctttcagcgacgtactatttgggaaaaccttgctatactggttataaatagtaacaacttggtcgggtttatccaaatcaataaacttgtccatgaacttgcttatgatctctacatttttctcaccttcaagtttattgtattggccataaagatcccttaaatctatccatctaggagcattttcaatttgacttaagaaatgatcactatcctgtactgtgtattgatagtacaaagtgtttagatttttgataatcacgtctcttctttcaagagagctaaattctgtacttaacattcttctaatcatgttaaaaggtaaaacctggcccattttacgatcgatctgtaaaatcttatacagaatattgatatccacagtattctctggtaaagataagtaagcaatggtggtaattgcaatattttgcatatgtgcacgagaagaactattttgaagtaagatcactgggttttcggaaatggtttccaagtacttcacccataaggcaataacgtcctgtggtgattgattatatagaaggtactttaaaacaatcgtgaaatgttgtgagcgtgccaatttgtattggcacaatgtgtttaatacttgataaggatctagcgtcatatttttgcttctgtaacttaattcctgtaggagatccgaagaaaaattcgctaacaagtgtgatctttccataggtgaagggttccttaatttctgtttcaacgattcaatcttatctttaaagtcattaaaaacttcattgatatctgaatctggagctttcaactcgttcttcaaatcagcagccaaattttgtaccctttcaaacggtgagacgtgcttttctctatttcctgaatgtccatcatctgtttcttgtaagtgaacgctgctttgttggtatatcgatgttgaagaggttagacatcttcgtgaaataatcacctttgaacaatcaaaggcccttaaagcattatgggaaagcatctgtatcccagtggaaggctctgatattattttgtgcagagccaacttaagcaaacatatagacagtacgtccttagttagacatgtgtagcaattgaacgattccacaggcggtatgtatatcgtatatgatgatattacattttacttaccccgctttttccctcttataatcgattaattacttagtcgacgagcaaccttttatggcatatttgaaaggtaatacaatgttccaacttcgttttttattcacagatcaattaacgtattggcacacctgatatttcctcaatagtaagtagttttggtgatgtaactttgacactaccttcgaccgaatattcacttataaaacttatatattacttgcttttacttctaacttgtctggagagttcaatctttgttttcagctctatataccggttttctgcatcggcggctaaatggtattcttttccgcttggctctacacaatgtttattaagctgagcgtcggtgtttccgatttggaccgtttgactttctttttggactggttttcttttttagtacgaggtgtacggacaaaagatactaacggacaaaacgcggttgcaactgaaatttttttttcactattttcgtagggcacattggtgtaaatatatatatatatactcaaggttcatctcgttttttttaatattcttgttccttactcttgatcatacgtagaatgtatgtctttatcctgaaagtaaagaaaggattatacaatgctgaaatgttagtactaaatatgagcatacaatcacttgttgttcactagttcaacgagtttcattcatattcaactcacgcaagggattatggaagaagaatcctttttatgaaagggaaaaaaaaccgaaatactatgttaactgcttccaacgctctatactaatgcgcatgaagattttacttgcgaatcaaactgattcgcacgcaatatctaagtctgctatacctaccttacatctcgccgtatgttatgggtgcaagggtgtttttttttttttatattttttttgtttggggttttcgatactttgtgaaggaacgacgcagaaaaaaacgaaaatcatacgcccgatgaaatttttgataagaaaattttctgaaaacccatgcgatgagaagtcaaaaatttttcttcttctccttttcttgtacttttatcccggctagttctttttctaaaattttcatattccagtccaatattttacttcattttttttttctgttctcgcttggcttgatttaattttttacgtaggttttttttacacgatattgtttgtattatcagtattcccttcaagctccccttttttttatcaattaaggttcttggtaatttctatttctgaaaaaccaaaaacaaaaagtcattgattgactatttgactcaaattaccaaaatcataacttttcttttcagcattccattattgaaggctttaaaataatagtttcttttttccttattattttattttttcctttacattggaatacattttattttgagttttaattttttttattttctattccattgttttttatttgctttggactgcccttttcgtaataatttccctttttaccctattttagtcacttctgtgtcagcaagcgggattatataaagaaacgttagcagaaacaatatcagcaaaatagaaaataaacgggcaatcaatcaataactacagaaatattgggaggttttaactaatttttccaggatatttcaacttttcataaatcaaattttttttacttttttttttgctttgctatagtattttagaaaaggacaaaaaaatacgaaaaaagacaaaaaaccatataaaaaaattgattagaagaacttataatggcattggcaaattccagacctttgcaaataccaactttagagaatgaaattcttcataactcaaattctccagtatttcagttgaattcaatgggatttacaactagagctgacactatttcgaatccaggcacggatcttatcggcaaccagccaggcatggcccttgatgataataatttggccggttcttcgttttcctcatctcaggaaataaaagctaccaaacctaagaaggactttggtgctcccaaaaaagacaatccattattagaaatttctaagctaatacctgttactggtgagaggccaaaacccgaaaatagagactcccctctggatgatgacgttcttcacgcagtttttttaatattatgggaaatggatccgaatcaacaaggcatgaccgtcaaacaactgtgtgacttgcttttgcaaaaacatccagatatgtccaatttatcaaccaagttgtcaaatttaatttccgcaaaactgaacgcttatgttaaaaaaattgaaaaaggtgagaaaacgttaacttatgctttatcaagggaatggtctaattcatctcctagaaggatgctctatatatacagaggcatattatctcccgattacaaggagcatgctcaagctgttacgatgcaacttaaacaacaattggagacctccggtgatacaagcgactttaattcaaatggcaagaaaaaaagggagtccagcagtaaccagctagttaacaatgacagttattcaagttctatgacggacatgaaaaatatgtcttctaacagttccttctcaaaaaatttgaatgtagggaatctggccttttcattaagtccagaattcaacataccttattccacttctccagtgtcactaaatctttccccatcgatgagtaataatcagcaacaattactgacacctaattcggcatcgaagagtaaaaacaataataaaaaaagaaattacatggatgaagatactaacgagtcaatgaccgagccaaagaaaaccaaaactactaaacctggcaaacaaacaaaatcccaatctttatcagttttatccacccccaaaaagggttcctctgcatctctttctacatttgcaagctccaagaatatttcgccagattcttctctgtcgcataatgcatcgtcaaatacttatgttactgccgctgccgctgcaccaaggctttctaagcttttgccgaaaaatgggtttaagaaaaattcacgtagctcttctgaactggctgctatccataaagtaatctctacacagactccaattgagagctcttcagagagctctcaatataacagtagtagtagttcaccagttaatagtgcagctgcttcttctgctgaatctttatccgacatcaattccagtcaggataacggaagagaatcaaacccaagttcccaagaatcacgaaacgaagttacgaattggatgaaaattgtgagaaatggatttttgacacatgatattgaatctcctgaatcaatcacattagatgacctagaaaatatattcaattgatttttatctccctttacaagagcataacggctgctctacacctatgtcgttgtttttttttatcaactaataatatgtgttcctctcatttggacaatttttagctagttctaactttcactacaatatttaaataaataaacaaccataaataaataaatgaaaaacaactaaaccgttagaggtggactaatttactgttaatgacagtaatttttttttttttggctgttttcggttattccggatatatatggattgatcttcatttaccccacagttagtttatccgaaatttgcgggaagctttattttttgttaccaatggatcgcgatttgccatgactgtagaaaagaaaaggttaactgaaaaattcaactttttcaagcggactgagtagtagtggtccccacttaattaatttattcaatacgttatatacttactgttacttcaggccacataaaagaacaaacttaagctagacaggaaaatccactctgggaaagggaaaatgattaagttcactaacgagaacttaattagagggatccgaatgacgatttccgcaaaatctcgtcatttggctctagggacagatatgacgagaaagtttagcttgtcgtgtaggtttttgaacaaagcaaatcttactgaagaagagaaagagttgttaaatgaaccaagggcgcgcgactatgtggatgtttgtatagttggaggagggcctgcgggattagcaacagcaatcaaattaaaacagttagacaattcgtcaggaacaggccaattgcgtgtcgttgttcttgaaaaatccagtgtattgggtggacaaactgtttccggcgctatattggaaccgggagtgtggaaagaactattccctgatgaaaagtctgacattggcattccgttaccaaaggagttagctacgttggtaactaaagaacatttgaaatttttaaaggggaaatgggcgatcagcgttccagaaccatctcaaatgatcaataaaggacgtaattatattgtctctttgaaccaagtcgtcggatatttaggagaaaaggcagaagaagtaggagttgaagtttaccccggaatagctgtctcggatctcatatatgatgaaaacaacgccgttaagggtgtaattactaaagatgctggtatttcgaagtccggtaagcctaaggaaaccttcgaacgtgggatggaattttgggctagacaaactgtattagcagagggctgtcatggttccttaacaaaacaagccttggcaaaatatgatttaagaaaaggcagacagcaccaaacttatggattaggtattaaagaagtttgggaagtcaagccggagaattttaacaagggatttgcagctcataccatggggtacccgttgacaaatgatgtttatggcggtggtttccagtaccattttggtgatgggctggtcactgtgggccttgtcgtggggttagattataagaatccctatgtttcaccttacaaagagtttcaaaagatgaaacatcatccatactattcaaaagttttagaaggaggtaagtgtatcgcttatgctgcaagagcattgaatgaaggtggactgcaatctgtacccaagttgaatttccctggtggtgttttggtaggggctagcgcgggtttcatgaacgttccaaagatcaagggtactcatactgcgatgaagagtggattacttgccgctgaaagtatctttgagtccataaaagggttacctgtcttagaagaggttgaagacgaagacgccaaaatggctatgtttgataaggaggcaactattaacttggaatcatatgaaagtgcattcaaagaatcatcgatatataaggaactatacgaagtgcgtaatattagaccgtccttcagcgggaaacttggtggatatggtggtatgatctactctggaatcgattctttgatattgaagggaaaagttccgtggacactgaaatttgatgaaaaaaatgacggtgaaattttggaacctgcttccaagtacaaaccgatagaataccccaagcctgatggtgtgatatcctttgatatattgacctccgtgtctagaaccggaacctaccatgatgatgatgaaccatgtcacttgagggttcctggacaagatatggtaaagtacgccgagagaagctttcccgtttggaaaggtgttgaatcgaggttctgcccagcaggtgtctacgaattcgtcaaagatgaaaaatcgcctgtgggtacgagactgcaaatcaattcacaaaattgtatccattgcaagacctgtgatattaaggcgcccagacaagatattacttggaaagtacccgaaggtggagatggaccaaagtacacgctaacttaatcacaggattcattatttatttaattattttattcattatttatttaaatttttctattcattcttttatataatctatattatttattcacgtaaaagagttcttttcagccgacaaacttttcagcttcaatgaacctcacgagaactttagaaccagattgtaaaagcgggtgcccggctaccgattgcatccaggtattcaaaccttgtctcctctcttcaatgacttcgttactaaatctattactcaagagaattttacccggtaaatgaggtaccatgacttttgggtgattaagcatagaaatttccttgatcaagcatttgcggaagaattcaaagtctgagtatcgtctccttactttcgataccctcttgtgaaaacttggcaagtttgtacggcatattatttcgtaatctgtaaacatccccttcgaatccatcccatttggtatatgagttttagggttgtgcacctcaatctctaaaaagttctcaggctcagcgtatatttcgctgtaactaggctctccatgtccttttgacagcaaagacttttctgtagacccaaaggatttgaattctcttggcatactttgtgtagatgcgtaccgcttctcagctgttcttgccgtcctcttttatgcagtattaagatccgttttaatccattcattcattgcaggtttacatatcaatacatatcacttagtacgtgatagtgcccaaagctatcctcgagttcacttatgcaattctgagcaccccatagccaagtcctcatagtaaatcatggtccctcctagcgcaatacttactagagtgtagaaatcccgaaatgtcaaaatcgaagagtgttgtgctcccttttccgtagttaaacttaaatttgcgtgggacggctcccttaagattgcttccggagattaagcttccttagctgctataataccgcgtaagcaaagaagaagaatagaggggaataggagataatgtaagagttgtgacgcatttgcagcatcaggattgtttactcgcataatgactgataggaatttctcaccacaacaaggacaaggacctcaagaatcgctcccggagggaccgcaacccagtacgatgattcagagagaggaaatgaatatgccaaggcaatattcagaacagcaacaactgcaagaaaacgaaggggaaggggaaaatacgaggctacctgtttctgaggaagagttccggatggtacaggagttgcaagctatccaggcgggccatgaccaagctaatctaccgccaagtggtcgaggatcgcttgaaggcgaagataatggaaacagcgacggcgcagacggagaaatggacgaggacgatgaagagtatgatgtgtttaggaacgttggtcagggattggtgggccactacaaggagataatgatccgttattggcaagaattaatcaacgagatcgagtctacgaatgaacctggttccgagcatcaagatgacttcaaatcacattccttaccatttgcgagaatccgcaaggtcatgaagacggatgaagatgtcaagatgattagtgcagaggcccccatcattttcgccaaagcctgtgagatctttattacagaactgactatgagagcttggtgcgtggcagaaaggaataaaagacgaactttgcagaaggcagatatcgcagaggccctgcaaaagagtgacatgtttgactttctcatcgatgttgtgcctagaagacctcttccacaatgagagagttaatggttatacagctgccatttgaccgtgcaccacagcaaattatctgttggaaaaagaaaaaacgcaaatttttttcattatttttttccagaataagtttggtagcaaattggcgatgagatatctaacaacgactactactactaccataggattgtctcgaatacattgtgttttgcagtcacactggtacttcgtcccttgggcaatctagatcactgtatatactatagatattgttttcagaagagaaaaactgttcatataaagtaattgtcagcaaagaaatcatgaaacatccgtatgaggaattccccacaggttccaagtcaccatataacatgtctagaggagctcatccaggcgccgttttgctatcaccacaatcttctgccataaacaagaacaatccgggcagcaattctggcaataaccagggcaattcatccgtgaccgcgaatgttttgtcccctcaatcccatagtatgtcactcaatgacatgcttgatcagcaatcctttatgctagacactgcgggaaccagggctcagccgctccagcaacaacagcagcagcaacaacagcaacagcaggcgtcgttgccttcccttaatattcaaacagtttcgtctacagcagctggttctgctatcgtttcccccatgatgcaatctccaaaggcgttgcaatctactttatcttcaacatctatgtatttggattcatttcagagatctccaaataatattttgggtattccatcgcagagtggttcaattcctttgccgcaatcccgtcaatcgcaacaacagtctcaatcccaaaaaaacgatccgaacatgggcaccaatttcagccaagacatcaaccaattatgttcttggatatccatgctgaacagcagccaacaaaatactgtaatggacaatatcctttccattttgaatgatgatgttttgaaatatactaagttaaaaatagagactttgacaaacactcccttcatctccccaccgctacctgcaattgcatcacctatacctaatagggatgacacacaaattttgaatattgattcagtcttttcttcaagtcctataactaatgaccctgaaaataccgataacttgttgtatcaaaattggtcccctcagccacattcaataccaattagccaacccatatatgacaacatcaccgacgctagtcaaaggtccaagtcggctgagcctcatgttaattcaagcccaaatctcattcctgtccagaaacaattcaacaacggtaacagtaccaaatataaaaagttgccatcagagaatcccaactatctttctcactctctctcaagttcccattcttttttccaaccaaagaaaaggtctaacatgggaaatgagtacaattctcatcaccatcattcattgcatcatcctctgcataataccacctcatatttttcgaatacttcaagaccatcaggaactgatttgaataagtccaaccagaacgtgttcaataataccattacgcatcctaatgctggtcctacaagtgccacatcgacatctacatcatctaacggaaacactcctttatcgagtaactcttcgatgaatccaaagagtttgacagaccccaagctactaaaaaatatacccatgtggttaaaatcgttaagactacacaagtattcagatgccttaagcggaaccccgtggatcgaattgatttacttagatgacgagactttagaaaaaaaaggcgttcttgccttgggtgcaaggagaaaattgttgaaggcttttggaatcgttattgattacaaagaacgtgatttaattgatagatctgcttattaaatctggcataataaagttgattgtcttgacgttgcataaagatttaatttttatttactttgcatataccaacacagggaacatatttcatttattttgtaattttaacgttttcttttatggagtttaatattttagattacacctgtttttgcaccgtttaatggcataaaactatttacttaacttttaactcgggaaatatgtatcactatactaaaaaacattaatttaatcaaagaaaaataaatttaatgtatgtatctatatatatatatatatatcacttaaaacagacaatagccataatcaactgggttattattatacaatattaaaggaagaacgcatatttgaaaaaaaaataaaatgggtaatgaattttagcacaaatacttcacaaaaggaaatatactagtagtaaatgtatatatttatatgtttatacaatgaatggtacaagaaattttgatattcttgctattgtggtttcttgtgtttcatccagtattctttattgattttgacattatcgcttaaaaattttaatcctgagaatttttgacttaatgcgttgaaaaatacttcagcaaacgtattaatgaaaaatatttgaccgtttggaatatgcggatggtctttgataatatcatcagggtctgttacgttcaccaaaatattttgaattgattccaaatcttctttcggagaatcaacattcttgtatgaatcgccaaaacagtcttgttctgggcggtgagctttatgaaatgtttccaaaagagcgcaatcattaaattcgagagtaatgaggtatgcccaacgtgctgatattgacaaggttctcgtcacattagagatgtctgcagctttaataattagagatatcaaagtgatttgtttcattgggttttcatgcattaatctatcctcatactgagaatgcaatgccatatctgtggccagaatagcctcggaaataaaatcaaatttttttttggagatagatagcaattgaggccaatgctctgatagcaattgttgaaataattccctgtgaaaattctccaagatagagacatttttgaaattttgagcaacctctgattcacagttgcacaatagttgattgttagtcccaggatgaccgacatcatgacctatggcagccatacacaacagtaatgtttgtacaggattatctttaagaagatatgtacacaatcgccatgtggcttgcatgacatcgatggcatgcctaaaattgtgaaatttgttaacttgatgataggatgattctaaagtaaatagtagtagcagtaacttattatctgcaatgagtacttttgcatccttagataactttttgataagcgtgaacccgcaccaaatcaattcttgagtgcttaatgataaagcacaaaagtcccaagttgatagaatgttccaataatgtgatccctcttgagaaattttttctattggatctgacaaaaaagacataaactcgatgttgcgaattagccttggcactgatgcctttcgtaaatgttgtgccttggaatcattcaaatgcaataataaagtgtaaatgtttgcttcacatgcttgagtggggacagaattcccatttacagtaccatagctgtttttgttaataccgtctggagtatcatcatgatggtgatacatccagtggttaattctcgttattctattacgacagatgctattttcacgctcaacacattcaagacgttgcaggttttcctctcgtgtatgatctatcgcagaaatattgaaagatgggaaaaatcgcttgaatagaacatccaattgtcgcacagataattgaaattttgaagggtcataaagaactatagatacgcccgtttcaaagttatggacgtttggaaaaggcgaaactctgtccttatacaatgctaccatcagagaatccaaatcttgaagctcaatcactctatcaaaatagtgttcattctgtacaattgtttgagatttctcaatctcgtgtattccaatcagaaaaagggtggacatatcaataggttatgttttcttcaattaagtagtagtgatctcaaaaagaatgtctggatactctaattagtggctaataaagcgtcagtgcaaaagataaagagggacaacaaaataatttaaaagaaaaacgcaaaatagtcggtaactcgtgctaaaaccagtaacgacagctaatatcaggaagatcccactttatctcaaatttgcgctttttagtccaatctctcacagtgactatagttttcaatttgcaagtatattctctctaagccaatttttcttctttataatgcctaaaacaaaaagaaaagaggaaaaattgtgcccagtaaaaagaaattctcggagaacaaaaaaagaaaagtgcaactagaaaaggacgcaggacccttttataattttgtacgaggagagcgacccctgcagattacaaagataatagagcctattgtagtatttatgaatattagactaattctcatacttatactagatattgttgttagtttacatacaagcccgtaagttcatgaaatttattcgaccttttcctttgtttcttccaaaacttcttcaactatctcttcgatggtggtaaagtcatcgctggcatcttctggttgaacgtcaaagattttgaaattcatagatttttccatttcttggccaattttttctctatattcggtccattgcttcaataattcacgttggtgtagaatcaaatctctcatggcggtgtcagcttccattgcatcttgctcttcgaattgggcagaccattccctcaagtttttcctaacctttttcctttcggcgttagacaaaatggaagctggccttggtctccaggcaaagttcttgaagccagcaatgatgtcttctttaactaagttaccagcaatattgaaaattttgtaaccatgctccaccttgtgtttcaaagaacttgaccatgcggtaacgtatctaccagatggatcccaagtgatattagtagccgcagagtaggtaggatgagcaacatctttcaaagaagctgaaacatcattattgtcattaatattcttttcacctggatagtccatatcgtaaaattgtaggtctgatctacgcatgtttggacccactaaagcacctacaaccacaaatctacccgctggagaccaagaaacagtgttggcaaaagtttttggaatttctttgaccaagctccatcttttaattacgtcagtcttttctttagtttctggagcgtaaaatctgattgtatttgctgggatagcataattcatatcagctacttcatgaacagaaattgtaacaaatctatttccgtggggttcccaaccgaattcaaagacactatctttcaattcaaccttttcaactggtatatctctttcagtcaacctacaaatttgtagattactgaattgagtcttaccagactttgtgtgacgttcgacattgaagcacaggaactcagcttggttttgccagtgcagagttacgttggagacttgaactaagttaacggtttttagcactctaccgcgaggaacttcagcaatggtagcagtacaagcggaattattagtctcaggagtccaataagccaataaaacagaaggctcgtcaccgtttctgaatggttgtaatttaacaccttctggagcaaatgagaaatctctaataccagaaggcttcaaagccttagcttctaatggcatgaagtttttagtagcatcgtgaactattaaactgtctccaaccatacgagcacaatatttatcattataagaccatctaactaaaggccatttcagatatgggctctttatcactgggaaagttgccatcaacagaccagaagcaatgtcccagatgcataattgatgaccctcatttttcttggtaaatggagagaattcgttatcttcttctacaatgattggttccgtggagaaagtgaccaggtacttttcattcggagagacggaagagtttcttacatctggatgatagaatcttctcaaacgatcgaagtttggaccaccccatgcagttacaccctgttgatggtaagaaaacaaataggtaccctttggggagaatctaacataattggtagaccagttctctctagattccaccaaagaatcttcttcattgaacatagagttccagaacacactagtcttcacgtcatcttgtaatacaaactgatctctcactttgtcgtccattaaccaggattttaaggaactagatggaacgaatgtaggcatatcaggctccctgaattcggtgtcaaagtcgtcagaattatatctttcaacatctttcatagtataaagaaacaaacgatgttttaaatccagtcttttaccgtggaaactcttgataatttttttagcatcgttcattgagccacattccacgaagagaaaacctttcgtcttaccagtggcttcatcaattggaaattccatgttaacaactttaccagctttggaaaacaaagaagtcaaagcctttttcaaaacaggaactttggcggatgggatgactggggcaccattaacgacgatgtactgatcgaaattgaattcttcagtgaccttgtattgttcttccaggtcggaaaaatcaatgtcgtcaacagggatgtcctctagcttaatgtcttcgaaagtctcggtagtcatttgaattatctttgaccttttgagctgtgtgttgcgagatactatactatgtactgagatgttattgaaatataattcgtaaatatttttcaatgtgcgtggaagaaaatttttcattagtttcccgctatccaaaatatggaaaggagggtaataggtgtcagaagaataaaagtattaggcgatcaagtaataatgataagatggtgcacaatgagaagtttatctagttacgtaaaatgtaatggaaggtactaaaatgtattttttgtttcgcggcgttacacgtgagttcatattatttcaactctttggttcttcttaacgtattatcagaatgtcacctattctaggtgaatatcaccctcttggtcagtggtagcgtttgcattcgtagccactggagcattttcatcatcactggacatgacgttatcactgtcatcttcgtcctcgtcatcatcgccgttaatttctttttgggcaaaatcgatagcttcctgtagcagatcgcccttaacgaacttgtgcagaccattcgtttccgacagtgaacaccaacttatttccaattcaaaatccttttccttgttatcctcgtgtgccaaatagataatctttgcagcttgtttaacggcctctcttgctgaaagaccttctggatgatggtcaactaatttttccaattcagccttcgcagattgcctacctttcccagtggcagcccccttgtagccccaataagagccacttggttccaacatgtaaagatgagcaccatttttatctacaccaccaaagatggtactgaccccgaacggtctaacactgttgtataaagtgtgcgcctgcacatattgtcctaaacggtctgcaaatgcaggaatgggaatgggcgttttatacagctttttgaagctggcggcttcttcacgaccacgattaaccaggtgcctaccatcaggaatcaaacctgaataaacgcaaccgatgtgacggtctacgacttgaatcttgacatttttttgtgggaccagcagtttagacgtaatgagcttttccactgcaaagactacaccgtcgttacactttataccgattgatgtggtaccgttttcgactgctttgacggcatactctacttggaaatttctaccatcgggggaaaaaacactattggaaagatcgtaaccagtaccaattgatgtcattgctgaagagttatgcttttgttaatttgatgatgcgacgctcgaatgtgtttgaaagctttacaactgcactaccaaataaaccctctaccgccactattaccacttactttcttatttttgccaccgatttagaggggcggcgaaatcttcgttaaacgtgatttagctatcggaacccattataaattgtgaggaagcttaccaactcataagtggaataaagacacaggcaacacttttcagaagcaatgtcagcaatgattcagaaaagtgaccccatcagggtcgaaatctgagtgctcagattatctcttcaaagggtaaattacgggtaggactacatatacagagaacttctgggacctgggaaatactgttctttctagtgtgtatacatgggaatagctgcatatttccagacagtttagatgttacctttgtttaaagttagagtatttttcacaccgatgattacgaagtcacacattcgcatcctgcggtattgtcattgacaacgcgtaaaaaaacatatacttaacggaggccgaaggagatgagaaacaattgaagaaaaggaaaggtaatatttatttaaatagtcgttttcaaaccaaagcccagcaatatttttcatcacgtctaattggcagggaaaatagtagtacgaatacttgataggattgcagaagatcttgtacataaatggcctattatagagagtcacgctgaacacgcggcggtagcttcaaatctttctctgcattaagttgctagagcttggtctgcccattatatgttcactaccatcagaaattgtgcctatgattgtctatcttcactttttttttttttttgaacttccaagctggtcgtgctgctatatttatttatacgtgtgatttcgtcttgctaacattaacatttttcttcttaaaacacacaacggcgaaatgattcgtatcacatgtttttctatcgtctgagctgtcaatgttttataacctagacattaaaagttatataattaaggtgggttcgtctttggaggaggtgcttccttcttgtttaggactttcatactggtaatgctttataagcacggccgttgttttagtttcagatcttcctattgtaaatggaataaactggcgttcctaccgtgatggcagcgatattacctaccttatatactgcgcttttaacttatgtataatatatatattaaataaaatacaaaacaaagtcttgaatttcttttctatctctgcaatagttgacattatttccagtcccaattcaatgcgctatcaaaaggcaccataatttacagtatattatttgagccatatctaagcggaaagctcacaagttcttgtcatgatacaacctgatagaataactatgtcgacactctaccgtattaggcgcaatgaagtggccgtatacatctcaggaaaactggaaaagacttcctagtcgttctggaaaagtaggtcataatcgaagaaatcaaggctaccaaaaatatcgggaacatccatggatatgtccaaagaagacatgggagggtcatagtagtttttaaaattactcggtaacttaacattgtcattgttattaatgttcgaaccactgttattgtagttattgtttatcggcataaagtttagattaggagcggcacggttactttcactcgaaccaattgacggaggcatgttttcctcattattttggttactaatattgtgtgctaagctataagtggaggcattaccaacatttgtagggtcatttgagctgctgtacggtggtacactctcattttccacgctggagttgagtaaaagttcaattgtgggtgtattatctttcatgtttggttttgatggattcagagaattttgtgggtcagcaacaccgatgttttttattctgtcaaattctttgatgatttggtataattgatcaagggtaaagttaacagtgagatttttgccctttagtctatcaattaaatggtcagacttgtccaagttaattccaagtgtcaactccaacattgtggcaatttttttggtagtcaagtctttgtctactttgacaaacaaaccagaaaataattgacctttcctcagcctttgaatgaatacgtcaaacaaggtcaacatcttgaaaatgtagaaatatttaaatctcaggttttgggacgcaagtaaatatacttccaacaaaagcctctcgaagttctccttgatagtgtccaatgactttattttctcctttatttctgggaggtcactaatgtcacctctggcattgcattcgttacatttgaccagaagcatatttttggccagctctacccgcatgatgatgaccaaaagggtaaacatcgtggtaggaacagccaattgaataacttttgtagtgatgaaacaaactaaagaagaaagaactttctcgtaactgccattgaaatacaggaaaaaaaatctgattagggaaatggtgtcggcacaacattgaaaaaaatacttatagaagaaggataagcattcgcttctctccattgcaagtgtttcaaaatataacatcagcgctattgaggcccttaacatcattaatttacccaagatctggcccgataaacttatagaattcaaaattgaattgaacgttagtttttgaaatgtcttctcttcgtcgtagatgttaatatccacacttcttagctgaaatttgttttttaaaagttcattggctttaacgcgtaaagtttctagtgtatccattggaaccgaaccactgtatgaaatggttatattattcaaatcagacaagaataatgctaattgagccctatggaaaaaaatctcatggatttcgagcagttgctcatccgattcggaacctgttagatccttcttaaccctttttttatagatttctacacaattgggatcccgaacgtcaatgaaaagatcaatcattgaaaggggtgagaccaatagtctacccttcaggcttgactccagagttgccatagagataattgatagccactgtatccttcgtaaatttagcagccttttgtctgaagcttcggggtggttcaaggctggaaagtcagatgggtcacgatgtaatccgatagacgtccctattagtatgacaaggttaattataacatccgacggttgttctaacagaaaatcaccctcagttggggaaaaaacaaatgcacaccagatatagagtaagcatgaaatggtattttcatttgcacaagcacaccaattttccgatgcaagtatctgctgcgctaggaaaattacttcgctttgaatcggatattgctctagcatctctttggtaatatacggactgtaatcttcaatcttatcttctataaatgtcaaagagatatacgcgatcctcaaaattaacagtaagatacacagattctccattttatttcgtataagggttgtgcccatcgatagtcgtacctctcctaattcattatactgtactgttgtgtgaattgattcctccaacatttccttgctggcgaaagggattaggtggaaaatatgctcaaagaaatgagagaggtactgttcaatgattgccttgggagggagcgttttctcgatttcattgatgtagcctttcaacaaatcagaatagtcgttttcggtggggcatgtatcctctaaatatgacgattccctgttactgtataataaagaaattactttatttaccgcaatctgttcttcagggttctttctctgtagtagcctgtccgtaaactcgttaatggattttctttgtgattcgtattttgagtttttcaatagaacctctctcatttttacaacgttattctttacgcatggctgtgtcctcgacctactaatatctgcatttaaagcaggaatcatggagtttctggaacaacttagaagcacggaggcaattaatgtcttcagaaaggtatcttgaaatattaagtacttctcagataaagggttgatttctcttttcatcactttggtcataatcaatctgggatgagtcttataaagacttattggaaagctattttcctgcaagcttttacatgtccttctagcagctaattcttcagtcggccttttcaatgcagtgtagaagtctttcttttcttgagtcaaatccacggttttatttctccagtaacgaatctcctttttcagtctcgctatggtggcatccttattcggattcctaggggccgcctgtctggcgacatcatatatacaaaagaggttttgtttagtacatctgccacatctaggtttttcctggtcacacttcgtctttgcttttctacaagcttggcaaacaaaagaaagtctattcctttttttacctactctattcattgccggtgatgattcgtctgtaaagtacatcttttatcgaagaaattttgttcagcaagatcagaaagtgatatttcatccgctctatacgtttcagtagattttctttatctgacctctattaagtcctaacaacgctttatgttttcttcgttggagatactccggagattatatttagttccgagatggtcttacaacctttcaaattccaaaatcagaagaaattttgcaggaaggcaaatcctaccggacgtattagtcacgattttatttattcacatatacagatattcacagttcgaattttgtttacaaaggtcaatcttattgatctgcggcttttgaataccgttgcattcaagaacggctttcttcatttcgtgcagttccgggaccgattcgtaaaccgcatcatcatccatttcacccttcaaaaaggatcgtctttgatcatcaataggtttgtatcttgtatcagggtgtttgtagtatattgccatcgtaaagcatatcaatatgaaaatgaagagatacaaagaaaacgctgcatttagaaaaaagaaaattagtcccataaaagaagacacagctatgggctgctgaaataagttactgaaaaataagaaaaaaaatgcgttcactaaattcagtgaatggatactaatattgaagaagttggttgttttatccatgtaaggttgcatccagcacaaaaggatgagatagatagcttcattcaaaaagataccaatagattgagattttccgtgcgcttgtagagaacccactagtatagacctaataagcatgtgtgcagaggtcgccattaaccaccagacttttgtagacttaaattgagaggaaagaaagccgaacttgtttaagaatttcgagctactgaagagtaaatagcttggctggccaaatattttcttagacttgatcatcttcctccatattcttacgcttgcggatgataacaagactgtaatcaaaatgaaaacaacgattgcctccactaaggtagctgctgagtctgtttgagtgaactcccaaagtgctaaaagagatatctcagaataaattatgaacaccgctcgatatagtgtcccctgtaaaagtgcactccaatgtgtgtggaagtgtaaatatctaattgtcttaactttaaacttctgaagtactttcaaaaatgttttgaagataataaacgccaatattatcatacaaatgaatatgataaagaaggaaaatcccgttaaaaagaaatttgatatctcaattccagctttgtaagacacccttttaatacctcttaatactaaaatttttgacagatagtcatttgaatttctcaaatttgaagtgtataataaatcatttttttgggaactttcaataccatttaaattacttgacgctgatatgattttactgttcaaggatcttttttgaacactgatcgataaaacttctttattgcggtatacaacggtgggggacccagatgttgcgacaacataccagtcaaataaccgctgcataaaatttatccttattattcccattgaccattggaaattttgagtccaagcggcgacaataggcggtaaaaatgatacactaatcatagctaaaatagccaaattttggaaatataaaagtagcgatattgaataagacgccagtcttgttgaagtaaccgtataaccttgcaaagaataaaccactgaaaacataattccggaaattgtcaatatcactagattccacgataaatactctgtttggactgttctaccatttgataacatcacttgtacacatgctagaggtttggtaaattctttatcaatagtggagtatgctgtcaccacaatatatgcgtctaagtcaggtatattatatgttatgcttggtatttggctagctaccgcggcctcaacataataacttcccatgagttctatatttcccggcttcaacggacataataaattatcttggattccacatagatcaaaaactttggtataaacattgagaccatatgcaatcaattctgccttgatggttatgttttcgctcataattgtttgtgcttcaacattaaagaatagagtattatttctcgggaaaaaagcagcttcgaaatacgatgcagaaaactgtgagtctttagcacaagtcaacagagccgaagtccttagatattctttagtatatgcatcaaatggtactgggaatagagtcgatgcgttgttcagtagtgtaaaagagttagaaacctggaaagtagagctgttaatggaaatagcgtgtatttgtcggaagattgctagcaaaacaaaaatccgagataaagagaagactttaatgggaagcatacttattctctttacatctataaatcagagaggttaaatattatttaaaatagcattacgactttgcttcatcatccttccaaaatattgacactgcatcattttttaaatgtgtcagtaattcgggcacaaaaatataaatggaccgccatgaactaaagctgtcgtcgatatggatcgctccatagcagcattataaaaattaaaaatgcatcaataccatgctacagtaataacaaaatacagcatggattaccactacatattcatcatgtcatgcattatagttgtaacatatgctgaacacccattcatcacgtgtaattggacatccgtggagttccaaaaggagtataaacgcaaatagtaaagctaagatataagtagtgtctaagtaaatgacttctttgtaagcgtacagctaaagtttaccgatgagttacgataagaaggcagatgtcacatccttagatgaagatttgagacaactaagagaaagcaaattttcaccggaagcaattcaaaatatcaaaatatgggtatataaatctgtcctaaaagagatagctcctcctggagacttattggaatgcttgaaagatggaacagtcctatgtaagctggcaaatattttatatgaagcagacacaggagaagctaaccatattagttggaagagctctaaaatgccatttgttcaaatggatcaaatttcccaatttttatcattttcgagaaaatatggtgtgcctgaagatgaactgtttcagacaattgatctttttgagaaaaaggatcctgccattgttttccaaacgttgaagtcactatctcgttacgccaacaaaaaacatacagatagatttccagttctaggaccacaactgtcaacaaagaagccaagacccccggttaagtctaaaccaaaacatctacaagatggtactggatggagcacttttgaatacggttatatgaaaggtgcatctcaggctactgaaggagtggtgttaggacaacggagagatatagtttagagaattattattaacactttctctggcagaaattgataaataaacatttaagaaccctatatacgcaaccaaagttcctttgatatattttagttttccatcaaagttttcctacataaacactaaggtggctagagacgcgtaacaaaagttaacgttaccggtaaaaatgtgattatacaaatcaatctcacagaacggtgtggaaacaaagtagttgaaggatttcaactatgcgaatcaacagtgagctagcgaacaagttttctgcctcaacggtgcacttagaacatatcacaactgctttaagttgtttaacaccttttggttctaaagacgatgtgcttatattcattgatgctgatgggctgtcatttgtcagggagaataatcatgtgataaaaatccaactactgttatctcgggagctatttatgtcttattcgtatagaaatgaaactgaggatcacatgaaactttgtgtaaaaataaatcatatcttagatagcgttagcgtgatgaacaggaattcggatgacattgttgagtgtactttatcttatgatggacatggatcaccatttgtactaatatttgaagactcgttcatttctgagagagtggagtactctacctacttaattaaggattttgatactaatggactagaactcgatagagaaaggataagctttgaggcaattattaagggcgaagcccttcattcagccttaaaggatctaaaagaaatcggatgcaaagagtgctatgtatatgcaaagaccgaggcgaatgatgagaatgtatttgccctgatatctaaatctcagctaggattttctaaaataaaattacccagtaacagatccatactagagaagttacaagtatttgacggagattccacaacagtaatagatggttttgctgtaattgggttcttcgatttcacctcgtttgataaaatcagaaagagtactaaaattgcaagcaaagtccttttcaggatggatgttcatggcgtattgagtgtaaatattctaagtcaaacagacgatgtcattatcactgatactacaagaccttcaaataatcgaccaggtagtattcgccaactgcagctacccaaggattatcccggtatagtaattgaggtttgcatgctagaaaaagaatccatagatgaggcagcacagacagaaatagaactcctgatggagactaatgaacttggcaatcgtaatagttttaaaaaatcaactataagaaaaagatatggtacagataaaggcaatgaaacttcaaatgacaacttgctgcaattgaatgggaaaaaaattaaactaccatctgaagaagaaaacaataaaaacagggaaagtgaggatgaagagaatcactgcaagtatccaacaaaggatattcctatatttttttaagtcaatatccagcatcgcagaaaacgcagaacttcattcagcatttggtaattttataacatataacttacaattaaataaaagtttaactatatattattatgtgatctaactctagaaaaagtactaatgaacatcacaccgtttattgttgggagaagtgttccatgatcatggacaattcatcagtttcagcaccccagttcttgacaacaacaacggaggcaccgacaacctttctggcgttaccttcacggtcgatcttacccaaaccagcccattcacctaattgcttagcatcagcaaccttgatcaatggaaccttgttttctgggtcgttagccaaaccttcaaccaacttgataatgttagcttcagtaacagagctgaccaaaacaaccaataaagcttcacctctggttaaagccttggtagattctctcaaacctctagctagaccatcgtgaaccaaagcggttctcaaaacaaccttcaaagcatcttcgatagtaacttcggcagtttgttcaacaacagtttcttcttgaacttcaacgacttcttcaacgtcagacatttttcttctcaataatatatagtctagtttttgacttcttcgacagtaagataattaaactgctccgtgaagagttttgaattgggaaaaacaattgaacaaggaacacttatagacctgttgtgataagagatgacataacttttataatatgtcctgcggagaattcgatgaaattttgcaaattgtaagtttgcttgaaagtttgcttgcgggtaaggtattctgaaaaaaataaaatgattccacaatggaaatgtgaagatgttgtaaacaaatcaaatgtacggatgcacaatggtaaacagtactggatttctttttatatcaccgttgagccgaaacaaaccccgaaataaccatttaatatgccaagatgtacaaacctcgtctttgcttattcaactgctacattcgcaatacctcaataacgaggtgcgtatatacatgaagcagaatttttttttacatatatatactattcattaacttgtaagaagacattaatcaccgtttcctgaagggaaaaaaatactaaatagaatatgtcttgctcgtcatatctccatttcacctacaaattcaccggaaccttccatattgacatcgtcgtcatcgtctatggcattttcaaattgttccgcattagcaacgccgctagcctgtatttcatcctcatcttcaaaatctaaatcgaagaagtcatcatcactgccaactatcttttcgtataaaactttggctgcggtgactacttcatcatacgatatctcagcagaaggcatggttgtatatatgacgccattatcactcgcaccgggaatatactttttttccaaatcttgatttacatcaaagaaggaggagttaactacaccaaagggtggcgtggatgtgtattgggtataataaagtttaaataagaactgtaatctttccctaggaacatactccttaaaagattggcctaacttaactgaatttactattgtatgaccatttcccgttagttgaacaatttcttcgtcgttctctaaacctgaagacgattcccttagcagggccatttccatagcttctagagcggcatcaatgtccatttcagcacgtgggccttgttctgtggtcgataaataccatacaatagttccttctggacaaatttcgctgccagcaccgagaataaaggcttgtactacttccttattaccagatttcaaagagccaggagggaagactaccatggcggccgattcaccctcattgaaccattcagtacaggggttttcaactatacaggtcaaacgatgaacctggtactgttgttgagggacatgcttactgtctttaggtgcttgcgtaggcgatattatcactttctctgaaacttcaactttggatccatcttggaatgtggccactttagttgtagggttgaaggataccaatttctcattgagtttgtaagtagcgccacctacagcggcagatctacaaaacccttgcgacaattctcctggcccaccatacttggagcatagtgcagggaatggtccataaacatcgaaactagttagatatcgacgaatcctttgtaaagcttctggtacttttacgttgagatcataacataacccaattgagaagattaattcgaagacttgtggtttttctaatttaaacttttcccctaaaaaatcagacatggtcctctccgcgtagggttgccatatttccgtttgtgcttcccagttgagtacgaatttgataaatttcattaagttcctctttgtcattagtggtaggttttgatccgtgaatatttcttgctttgtatttgttagtttttcgaaacaatcattttcataagtatggaaattagataaagattggaattctaaatactggtgaactcttgatttgattaagatggataataaatcagattttgcaaataggatcttcggggaaagatcaataccgaaatctcttgaagaatatttaccactaccgattagcgtggatacatacaacttcgcatttttatagcaacttactgagccttcattaacttcatttacccatcttttgatttggtctacagttagtgtggctgaagtgtcaccgtaataatcattcttatcaatatgaaggacattggaaccttgccaagctaatgcagcagccaatacactctctaccataccagtccctgcgattaaaacatcaactttatctggtgtagtggctggcaaagggtcttcaataccggctaaatgcgggacaactagaggacttggattttgagtaaaactgaaaaatgatgggcggcgttctgccatggatggtctacgttcaggacttaacataactttttttcggtcaatattagtcttcctttttttatttgtattatagaaactgaaatgttgctgttaaacccttaaaaaaacagtaataaattaaacttaaatgtttatatccgaaggcagtatcctagtgtcttttagtttattatcgcaatgtgatagtttatctttcaataatgatggaacggaataaaaatttttcttgtactgattgaatttagttgcgaattaaccgtacgcacaatcagtgtatattacttctgtaaaatcaaatgtgcaacaacttttgaatatatttaatgacgggaaaagaacacgggaaacgctactattgttgtatagtgcgatatagaacctttttttatcttcttcacttgttctgttttctttttttttttttttttttttttcaagttccacgaaaaaattttctcgttttcctttagtcactcttgtcacataaggattatccgaaccccgccccgcggaattaattagttggctagattcatgcttggtagaatgaattgtaagacagctcctctcaagtaaaggctcgaaatgtcttcgcgaccggctactacacctcctattaaggtcatggttcctttgaccagttctatagtacctgcgacggccaatacttggtggggtgtgccgacatgaggatccataatgacagattctttagtatctccatcatttcgtattagcttgcaaccttgaaggcattgtgtatttaaatccacgacatttataacgccacttccgagtggaacacccgatattacttcttcaggaagagtttcgtcccggtatattcggtcaacatcaccttgtcgtagacccccgataagcacaaccttgtggcctacagttgtcattgagtgtcctaccatacataagttgataggtaccaaaccatcagattcctcttgtgttttggcataaaggtctattttagtccaggtttcggaatcgaagtcaaaccaccacatatcgctgcaaacgtcatagccatctgaacctccgtggaacgcaatagttcttccgattgatgcacatttttttgatggattcaatggtggtgtatgtttagggcttgtgggaggactggatgtggtattcctggtagactttgaagaagtgtcttcactagtactattattagaattggaaatatgcatactatcgcgaccactcttcttctccttccttgaatgtgggatattcggaaaaagtggttgagaaggcttatttcctgggcgtatttccaaatcgatggagaagtcatttttcaagttcctcagtaatctcgtttctatgggttcaacatccttggtaaaataatctggtacacagcacgctgaaaaggctcttctgctcggccataattctggatcatcaataatagggatcttagtagcagttacagtatctgcaaatttataataattacgtttcccacgagaaactacagggatatttatcttccacatgtcattcatagcttcatacttgtcgtcaccagtctgactataccctccaaagatcagaatggtattaacagatgagcaaatgtgtgttgctgtgctacaatgtttggaagagagactatctgtagaccttgggtttgttacaggtggaattgcatcatcctctaaatagtccgtacttcctggtgaaccaaccaaatcatctattttgtgatccccattaccttggcgatatgggcttatcgaccttcttcctttcgcacttgttgtggtattttcattggatacattgttgttggaattacttattgatgcctgcatgtgaccaaatcttggcgagaaattattgtaaattgcaaactggtacggaggagcgactaattcaatctttgagaaattgaacgtcactgtatctagaatgtaaccagtattgttcaaaaaagctctttttcttataaaatatcttcccttatcatcaacttgggtttccgacttgatttcaaacccgccatacaaaaagatatgcctttcagttaatttacagccctgggtgcacaccagtgggggcggaatgtaaccagaaatatcaggtcttgttagtctggaagaagtcaaggaaaaacagtacaagtgaggattaggaatcatggatgggttattaattagctctggtattagtggtggcggtaaattctttatgccatccacgtaaaaatcctttagatcaggcgcttcctcatcatatctatgacatgccatcaaaccaccgacaataaataattggtcgttcaactcgacagaacaatgatatgaaagggatggaagtttatattctgaaaatattgaagcgattacagaagaacccgaaaaagtgtcataacttctaggaacacagtctgtaccattgataaagagtggacatgtcttgttcttgaaaatgtctaaatctgattccgagaatgttggaatcggcgttgttaaccttacatcttccggtttcgaacttgatactaataaaaatctaaatcttctagtgatcattggcatccataaattatgcctttttaaaacatcactgtcccttaggtctaccgtcaaaagctttttataatacttaaagtacgatattgtcgaacgtgagcgaagaatttccaatctttctgacgaataatggaaagcaccatggcacttggcattacactcgtcgtcagtattatcttcaaaatcgtatatatcatctttgctcttacgttcatcatcgaggttctccatattcaaggcagtgtttctatttcttactgtcattttcagcgtatatggatctacctcatttacgcaattactgacgaaatcgttcaaaaaacagtaggtctttgttctctcagtgaagcctgtagaagaatcagaagaactgattacacttccttgcctaaagctggtaaaagtaaaaggttttcttgattcataatattttttcagtaaggcttcattttcttttctaatcctagagtcaatattgtcgcttaacgcttggtcgaaaacagaaacataatttgaaatatactttaatgaatcgtattgctccctgtagtgagacctttcctctttactgagtttgatatgaacagctggctgaatgtgtaagggatgagcttctagactgtgcgatccgaatgtgcttgcttgaggcattcttatgtagaagaattggtacggaaagccttaaagtagccgatatagggaggtcggctcaatttttgagttaaagaaagtgctgcttttgcaagattcttctcctttcctttaaaaatgccgatttcgactcgatatgtgacttatgtgatgggcaccataccatactaacagccatgtcataataatgaaattatacgccggggaattgcttttatgggatacccggaaattagagggaatatcgtaaaatctggcagtaacatcaattaatgatacttataataaattgattgaaaatagttacctatttacctaatcatatgtatatagtttaaactccttaatatatatgaacatcctgacgaacaatatgaaaccacagaatagtagtaaagaaaagaaaaaatgatgattatgaaataaaatgtaaaaaatgtcctcgattgatgtatgtattcttcgtgccataaatttgtgatcgttcttttttgtttttaagatattttcaaaatgttgtgtaataaaaaatgttgaatgggatgaaacaagactaagcgaaggagagaaaaatgcttgaaatttcgattaaaaaaaaaaggtgagatgcaagtttggttaatattactgtgaattgaataaatttccattagatttagaattacagcttttccttgcttgtgatttcgatccggaatcagaaagtaaagactgtgatcttttgagtttacttgctcttttctttgttacgtttgaatttgaattccctgcactcgaacttgcattcaatgatgatgataaagatgacgatgatgtatcctggttaaattgatcaatatttgccacaataatttgaaatttggaaggtttcttcccattttttttgattcgaccctttgaattattattgcctgatttgctcttaaaagaaactgtgtttgaacttgaaattggattgattcccgtatcacttctaaaagaccccatcttgggtagctcaggaatttgtaaggcagatgtacctgtggttgtactatgcaaagaattacaatttggtgttggtgataaaggtaatcttgtcaaccccaaatcaaacaattggtcatccacattggaatccagaatgttatctgatctcgaagctaacaagggaattctagagttatccaatttggagatagatttagttattgatgaatttaattggatggtagtcggtgaagagccgtatatgtcctgtttattttcgttgtccttagttagtgtgctagtgctattgatggtatcctggggggttttaataaataattttttattgttagatcttagcggcgttctctgtaagatgttgttggcattttccagccctatggatgttgcattagtggtaatatcctttcttgccttctgaaaatccactaacgcgctgttagacgatatcaatgcttttgcataaggtgtaccgacgtcattcagaatttttcttccatatggtgtcaacgacagggaggagaacctttttgatggagatgtcggcagcggttgattgaacatgagattcatgtcaatcttactcagaggagtgcgtgaaaatgcgccggtgcatgaagatgagggtgtttttccattactcttcaaaagattgttcaaatcgacattgctaaaaacattctgttgttgacctgggttctctgtggtgctttgctgagcaccgttagaatctgttacaaatcgaagtggtgtctttgccggagttttgtgaaagaaattgaaattggtggacggagagtccaacaaaaattctttgaattgctctggggatgcaaccaaaaattcgctgggtaaagagttgccgaactgcaaaacagaagaaggttgaacgttgatatcgtccaaagtctcacttgtatctgtccttgtgacagcaggaggtacaagtgaacctagagcttgctgttgttgttgttgttgttgttgttgttgttgttgctgttgtatctgctgatgatgcggtaatatactgttctctaccaacgacgattcgttgctcgaactgttgtgagcgtctgtattggcaaaatgatcttgagtctgttgatactgattagaagaatagggcgtggggaattgagtcgttgtaggtaacggactgttaaaattatatttgaattctgacattaccttcaaaaaatttgtatctgcattattgtccgtagagggctgtcttgaggaagttgcagttgccccagttgaggtataattttgctggtagcttatatctctgtccatagttggaatcaatgctctattctgaccaatttattccaatttggacactttttccacccacaatgccgatgccaaatattcagaagatccttgcagctccttaaggctctgtcctatttgttttgttttgttcttgttttgttgttttttttttttgcgtcccgtttcttttcgcgaggagggttacgccaaacgccaaaaggcttatgcgggtagtgacctaaacttgtttactggaatgctattaacgatgcacaacagataatgaataaatacagatgagtatctaggatgccagaagtgttcaacaatattcaggtgaaaaaattgccgactaggttgaatagtaaaagcataccgaaatggatatggatacgcaggaggcagaactatcgagccagctggagaatcttacaataaattcaccacgaaagctacgctcgaacgcgcacagtaacagtggtaaagtgtttaaggaatatgaaagtaaccacgattttcaagattcaaattttacttcccaagttgtggaacctgcaatatccgattctgtcaaaaaacctcctacaatgacagttttgaacaactatagcacggtgcatcagaaagtgccgtcaggtttttcaggcacgactgctacatctcatcaagaagctcaatggaagcagtatttccctggtattggtagcggcggtggtaccaactttggtggcgctgttggtactgcaaacaaagttcctgaatcggatctcattgtgagcgacttggttaaggatttatctggagttcttgaaacaaatacatttaaaagacatttagatatgaagaataaaactactactatgcagacccatgaaaaccatgatacgattagtatttcacattctaaagatttctttaacgctgagaaggtctcatcgtcgttttctgatgacagcgattctggcccagcagctgaggcacatgatgtatttgatggcatattacaaaagcaaaaatcgaattatttggtgggttcttatccaagtaatagcaacaacaaaaacaataataataataataataataataataataatagtattaatattaataataaggataacgctagaacgaaggaggaggacgaagaggacacttccaattcttttgaattttcatcatcgtcatccatgtcgtcctctcaaactcaatcaggcagaaaatcaaaagttctcaagaaacctccattgaacactatttcacccggtcaattgggatatcagtttaaccatacacacggcgcatgggatccgccgctgaaccagggcttagatgtgtcgagttcacattctctggacaatacatcttccaaccagtcccagttcgccacaatggtaccaactggagataatcacactaacggtaaggcaccttcaattctagataagaaggcgtatgaattaaccagtaccaaaccaggtgatgttggctaccgccaaaagaaaatacaagaagaagaaaatctagcaaatagcgatgacacgcccctagacacaccaaaatttaatgacctttttacgaaaaatggcactagagcgaaggttaaaggacaaatgcgtacctctcgttcaatctctaattccaatctactagaagctcacaagaaactaaagaccttccccgctgaacgggttgaagatattacgtccatttccgaagtaaacacctcgttcaacgaaactgaaaagcagctaatatcaatcttgactagtaaactatctggttctccaagctatgattccgattgggaaaaaatcctgaaagttgacctatcaaggggcaaactgaagaatatgtttggcatgcaaagactactaccgaatgtattagtgctaaaccttagtgacaatgaaatgaacactctagaaggtataccctcgaacgttgtacagctattttgttcaaacaacaaaataacgagcgcacattgttcattagccggattccacgatctggaatgcctcgacttatcgtacaacctcttgaatacaagtttaaaatttttgtcactttgtcatcacctgcaagaggtgaacctttcttacaactccatccaatccttagaagggataggatcctccaggatgaaaaaactgaacctttctaacaacgagattaatggtatcatcgatttcgaacaattgatactaacaaacaactctgtcgtgggcggctggttgaccgtggaagtcttagatctaagcaacaataacataattggcgtaagaaacatcaattgcttgccccgcctgaaggttttaaacctcaatggtaacccgctagtttccatcgtggaatcttctaagatggagaacggaacgttgagagcgctttccatcaaaaatacaggaggcgcgctatccaaattacaaaattacaagttggatgatcaattcacgttcccctaccaaaatctaaagattctaaaactggacggcttcgctcaacttagcaaatggcaaaaatggcctgccactttgcaaattctggagatcaacggcggcctggcctcctctttgccgcgattctcttctctaaaatccaccaacttatattctctaactatagctaatgttagagacttcacacacttaccagtggacctctccaaggaactaccgttcttgcaagagctacatctgccaggcaacaacctacaaaacgcacacaagttaacaaaaactctcccacgccaatcagtaaaatttcttgatctacgaaataacccaatcacgacaccacgccacgatcgcgccagcacgagcttgcattaccggcagttgctccagcttgctggcctctgccagcagcaatgtcccgccctggcgaccctctggttagatgacactcctgccccaactgccacgaatctgtaaccccataactatacccgtacgcagtactaaaaatgtatgtaattagtaaatgtatgtaacaatttcaccgttttgtgtaacaattcattcattcattcttttgatcctttagtaccgtccgcacatgatgtcatttccccctcatttttgtttgctggtatgattccccgcccgggcgacggtacggctgttatccagcgatgcgggacttccgtccacaggtatctttttctccaactccaacagagatggaaaatgaggggcgggtgtaggtaagcagaatgaggagaaatttgtaatgaaaatggaagttcggcggttatataaatggggggggtttgtcggtgacaattgacttcactctcctttcctcaaaaattcttgggtgttaggattagaagtatctggaaaaccaaccaagaaaactacaataacaaaaataaataaagcatgttcagtagatctacgctctgcttaaagacgtctgcatcctccattgggagacttcaattgagatatttctcacaccttcctatgacagtgcctatcaagctgcccaatgggttggaatatgagcaaccaacggggttgttcatcaacaacaagtttgttccttctaaacagaacaagaccttcgaagtcattaacccttccacggaagaagaaatatgtcatatttatgaaggtagagaggacgatgtggaagaggccgtgcaggccgccgaccgtgccttctctaatgggtcttggaacggtatcgaccctattgacaggggtaaggctttgtacaggttagccgaattaattgaacaggacaaggatgtcattgcttccatcgagactttggataacggtaaagctatctcttcctcgagaggagatgttgatttagtcatcaactatttgaaatcttctgctggctttgctgataaaattgatggtagaatgattgatactggtagaacccatttttcttacactaagagacagcctttgggtgtttgtgggcagattattccttggaatttcccactgttgatgtgggcctggaagattgcccctgctttggtcaccggtaacaccgtcgtgttgaagactgccgaatccaccccattgtccgctttgtatgtgtctaaatacatcccacaggcgggtattccacctggtgtgatcaacattgtatccgggtttggtaagattgtgggtgaggccattacaaaccatccaaaaatcaaaaaggttgccttcacagggtccacggctacgggtagacacatttaccagtccgcagccgcaggcttgaaaaaagtgactttggagctgggtggtaaatcaccaaacattgtcttcgcggacgccgagttgaaaaaagccgtgcaaaacattatccttggtatctactacaattctggtgaggtctgttgtgcgggttcaagggtgtatgttgaagaatctatttacgacaaattcattgaagagttcaaagccgcttctgaatccatcaaggtgggcgacccattcgatgaatctactttccaaggtgcacaaacctctcaaatgcaactaaacaaaatcttgaaatacgttgacattggtaagaatgaaggtgctactttgattaccggtggtgaaagattaggtagcaagggttacttcattaagccaactgtctttggtgacgttaaggaagacatgagaattgtcaaagaggaaatctttggccctgttgtcactgtaaccaaattcaaatctgccgacgaagtcattaacatggcgaacgattctgaatacgggttggctgctggtattcacacctctaatattaataccgccttaaaagtggctgatagagttaatgcgggtacggtctggataaacacttataacgatttccaccacgcagttcctttcggtgggttcaatgcatctggtttgggcagggaaatgtctgttgatgctttacaaaactacttgcaagttaaagcggtccgtgccaaattggacgagtaaggtcatcaataagcctggtgtccaatcgatgcttacatacataaaattaaatattctgtctctgttatatttccacatgtcatcatttcaaatatatgtactttaaagaaaataaaataaaaaataaaatttttttctcccgataatcaattttcttaattaattaattgcgttacgattccgtttttttacttcttttatctcattatctatctaagttatttaaaaaaaagaaagaactttttatgaactttcctcttttctttcttttagactatttaaaatacatcaccttggtcaaacatagcatcagagaccttgatgaaacttgcgatattagcacctttgaccaaagatggcaagaccttaccgtccttagtgtacttcttggcatagtcgatacattcattgaaacagttgatcataattctcttcaactcttggtcaactctttcgctagtccatgtgattctttgagagttttgtgccatttctaaaccagaaacagcaacaccacccaagttagcagcctttggtggaccgtaccaaacagcttcgcttggtccagtggcggtggaacgagcagtttcaaagacggcaatagcttctggagtggaacccatgttggaaccttcggcaataaacttgacaccttgagcaaccaaggccttggcttcttcaccgctgacttcattttgggtggcacatggcaaagcaatgtcgaccttttggacgtgggtccatggacgagcaccagcaatgtattgcactttgttttcggagaaagtagagtattcgttgacgatttgttccaaggacttgaagttgaccttagcactggaaatatcagcgacttgttcggaggtgataccagtttcagagatgatacaacccttggagtcagatagggaaacgacagtaccacctagctcaataaccttcaaggcagcgtattgagcaacgttaccactaccagagatggtgacgcgcttaccttcgaaagattccttaccgtttgtggcatagtcgatcatagcttgagtatagtaaactaaaccgtaaccagtggcttctggtctgatcaaagaaccaccccagttcaaacccttaccggttaagacaccttcccaggagttcttgtatgatctgtaagcaccgaacaggtaaccaatttcacgaccaccaacaccgatatcaccagctggcacgtcagtgtcttgaccaatgtgtctgctcaattctctcatgaaagcataacagattcttctgatttcgttattagatcttcccttcaagtccacacatagaccacctttaccaccacccatgtctaggccggtcaaggagttcttgaagatttgttcgaaacccaagaatttcaagatagacaagttcacggaaggatggaaacgtagaccacccttgtatggacccttggcggagttatattgcactctgtaaccttgagcaacttcttgttcacccttgtcattttcccaggtgactctgaattgtatgattctttctggaacagaaacaattggcaaaacctttctgtattctgggtgttgttcgaaaagagtagagtcttccaaagaggagacaacttcttcgtaagcttgttgaaattctggctctgacatttctttttctttttggtctcctaactgttatattagaataatgcgatagtacgtatcaagcaactttcaatgctataagaaaagtcatttaaagagtgagagaatataaaatgggtaaacgcatttgtaactctcgtatattttatatatgaaaaacagaaaattttccaatcttctcttacttagattacgtatactttgctttaacaagaagccggcctttgctgctacttcttacgctttcttcttccgcaatttttcagtgctgattttcattatggtacctgatgaaaaagaaaacggcgcagcagctgataacagcttctctctgctgattggacgtggggtcgtactatttcttttttattgccccaccgcactgaaaatgcatgggccggttccggcgcattggttctgcgataagaatatcgaggccatccaatcagatggtcagataaggttattaagatcaggcccgtttccatggagtcatggaacctgcataaggggagcctgatacactagagaataatgacctgagtggatgtagcatcatattccttatgaaatcctcttatccagccaatcgtaaacgatgccctcccccacgttattgttgtataattcaggttatgcccagatgcggagtggtgcccagatcgactcgaacgcatggtcttctaggactctttatcgcagccccatgaagcagtgccactttatactgaatggagttactaatatggtttggctcggttggtatactggccacagcccgctagaataattcaagaaaaaaagccaatgctggacagaatcactgtagagtttagcggacttgaacctaaagaagttcatctccttcttgtcgggagcttcggtgtgctagtttgttactgtcgaagagtccatcattaagagaagttttcgaagcttctgtcgctgaactactgtatgcgagattacactttacagaataacttgggaagctgtcattcttggtagaatatgaaggctttgagtgctgatctaagatcagcttacgcaaagtttcttgcacttacgcgattggagccgacggcttggtaaaaattttcgaaattgcaggttcttgaagcagagattgttccgaagaaacttggtttccaatcagatagagaagtgggctttctggtcatgccacgcaagttacaagcgcggaattgctaccactttacgtctttcttcatgttcctcggacgtttccaatcattagccgttcctctagacatctacagatctattcctaatcacaacctatctctagccgcaagatatatctgtgtgagaggggtcgcaacaggaataccttaaatgggataaccgtcacgtgactctcactaggggcatcaagtgcgctgcttcttcaaggttttcgcgccctgtttgaagaagtggcacagaatccatagagtaatattactaacgagctacgaaacttagcttacctattaaatactcaaagaaaatacgctgtgtatgcttttgcggcacatctatgtcattaaatctctccatggcgcgtatattttatgacgggaaatctgaggccgatcgaggagggaaattactagaaaagcttatccttctttacctccgaacaaattttaaaatatacctcaatgggaataaagaatgcaaggaaaggcaaggttcagcctatgatgatgaatatcgtactctaaaattatagatatctaactgtgggcgtattaaaccttgctttggtcattatccaatcgtgtatgcagagagcggggcgatatgcagcaaacaaaaggggcgaaataatagttactccaaagatgaaatggcagaagaaaatggaaaactatacagtttgcgaaggaggcatcctcttagttaaaaaaaaatttggactcattgcactgcaaacagagtttctaggattgtcatattttgtacctcctggaatgttaagactttctcattaataatggtgtgatacacttatagttgggtgctaaaaggtaactgcaagccccacatctataatattaccgttaagtttccggcgaatagtttctcttttcgcccctctatttctcccttcaaatgtgaagataaggaggacagccataaatattcctgtaatgacattccatcttgggtggacaattttatggtataatcaagcgtatttagaagtttgggcgacagtatttcaagacgagatgcataagtattctcttcatcctcaatcccgcgatgctaaaacaaagttttgttgttgcattccatttaagtagagcaaaagcgtggcaaatctgaaaaattgccacatagggtgctaaatttggtataatggcacaaataaacaatctcagtttactgacagtgaactacaggaatatacaattttgaggtgttaacgaccaaccgttaatagcttattctctcatatgttataccactgtaggaagaggtggtttcaactgtattttgagcacaggtagatataagctctggacagttttgctaccccttgaaagaattcaacagtattttctgaggtactcatcgtaaaagattgctaattttggtcgcgatgtatataggtaaaggagtatttcctaaaagttgccaaagattatcaaaatattaccgtgtttataaaataaactgacacccggataattaagaagtggtaagcttatgttagagtacttgtacttgacaagtaaaatcagaattgggaattatcaattgagatcacgtgcaaaccgaagaaatgcaaagaagtaaggttagggtttatggacccaggcagcagaaaattgtagcttcatttgttggcacaggactattccacccttagaattgactttttggacattgagctaaggttcaatgcactcgatggtcttctcacttccgaatatatagatctagcgtgtgaggactactcattggcttgcgatttacggtttttatattttttgccgcacatcattttttggcctggtattgtcatcgcgttgagcggactctgaatataatcctattgttttttatggatctctggaagcgtctttttgaagccaacccaacaaaaattcgagacaagaaaataaaaaacggcacttcatcagtatcacaaataccatcaatttatcagctctcatgaatgaaatcgatgagaaaaatcaggcccccgtgcaacaagaatgcctgaaagagatgattcagaatgggcatgctcggcgtatgggatctgttgaagatctgtatgttgctctcaacagacaaaacttatatcgaaacttctgcacatatggagaattgagtgattactgtactagggatcagctcacattagctttgagggaaatctgcctgaaaaatccaactcttttacatattgttctaccaacaagatggccaaatcatgaaaattattatcgcagttccgaatactattcacggccacatccagtgcatgattatatttcagtattacaagaattgaaactgagtggtgtggttctcaatgaacaacctgagtacagtgcagtaatgaagcaaatattagaagaattcaaaaatagtaagggttcctatactgcaaaaatttttaaacttactaccactttgactattccttactttggaccaacaggaccgagttggcggctaatttgtcttccagaagagcacacagaaaagtggaaaaaatttatctttgtatctaatcattgcatgtctgatggtcggtcttcgatccacttttttcatgatttaagagacgaattaaataatattaaaactccaccaaaaaaattagattacattttcaagtacgaggaggattaccaattattgaggaaacttccagaaccgatcgaaaaggtgatagactttagaccaccgtacttgtttattccgaagtcacttctttcgggtttcatctacaatcatttgagattttcttcaaaaggtgtctgtatgagaatggatgatgtggaaaaaaccgatgatgttgtcaccgagatcatcaatatttcaccaacagaatttcaagcgattaaagcaaatattaaatcaaatatccaaggtaagtgtactatcactccgtttttacatgtttgttggtttgtatctcttcataaatggggtaaatttttcaaaccattgaacttcgaatggcttacggatatttttatccccgcagattgccgctcacaactaccagatgatgatgaaatgagacagatgtacagatatggcgctaacgttggatttattgacttcaccccctggataagcgaatttgacatgaatgataacaaagaaaatttttggccacttattgagcactaccatgaagtaatttcggaagctttaagaaataaaaagcatctccatggcttagggttcaatatacaaggcttcgttcaaaaatatgtgaacattgacaaggtaatgtgcgatcgtgccatcgggaaaagacgcggaggtacattgttaagcaatgtaggtctgtttaatcagttagaggagcccgatgccaaatattctatatgcgatttggcatttggccaatttcaaggatcctggcaccaagcattttccttgggtgtttgttcgactaatgtaaaggggatgaatattgttgttgcttcaacaaagaatgttgttggtagtcaagaatctctcgaagagctttgctccatttacaaagctctccttttaggcccttagatctcacatgatgcttgactgatattattcgacaatatgattatgtcgtgtaaataacccactttcatgttgtcactccctcggctttggttggttaaagggacttatcggtttctttttttagagttgatttaagatcagatcgaagtaaataacgtgcagaacattgcatatgatagataacaacctatagtatatatttcaaaatcgcgacaaatctgaaatattaattgatttgattagctgcagagatcttctcgatgtaaggagctatttaaatagaaagggtcagaatcgtcgtcctgtgggagctggtatatactaaattgatgaacaactaaaatagcactctcattgtcattttgggtgtgagaccttaagcaaggagagatatttttaatggatgtattagcgcagccgttgcttacggtattccttggcatattgtccctgaaaaaaaaccgttgtacactcggatacgcatttttcggacttctcccacccaagaaacgcaacttttgaagggcgcctacaccactagaccaacaaggccaatgcaaagctacaaacaaatgcgtgggcgcatgggcataaggaggtgtaaaaagctttttttttttatgtgaggaattacaggcggaagatactcaaataaagcactgatttgatgttaccgaacttttccccaggcataaaattttattttcatatttcatcaattcgatattattgatatcgcacctaatgtagtcatttcctttctctctttgctagtagattttaaaaaggtttcttgctgtatttttttatacttttatagacgccgctttccaaagttcatctaaaataagtcgctacaatgatttgatcttgattcggtgcttcaggagcctgcttgcttctttgcagcttcggcaatttggaaccttgtgtgcatatcctcgtttgtaagcccagaagcacacagacatcgatcacatctataataggagcatgctatcataaaagattcacagtattcgtataattacatggcagactttttgaaaagaatggtatggaaccaagtgagcgcctagaaaaaaagctgaaaagctgaaatcttaattggataagaaacttcaataacatttttcacgcgtttctttttcaactagattagccttaacaaacgacaatcatcgagtacccacgctcattacgctgaacgtgcaaatgtaacggggtggaaacctaaaacgttgaatgaactagccagaacgatgacaattgcggcaagctttccatacgtgttctgttgttgcggcttagagtggtaggtaaccgcgccaagcaaaattacctaccactttaagcccaaaaaggtgatgtgtagctattgcggctgtggcggctattgcggttgtcgccacgcttgtcgccagggttgtcgctacgaatgtttcagcttttttttcaatgggccactcttttcacgtgaagcgctccacgaaatgtgcggatattgcggaagctctcaatgatgagctatcggtagggattaaaataaacgagatttggcagcagttttaaataccaagggagtagtatatctagcctccaataacttcatttgtggaaacttacttctatctcactctctacctgaaaagaaaacaaatattgtacattcatcaattgctggaacataaagaacataaaatcaatatgtcaactagctcctccgtaacgcagaaaaacttggatacaaacgcggaagccttgaaaaaggaggataaagtattatcagagtttgatattcaggatgagaggcctaaatcccttttatgggagagtgcctttgtcggagtgctgtgctctgcccaactaatgactcaggcaggacttggacaatcattagcgccgcttcacatcatcggtaacagttttggaacaacgaatgctggacaacttagttggtttgcttccgcatattcgctaactgttggtacattcattttaattgctggaagactcggagatatcttcggacacaagaaattctttgtccttggcttcttttggtacgcactttggtccttacttgctgggtttagcgtctactctaatcagattttttttgactgctgtcgtgcatttcaaggcatgggtccggcctttttgttgccaaatgccattgcgattctcggacgcacatataagccaggaagaagaaaaaacatggtctttagtctgtttggtgcttcagcacctggtggcttcttccttggggctgttttctcatccatgttgggtcaactggcgtggtggccatgggcttactggataatgggtattgcatgctttgttttagctgtagcaggttactttgtaatccctcacacccccatgccaagccgcgatgcctcatctttcaagttgttggaacgaatcgattttgcagggtcagttaccggcgttgttggattaattctctttaatttcgcttggaaccaaggccccgttgtgggttggcaaactccatacacatacgctcttttgatagttggtacctttttcttggttatttttgcatatatcgagtcccgagcagctttccctctgctaccatttgctgctctttctagtgatactgcttttgtacttagctgcatagctgcgggatgggccagctttggtatttggatattctatacatggcagttcatggaagactcaaggggccaaaccccccttctttctagtgcacagttttcacctgtagcaatcagtggattttgtgcagccgtgacgacaggtttccttctaagccatacacccccaagcacagttatgctttttgcgatgacagctttcacagtcggaactatattgattgctacggcccccgttcaccaaacgtattgggctcaaacgtttgtgtcaatcattgttatgccttggggaatggacatgtcctttccggccgctacaataatgcttagtgactcgatgccacacgaacatcaaggtcttgcagcctctttggttaatacggtggtaaactattcgatatcgataggtttgggtattgcaggtacaattgaatctagagtaaatgacggaggtgccaagcctttgaaaggatatcgttgttcgtggtacatgggcatcgggttgagcggacttggcatttttgtcgcagcaacgtatgcatggagcacttttatgaagtctaaaaaaaggatctccgaaaagcagcattttatagaataagttcatatatagagaaatacttcatcgtggtatataacccaaactaatagaaataaatatagtacgatcaaagtgatagagaggagccagtatatcccgtatcgtgcgataaatatgaaaattacaagaggccattctcgagtgaaaagatacattattttttcaagtagaaacctgaaagaacttcagtaagataacttagcgcacactttcctactttaagctcaccaaatggcatccccaggatcgacagcattaccacacaagcgacaaagagtccgaaaggcttgcgtgccctgtagggaacgtaaaaggaaatgtaatggcaaatctccatgtgaaatgtgcgttgcctatggatatgtatgtcattatattgacggtcgtgtcccttcggcatcacctcaagtgcaacaagtaggtgaaacatctcctgatacggagagcagaccttttgttcttccgggtatacatagaaacgaacaaccgcagcctataaatacacagaacgttacaagtcaaaacattgtagatccaactaagtctaggtacacgatccagcactctgcagttgctttcccccgctgtcttggtctcgaactccgatcaactaatcctccacgcctacattccttcgcttggcattgcggaatcagaccggaagaaaatccaaactcacatgtccttctttctgatttagttacaaaggaagagtattaccgtatctcaaaagtttatttttcagttgttcacccgatatttgatgttgttaatccagagcaactggcaaagaatgttgaaaaatactgggatggcgacgtaaaaaccttagagtatggggctgttattgcaggggtgatagctttaggatcattttttatgggaagtcttggccatccccgagagatggatatagtacaatatgccaaagggatccttgatgacccgactttcagtcgcattcccacggtggagcaagtctccgcatgggttttgcgcaccatttacctgcgagccacttcgaggccccatgtagcatggttagctagctgcgtaaccatccatctttctgaggcaattggcctgcatcatgagattgacagagaggatatagcgatatcgaacaacgttccaccaaaaagaactactgtagtgagcgaacacactagaagattattttggtgtgcatggtcaatcaataccattctttcatatgactatgggcgctcaagtgttacgctgaatagaattacttgcaagccagttaaggagacggacggtaattttacagctcatttagtcgcgttagcacacctgattccccaagacagcgtgaacgcaaacgcagcgcaattgttgcaggccctggcggccgttcatgaatcaccaaacgcacatccgtttttgtcgttgaccaagggtgatatatgcctctctttgtatagaagacttcgtttgctgaatcatattcttgataaaaatgttgttttacaaataattgatatcggcaacactgcgctatcagcagcatacgctcttgtaaaactggatcaagcatggtggaatgtgttgagcacctcattccagtacgtctgtgtccttcttgccatcgacacaccggaaagtctttcacatgttgctactgccatgaaaacgttagataatattactcaaattctcggtacacgtattgcttttgaagcacaaaagaccgcaaaactgcttcttgaggattccatgaaaaaaaaaagacaagaaattcagcagcttgagcaggcaactcaccagagatctaatcttgaaactactcacctactcgatattgactgggatgctttgctagatccatcagacacgttaaactttatgtaaaagagtattatagattatgtgtatcgagaagcaaattgatttataattagagggaatggaattgatgtttaatacctgcttactatattttatctttgataattgcgcagaaagtaatatatccggtatttgaaaataggaaatttaaagaaatcccgtcacgcctggaatgaggggtgaaaccttgactgatattatattcttttcttggacatagtgtctgaaccaaatgcaaattgcactgcattgcaccaaattgatggttcaagttcgatctataaaaatacgagagaaggtctgactgtttatgtcaatactcaagaggctcaggaacagtgttaaagcttggaagttcaattcattaaagaaaagttgataacgtcaggtggaaaaccgaaagataaaaataaaagcaagtcaagatttgaagtattgctgagcgaaattttgtttgagtggtccggaaatttttatacactttattagtatttggtttagtgtaggtgggaaagcttagaacgtatgtagaaaaacatccctgaagagttctctagatcttatcatcagcaataaaagaatgccgttgtgacacttaaatagtcatatcacatgcggatacacttctaatacactagtcttctttcactgccctttatttataagactcatgtccagtctattttttttttaaaaaaaaagactttcaagctttttacaacttgatattctaatatgaataatgaataatgaataatttaattaattgttttgtttaaattttgttcggtctcggctatatttggaagaaaaatagccagtacatactttctaccactttcgctcaattatcaataaaaacatttaatcgaaagtcattcaaactgaaaacttcaaaagtcatttttttattgcttcccattccaatcacaattatgctttgagccaatttcagtaaaactttgaaaatacgtaggcgcatcgcatcgcctaacttaattcgcggtttaactagcttcctccaccagttccataaaaaaatgatggatcagtgcaaaaaaattttatcataaatctgatgaagtatactaagctgaataagctgtaggccttatttgcttttttcatacccttggttggtacgacagtaaagattggcaggttcggagatacaactttttttgaggcttagaatgctcggcctgcataaaatggcgttaaagttgcgcacaggccccggaaaccctgccaaggaatattacataagttgcaacatctttttccaatacatggttagagagtttttaatcgttatacttttttctcatttgattaaaaaatataaaatgaattgcgaaattcttctagaaatgcgttactattttacggttggcattgcaagattattataactacgaagcagtgttggaaaatatcatctgggaagaaattcctatttcttgggaagaattacatgtgcataaaaagataaaaccctcgatcacccaaaattgactttgcgactaaaaagtgattttttcagcatattgcatttcaaaaagtcgttgtttagcacaactcatagaaaataaatactagtatgattcgggaattatttatcagttaattataggagtacagccttttatagagttggcgaagatagccaaaagataaaagctttgacgtacgtctgtaaaaagtgccttttctgatcgaatccagttgctcagatatccgggaagttgttagcattcattgcttttctgcactatatcagcatatgaatgctttcagtattttaattttaccctttcacgaagtacgccagaaaatgattggaaacgtactcaaaaacaaagcaggaaataagcgacgaaaatttttcatttcaattaagaggtactgagcggctacttaactttttctgcagtaagtaatgacagagtatcactacagaattctgtgcctccggtctgggaatgcagctagggagacagcacccttttgctaataatgcgccggaaatgaaacatttagataaaatctaaagttacgaaaacaatacactttgagggaaagatatcagagaattaaaagctgcaaagaactatgacaaattaaccgctttgttgaccctagatcatagtttacactgcgaacgggatagttgcaacctcttttgtaaaatgcacccatatctcattttgcctttatttcgggtgtataataggagaaaaatttgaatggtaaagaataagtcccttgcgagtgtcaagagaagcacaattattattactattggtgacgtgattgaactcgagaattttcctggaccgatatttgagttttacgtggaatgtgggtgtacctcatctcaaagaattggcgaaaagccaaacttcttaattctaacaaaagctactgattcgttggcgatgaaagactcttttttttggctgtcagaagctttcatctttgacatagatgtacagaatttgatcaattgtttatattaaaagattcgtcgcaacttatataaggtggcaagagaatgattaacttcaattgctgatgaacgttctcaattcaaaaattataagacacaaggaaaacaatgtattgggtcctcctttgtggttctattttgttatgctgcttgtcaggagcaagcgcctcccctgctaagacaaaaatgtacggcaagttaccactggttttgacagatgcctgcatgggagttctcggcgaagtaacctgggagtatagtagtgacgatttatattcctcaccagcatgtacatatgaaccggcattacagtcaatgttgtattgtatttacgaatcattgaatgaaaagggttattccaatagaacctttgaaaaaacctttgctgctatcaaagaagactgcgcatattacactgataaccttcagaatatgactaatgcagatttctataatatgctgaataatggaacaacatacataatacagtattctgaaggtagcgcgaatcttacgtatccaatcgagatggatgcccaagtgagagaaaactattattattcttaccatggtttctacgccaactacgacattggtcatacttatggtggtattatttgcgcctattttgtaggtgttatgattcttgccagcatactccattatctaagttacactccgtttaaaactgccttatttaaacaaagacttgtaagatatgtgagaagatatttgacaatacctactatctggggtaaacatgcgtcgagcttttcttaccttaaaatttttacaggcttccttcccacacgatctgaaggcgtcattatacttggatacctcgtgcttcatacagtttttctggcatacgggtatcaatatgatccttacaacttaattttcgactctcgtagagaacagattgctcgatacgtggcagatagaagtggtgtcctggcatttgcacattttcccctaatagctcttttcgcaggaaggaacaattttctagaattcatttctggagtaaaatatacctctttcataatgtttcataagtggttgggaagaatgatgtttttagatgctgtgattcatggcgctgcttataccagttattccgtattctacaaagattgggcagcaagcaaggaagagacatattggcaatttggagtagctgctctttgtatagttggtgttatggtgtttttttctttggcaatgttcagaaagtttttctatgaagccttcttatttctccatattgtgcttggcgcattgttcttttatacgtgttgggagcacgtcgtagaattgagtgggattgagtggatatacgctgctattgctatctggactattgataggctaattcgaattgttagagtatcttatttcggtttccctaaggcttccttacagttagttggcgatgacatcattcgagtcacagtcaaacgaccagtaaggctatggaaagccaaaccaggacagtatgttttcgtttcattcctacaccacctgtatttttggcagtcacatcctttcacagtcttagattcaattatcaaagatggtgagctgactattatcctgaaggaaaaaaagggagtaacaaaacttgtcaaaaagtatgtgtgttgcaatggaggtaaggcatctatgagactagctatagaaggtccatatggctcttcatctccagtcaataattatgataacgtcttgctacttacgggaggtactggtttgccagggcccattgcacacgccattaaacttggaaaaacgtcagcggcaactggaaaacaattcataaaattagtgattgcagttagagggtttaacgtactcgaggcttacaagccggagctgatgtgtctagaagatcttaatgtacagcttcacatctacaatacaatggaagttccggcattaactcctaatgatagtttggaaatttctcaacaagacgagaaggccgatggaaaaggtgttgttatggcaactaccctagaacagtcacctaatccagttgaatttgatggtactgtttttcatcatggaagacccaatgttgaaaagcttctgcatgaagttggtgacctaaatggatcgttagctgtggtttgttgtgggcctcctgttttcgttgacgaagtaagggatcaaacggcaaatcttgttctagagaagcctgcaaaggcaatcgaatactttgaagaataccaaagttggtaatcaattaccttatttatttcctcactattttacctatcacaagtatatatttaattgttttgacctgaaacataatttatgtctagctgcaatgaagacaattgatcgactttcacaaactttttcaatctactaatctttggaagcattttttaactgtctcccactcttgttccatgacttaaatttctcttcctccaaattaactgaattttttttctggattgatgttctttccaattgttgtggtaatccacagctggtataacataaaaagaagttttttgtaaaaaaaaaaaatttctcagtaagcatataagcctcagtgaaataaaattttaacaactacacgctattctattccatttgccctgcttttctcgcttcgttatcacctaaccactaagaacatactaataatacaaaatttttatccactttttaccaacagattttcatgaaatatccatcttctttccgaattctgtataaaatgaaagagagattttttgctctcaatccaggctcaaggctcttgagaacaggtaattgttgtttagcacgttttcaacacatttatcagaaaacgacagttaaaaataagacgagcggcgttatcatcctgatagtcactaaatgaaaagcaggtacttttgaagagcacatgtaatatttgctcaactgataataccttcattttatacacacttctaattttttttttaaaatcagatacgcattgatgttcaatgtagcattaccatcacaagacaaaaaatcagaattttacaagcaaaagcgcttatctttaaggaccaacatattagatgaattcttaagggttgccaaaacgcaagacaacaggcaaaataatttcgtttctcagtaccgaaatgacgaaatatactgaggcaaatgcgatcatcatgcctttgcgccaagaaactcccttgtgaagaacttcaaaccgaaatgggaaaactttgagttattgacagggaatacggaggggaagatcacacttaaatccgtatgagccgcgcacataatggtattcaaatacacaagaacattcatgagctatttttcatccgtgcaaacgaatttactacaattggaccagagggcaccataactggagactttgctactgactcaacgttgatgatgcgagtagtgggtgtactgtgatttgctcatttttttttttatagaaagattcgattaatgaaagtcacaggagacatttttacatagacattccgtatatgttgcgggtatcgcggatgcggattagtgatgcctttaactacatttcatagatttctgtataccaattgaaatgagtgaagtaagctcctacagtgaaatatctgggtgctactgacgccaagccctacagcgatcggaatgcgggaacggaagttaacggggcttccagaacggcggaagcgaattgaacgaggacggcaaacaaaaacacccaaaatttcattacttagaatgaccctcaagagcagggtgcaatttatcaagcgatcattgaactaactaagttcatatcctgtataggatttaaaacaatgcaccctaagttcaaatgcaccccccctcgccccgcagcggacccttgaacagagaactgtttcgaggttcacccaattggatcacttgtataatttgtaatcgagttcggataagatgtatacgaatctaactgggtgcagtataattagcattttatattacctagcaatatatgtataaaacaggaatgtgtgcgtgcttcaggcagaattttacggtccttgtaaaaaagtctatcataaagccatcacaaaacaataataatgaaattctcaactattttcggagctactacagttatgactgccgtctcggcagcagctgtgtcgagtgtaatgaccactaagactattactgctactaacggtaataacgtttacactaaggtcgttaccgacaccgctgaccctatcattagttacagtaccactagaactgtcgttgtcagtaatagtgatgctacttacacaaaggttgtcaccgaaggaccagataccacctctgaaaagagtacaacaaagacacttactttgacaaacggttcaggttcatcaaccaacctttacaccaagaccgtcactcaagccgtcgaatcatctacatcctcctcatcctcctcatcctcctcctcctcttctgcctcttcttctggtgctgctcctgctgcattccaaggagcaagtgtcggtgcattggcccttggtttgatttcttacctattataagctcggtttcaaaccagaaaaaagctattagttatcgtgtatagcatatttataacttatctatgaaaagctaatataattgtctttctccttcaaaaggctagtaaaaaggactttttttcattacgtttctcagtgacttcaatgtagcagtttttcgtttcatcatcatcatcgtattattattattgttattattattattatcattacttttattaatattaactatttttttagtatgatttcgggtatatttattttaattagatacttttaaccgtttcaaacaattaaaggaagaccaacgaacttgaaacagtatatatacatacatacttaatgtgtgttattaaaatttttttattctaacataacttcgaaaaaaggccaagccgcaaggtgcttcataaaaatcggatatcccgcatgattattcacatatcatttacaataacatgacggcagcaagggcagcacccatcaaaccagtaccagcggtgatggcatcagcagcaccggtgtaactagataattcagcggtgctagaggatgtagcagaggaagaagtttcagcagtggtggttgcagtggttgaagcagaagaggtagcagcttctgagctggtagaagtactacttggagaccaggtgttgctgctgccttcaccagtccagacaaaagtagcatcttgggtgacagtcttagtgtagacgtgaccgttcttggtggcagtgatagtggtagtgatactagaaccagaaccttcatcagcagaagaagtctcagcagcagaagaagtctcagcagcagaagtggtagcggcagcagaagtggtagcggcagcagaggtttcggcggcagaagtttcggcggcagaagattcagcggcagaagtgctgctggcgtaagagtcttcaccaccccaaacaaaagtagcatcttgggtgacagtcttagtgtagacatgaccgttcttggtggcagtgatggtggtggtgatactctcagcaagagcagtagcggcaacagcagatagaaccaaagcggaagagaatttcattttagggattattgttattagttatttttaagcgagtggaagtacttgtttgtatctgttcgaacattcatattacctcctaatacttcaaatagttcttggcttaaataccccataaatcaacttttacaaaaaaaaaaataacaaatctcgaacgataattgaaccccatttttttgcaccctttcctagaatggcggaactcggctcttgagcccttagattgctttccttcacatacatcaaaaaatatgggatagcggggtgcggaacaaacagggtgcaaaaaaaaatctaggacataggtaggactaagaagactgtggcattactacacagcaatcatattttaccgcttcctcgtttaattggatttttacttttcattacattagcgatcattaaaaaaggagcgtcaattttttacttggcaaatgtgtaatgtagcgttttcggtatgtcacatcaccaattttgtcgcagttaatttaattcacccagatttcgaatgcttttcgctagattagtgctgctgttggtgtatttggcaccaggttctttagcaaaaccagcatcaactaagaaaagaacgcaatgggaccagatagcaattgatgcttgtgctaaagaattggaatcacacaaatttgacacggatgtgaagggtcggcacgctactctttgcacttatgaaccagcactagggtcttggttacattgcgcgaaggatgttctcgacagtaggaagaaaagtaaaaaaatattcgaaaaaacgtttagcaaaattaatcagtattgccacgattatcacaaagatgaggtcgtcagcaatgaggagtattatcgaatttttgccaatgcatcccttttcatccggcctcttgatgaggtaaaggaaaacatacgatatcccgtcactcccaataaagcctctctagataggtgggtatgggcttattttgggcccctggataatatagacaaaggaaatgtttatggagtgacgatttgcttatactggataggagttctgtttattgcagctgtatatcacttcttgaacttttctcgacttaaacaaacggtgttcaaaaacaaggtgtctgctttcttaagaggccactatgttcttccagcgcttgttcataaccatgctatgtcagtgggaaggtggtttttcatcggtctggtccctaccaggttagagacccttgtcctattcggttacgttttgttgcacgggttcttgttgagtagttacaattttgaccataatgagttgctcagtgatcgcagaagccaagtgcttatcttcctttccgacagggcagggatcctggcattcgcacattttcctttgatagttctctttggcggtaaaaacagcacaatgacttggctcacaggtataagatataccgcattcattacttaccacaaatggttaggaagattcatgttagtagactgtacgatccatgcaataggatacacctaccatgcatacatagaaaattactggaaatacgtgaagtatagtgatctatggacatccggaagacatgccatgatcattgttggaatacttgtgtttttttcgttcttcttctttagacgacattattacgaattgtttgttattacgcacattatcttagcaataggatttttccatgcgtgctggaaacattgctataaacttggatggggtgaatggataatggcgtgtgcactgttttggattgctgaccgtattctgcggctaataaagattgcaatttttggaatgccatgggctaaattgaaactgtgtggcgagtccatgatagaagtgagaatctcaaaaagctccaaatggtggaaagcagaacctggccaatatatatatctgtacttcttaagaccaaaaatattctggcaatcacatccattcacggtcatggattctttggttgaggatggtgagttggtagttgtgataacagtgaaaaatgggctaaccaaaaaattacaggaataccttttagagagcgaagggtacacggaaatgcgagtactagcagaaggaccttatggacaaagcacgcgaacacatttgttcgaaagcctcctgtttattgccggaggggcgggtgttcctggacctctgtcgatggcaataaaggcaggtcgccaggtcaaaagcaacgattctcatcaaatgatcaaatttgtgtggagtgtacgtaaccttgatctcttagaagtgtatcgcaaagagataatggtgctaaaagagttgaacatagacacaaaaatttacttcacaggagagcgaaaagatgaatcgaacacggaggagggagcaattgctaatatgagcacggaaggcagactgctgacgacatcgaaatcagcggaaatgattactgattttggacgaccaaatatcgatgagataattgaagaagcagtaagtggtgcaaaatctttgttggtcacttgttgcgggtcagagggctttgtagacaagacacgagagttgacggcaaaaagagttcttgaacacggtgacaaatggatagaatacgtggaggaattccagaattggtagcatttcaatccgccctatcaatgctaacctgttacgaataccaaaaccacaaaaacacggaccttgtttaattactgtatgaaataactgtactccattaatattcaatgcatttagtccttaaaaatcagcgggaatctaataagccggcgaaggtactacacctcacccttactgttatttaaaaatcctatttgtggggatttgcaattagttttcatcgccaaataacaatccttcactgcacaccactacttaaaaaaagggtacattgctaacattcttggtatgaaaaattgcagtcatttagattgagttggcaaaaatacaaatttaacgcatgagtataaaatcgctattcgctttattattatttcctccctgattaataaatatcgaagggtaatcagggttacgggaacagtacttatcggaggaataataagcagcaccctttagaatgtggatcgtttcaatacagtcgcatctgacatatacagcgccactgtcgtaagttgtcaatcacgagaacataatcttgaaacacggatggctacatagagttacctttttcatcatgatatgaattgatactttaggcatgatagaaaacaaaagttttgcattacatcagggtatccaattgaaaatgttctagctattcatttaccttcccgaaaagcattcttcgaagctgcagttctttctgccattcatctcagaactgtcttcgttgcagagtcaaagttgccacttttcttcatttatttgatatagaaaatgcgcaatatacaatctctcattgcaggattgatatcatttttccgagggagcgatattcaaccaggttttgccagtcaacggtgaagggtaatacatcaggtaggttgaaaattaggcgagtgaattaagaactttcttcctttattactctcattcaatgccagttcgatgaaaattagcgggcaacgatacgcaaatgtctcgtaaatacttacgtaataagttattatttaatcaaacttcaattcgcaaacaaatgaaggttacactgtacttgcatcacttacagtgggtttgaagtttctatgatagtggtatctcgaattactgagaaaatactgatagtgagctcttgacgaaaacctttctccccgattatcgcctatggtgtatgtcataaaggcttataaaagcgaggcttttcatagaaatatcacttcattgtcagcaacaggggctcatgttcattcgtaagcctcttaatttttcaaaggcattgtacatagaaacagcgaaaaaactgtagcagccactttcactgagctactgtatataaggcgggcagtagaaaccaagacataataattcaaagaagaaacaaccaattaacaatgcgtggtttcagtggtcaaccattgagtgatgatgataattatagaattgaaaagactcaaaggaacacaattcctgaacgtctccattttagcagagagagaaatatgcccattgcaagtatattcgggactagaggatattttgtattctcaagtgagcaatcctatgacaaattcaaacagacaaactttaatatcagtactctagatgcggatggtgtaggtgttcctctttttcatattgtccaaagttataacgttattggcaaaattactcggagctcgccggatttctatatctacaagtacgttttacaaggggtgcaagatccgcctttatactctgattgtaaagttatttgtcaagataaagtttttcgtttatgcaaaattttatattgtgaaatttatgctcatcaaggattttttgaaactaaatacgatttcttctatccttctaaaacgcagccggtcaaaaaataccaaataatcaaacaaagtaatatgcgagatctatattccactttggacggtatgcgttttcgttggcatgtgaaattctacagcgatcattttcgattgatgttcctagatgaggacaggctcaattactcaaatagtaaccaaaaggaaaggcaaaaaccagatcaaggaaaaagtaaggctccagatttcgtaattggccattatacaagaactttttccgatatactccctagatccacgtcaaaatgctccaatcttattattggagaacactcaaagccagactctcttggtatcacgaccgttcctgatttgactcaggaatttgcctgtcagggagctttaatccattatctgctgcatatagaacgagaaagaaaataaaaaaagaaacagaaacagaaatagaaaatggtgaagtaggatacaatctagtggcttattactcaaggattttttcgcaatccgtccaatccgaaaaatataacttgacgtgtaacacccagaggaacgttatacaggcaactgaggtcgaatgaaacgagattactctttaggttcaattgagcaggcatttatccgagacattacgacctagccaaatgagatacatacatattagctagaacttcgcatcacatattttttcaattttttttcaatacgcaattattgcccataattaatctgaggttttcatacttattggcaatagtaagatcaaggtaacgttgtttttggtttgactttatacaggatttattcctacgtagtcaagattatggtatattttgtgtgcattttaacaccggcgctagtaccaacatctttttactgattgtattcatagagtatccttttaatattacttagcaagtattttgtaacaaatccaagcataatataacaagctccgtcaattgaacccacctttttaacaatatgagaagatacagctgttttttctcgaaattgttatctagaagtttatgcaaaatcaaaactctatccagaatcatcatcggagctttttgaaatccataaatctttctatccaataagcatattaaagaagttattgatatgaagatgacgcttcataatgctagctacaacaattacgtttgatgactgcgtattcaattatttttatcccgaactacatatctcgcttttactggcgccacttttcttcctcgtttttcgaggaagcagtcaaattaaaccttaaggggtgaaagtatgcttactttgacacttattcctctttacaattcgtttcacagaacagacaaccagcactgataatgaaaagaacggtaatatcttcctcgaacgcatatgctagtaagagatctcggctggatatagaacatgattttgaacaataccactcgttgaacaaaaaatattatccaaggccaattactaggacaggcgcaaatcaattcaataataagtctcgggctaaaccaatggagattgtggaaaaactgcaaaagaagcaaaaaacgtcgtttgagaatgttagcactgtcatgcactggtttcgaaatgatctacgtttatatgataatgtgggactgtacaaaagtgttgcgctcttccagcaattgaggcaaaaaaacgcaaaagccaaattatatgctgtttatgtcatcaatgaagatgattggagagcccatatggatagcggatggaaattgatgtttataatgggggcgttaaaaaatttgcagcagtccttagccgaattacacatacctcttcttctgtgggaattccacactccaaaaagtaccttatctaattcaaaagagttcgtggagtttttcaaagaaaaatgtatgaatgtaagttcaggaacaggtacgataatcactgctaatatagaataccaaacagatgaactgtaccgtgatattaggctgttagaaaatgaagaccatagattgcaattgaaatactaccacgactcttgcattgttgctcctggattgatcactactgacagaggcaccaactattctgtgtttactccatggtacaaaaaatgggtgctatatgtaaataattacaaaaagagtacctctgaaatttgtcatttgcatataatcgaaccattaaagtacaacgaaacttttgaactgaagccattccaatattcattaccggatgaattccttcaatatatacctaaatcaaaatggtgcttgccagacgtttctgaagaagcagctttatccagattaaaagatttcctcggtacaaaaagttctaagtacaacaatgaaaaagacatgctatatttgggtggaacctctgggctaagtgtatatataactactggtaggataagcacaagacttatagtcaaccaggcatttcaatcatgcaacggacaaataatgtcaaaagcactgaaagataattcgtccacccaaaatttcatcaaagaagttgcatggagagatttttacagacattgtatgtgcaactggccatatacctcaatgggaatgccttatcgattggacactttagatataaaatgggagaataaccctgtagcatttgaaaagtggtgtactggtaatacaggcattcccatagtcgatgccataatgagaaaattactgtacacaggctatattaataacagatctagaatgatcacagcttcttttctttctaaaaacttattaatagattggagatggggggaacgctggtttatgaaacacttgatagacggtgattcgtcttcaaatgttggtggctggggtttttgttctagtacaggaattgatgcccaaccatattttagagtttttaatatggatatacaagcaaaaaaatatgacccacaaatgatattcgtcaaacaatgggttcccgaattgatttcttccgaaaataagcgtccagaaaactatccaaaacctttagttgatttaaagcatagtagggagcgtgctttgaaagtttataaagacgcaatgtgagaataacgtctcctgattaagcaggtgtgctttagtagttttgccgctttgcttgatcactgttagtatttcggcaaattatatggtattggtcgccttgccaggttctttaggaagttcatcataaactaacgctttcaagaatttacggaaatgatagggtttatagtttttataacagtagtggacctagaaaacaccgatagctggcggcggttatatctcattactactatgaaaactgtggctcctgagtagctactgaaggatgtgcccatcttaatccagacctagtcaatacaatcaatacaactgtctagctgaaaactgacaaaaaagtttgtcgatgtctctagtatattcactataacactaaattttattgtaaattattacacaagttttcaagaagaaaaacaatattaaacacaataactagattatgcgaggcacggcaaaaggagtgaagagggcaaaatacggagaagacaatatagaataaatttctttttttgattagagaagattgtttgccagtgactgtgaactaattaaaagggaaaagagaatgccttggttagattgcttggagcaatagtcttaccatgatgatcagtcggattctgacgacgttgggtattttaaaacacgcgtaattgaaagggtgatgttgagaatggaccacttcaagatatgctcgaaaatgtagctatatttcacggatgaataactcgtaagaatgtgcagtagctgatggacctaggaacgatcaagtcaacgttgtattttggttcggcaaacaattgatatgatgttgacaagaaaaccatctgcgctctaatctctaagtacacgtgcatttggacctatcatcaaaagagaataagaggatactttcaagagaagttcaaaaaagaatcattattatgatccaatgacagtgacaataagatcaacataaaaaagaaaagtcagaagtataaatctgggtctttttctctaaaataattatagtctgttaatttataaaactgcctaaaaaatatacttaaaatatgtctacagattatgcagctggaaaaaatcaagcaaaaccagcgtctggtggacaaacggccttcaactggatggcggtacaataatctggtaatgtctcattcgcagcgaaaatgttcacagttggggtgctcaaaataacagaagcaaagtttgggtaacaggaagcaacttgaacgccatactgagtagagttaaacaattggttagctaaaccggttatgaaggaagcattatcagcggtgtctgcccaagagttgtattcaatttcaccagtaacagtgttagcaaaaggaaccatagcatcaccaatggattgagggttacaagtgtagatattggtggtgaagattagtggagaaaagttcttcgtatcattgctagcaatagtagtcaactttgggaggaatcttgtttcctggcccaaatatcttgcccaagcgtcaccagcgctttcagttaaaacgtcggcaccagcaaacgtagattgacccaaaaatgtaccattttggccaacgacttccataacgtaggtaccacagtgaggtccatgtaggttattacaagtgacgttagtcaaatcaaatctgacggctgttgcaacagacacaaggacgctgaaaaaagtaaaaatgtttaggaaactcatggtatggttgttgttcttgatttcttgagattgtacaatctatcagaagcagtagctctccattttgaatgaaaattacgatgcttatatatcaattatacctgttatatgctgaaaaccttaatgattatattaacctttttctagcaactgaaaatacagatctggaatatgtttctatatttccaacctcagcggttattcgaaaaaaaaataattgacccgcagggtgtataggtagttgatgaaagtatcattgtttttaatttattgttaaaagtccgaaaagcgagaatgcatgaaagtattaccttccattccaggaatagaagcaacactaattcaaaagcccgtttaggaaagatccgaatattttgacagtagtacgtaatgaataaccactcaggtgatactaagacaaattttacaacattttaatgtgttcctgatttgattatgcaacactttttttgacccagtccaaaaaaactgccgtaatatacttcattggttgtcgtacaagtaagctttaacatggttctcgaagtcaaagcgcaaacatgcgaccaatgggtcaaaataatggtaagacgctgcaaaattctcttcacttaattgaaaaaaagtttcataattcatgtcggacagatttatttctggacaatttggttctgttgaattcagaaatgctcagggttcatcatgccatagtgccacttcaatggaagacaatacctttgagaaaaaaaggtaccttgcatgaggtatgatgcacgggtgcactgttaaaaaaaaaaaaatttcagatgtatttaaagactttctaggctgggcggctaacaaaaaagtgatggagagtgaatcaacaggtgccaatatgcagcaagtggaactttctggggattttattactgtgatgttcgacaaatagttcaaataattataagctagtggctgcattggattatgaaacagggaatcagatataggcttccctggctttccttcgaaacgtttgaagtagtaagcgataacctatccctgaacacttaacattatatggctcttttctgcagcagatacttttggagtcttaaaagcacaatgtttgagccggccaggcgcccataattagaaataaaaactgtttatagtgtagatgatcagttgtgattatgctactgttacaattaatgaagttgattgcgatctctccttttactgtatctttagttctgttattaacgacgagccaaattccagaaaaacagtaagggagaaagacttttcctctttatttgaaccgctaccgtgaagatcgtttactgccaaattttgacagcagattttgtatatagctaccatatcagcagtttcaattatttgatattaataaaccgctcttctattttttaagagataacgaaaattttgctttacaaaatatttagctaaggtataaatgtgctatggacgaatagtggagaatacgccaaaacaagaacaaaaggagaccggaaaacttctgctcacaaatactcataatcactcttatttcttctgtccataagctctggtggcataagaaccattctgcacaataatatcctgtggacggtaatcaaactttttggaaaagtaactatttaggatgttctttactccctgagcgtacctcttttgagcatccagagatgtgccactgatatgaacagtcattgcgtttcccacgtggtccttattgtccatagtcctccagggatggtcttttggtgctggttgcttatcccagacatcaccaccatagccagccaatttaccagacttgactgcctcggcaacatcttctgcgacacaaatagcacctctagcggtattcaccaagtatgcaccatctttcatgtgggaaataagctttttattgaataaaccccttgagtccttgtgcaatggacagttgatggtaacaacatctgactgagcaaccatatcctccaatttctctactctctgaacaatatcacctctgccattgaaaagcttgctggcctcgttcaatctattgattgcttccgcaggtagttcctggtagtcgtagtacagtaacttcttcggattaaatgcgaccaatctttccagaaccctatatccaattctaccggcacctaccgttgaaattattttgtcttccagatcatactcatttttagccacgccggcaatatcccactcaccattaattgcttgttgatgaccaccattatagtttcttatcaaaaccaaaattgtggccataacgtgctctgcgacagaaacgacgttagaaccagtaacttcggtgaccgtgattttccgttcatttgcagcttctaaatcgacatggtctgaaccgacgccagcggttacacagagcttcaggttaggagcttctgcaatcctgtttctcgagatgtaggcggggaaaaagggcgtagtaatgacaatttcagcgtctttcaactccctgtctaccgttgaggttggctcagggtccttgtcaatggtagtaaccaactcgtatccctgttcttcaatgaaatttctgataccaagttcattttcaatacaccccaataacttttcctgctcttcagcatgcttaccaccttcgtaaagaaccagcaaaacctttcccttcgacatattaattttcagctgttattttgatttgattagcgttgcaatacttgtaaattgttcctgcttaaaatgaataaaaaaagcacaatacaagaatatgcatattttacgtaaatgatatattaactaaactttcctcagcaagaactcattaaaaaagactcaattttgtgcccttttatatgttctttttttcaatgattgacagtgcagagtgatttctccaacttttagttaacagtgaataatccaagaatagtatattccgcataacatcaaaatagttttattactggcatgtctttttcattcggagttctagtatcggtgccttcctagtaaggaaattcccgattataagggaaaaaaagaaaagggataagccgcttgggctgttggtccaaacagaatgttttaaaccatagccaaacaagtgcaaaatagaaaagttggggttaaaactctctttcaagcctatcctcgagtggtgacaaaataggtaatttccgacacttttttctgctactaagcaccgtgaaaagagaacgtttcgagagtacatttcgtactgaatgttgtataaactctatgcttctaaagatttatccaaaccgttggagctttccctttatttctacataggtttcgaaaacggtctcctacggagcttctccttttatggcgatctgtttttaaagtgttttttagaaaaccattaaactcgaggcttggtttatttttgccttcgagataattttctcttttcctaagaaatttatgttacgccaacaaagacaactaataaggtctcagttcctcttgatcgttagcgataatgctttttttttgcacttgcggagtgtaaatatctatagaaaaataaaccacttgaacaaggggagcttcaagaacctttatgcatattatcgaaatttttagagaaaggttcacgattcaagctttgtttaccaatgtgatgtattacagtgttcatgtcacttgcattgacattgtctttacaccacattaaacacaagttaacaaccgttctccgggcaaagcgagacgatgcagtaatcagcggcaatgaactacgtatgtaaaaaaaagatcggggtgtaaaaattctatgccaagaaaaaaattaaaaacaaaataaaaaaaaaaagaaacttgcggctcttcactcttaaaagacaaaaagtattaggatgataaaaaaaattcataaaaaaaaaaaattctatggcctcagttctcgaagagcccatttataattgtttacataaataatgagattccaccgtcaaggtaccgcagccaccgtaggcgtactgctcattgtgctgcttggtttctgttggaaattatctgaatcttatggcatagtgtcaactgccctaccacacaagcaacctgcaaccaaaatcacagacacaccttctatacgatgggataattaccatgagtttgtcagagacattgattttgataacagcacggctatctttaattccattcgagctgctttaagacagtctccatcggatatacatcctgtcggagtatcttattttcccgctgtaattcccaaaggaactttaatgtaccatgccggatcaaaagtgccaactaccttcgaatggctggctatggaccacgaattcagctactctttcggcttgaggtcaccatcctatgggagaaaatctttggaaagaaggcatgggaggttcggcaatggcacccatggtgatcatccaaaagggccaccaccaccaccaccaccagacgaaaaagatcgaggttcacaaaaaatgcttacctatagagcagcacgggacctcaacaaatttctctatcttgatggggcttctgctgcaaaaactgactcaggagagatggacacgcagctaatgttgtcaaatgttattaaagagaaattgaaccttacagatgatggtgaaaacgaacgaatggccgaacgactctacgctgctagaatatgcaaatgggggaagccattcgggcttgacggaattatcagggtagaggttggctttgaggtcgttttgtgtgatttttcggctgataacgtcgaacttgtttcaatgttagaaatggtccagcctaaccagtacctaggcttaccagcacctaccgttatatcgaaagaggaaggttggcctctggatgaaaatggaaacctagttgaagatcagctaacagatgaccaaaaggcgattctggaaagagaagatggttgggagaagactttttctaatttcaacgcagttaagagcttcaatcagttgagagcgggtacagcgcatgacaacggggagcatcgaatccatatcgactataggtacctagtgagcgggataaacaggacttacattgctcctgatcctaacaacagaagattactcgatgaaggaatgacatgggaaaagcaattggacatggtagatgacttagaaaaggctctggaagtcggatttgatgccacgcaaagtatggattggcagttagcatttgatgagcttgtccttaaatttgctccattactaaaatctgttagtaacatactgaacagcaatggtgatattaatgagtcaattgccatcaatgcaacagcactcacattgaacttttgtttaaggtttgagcctgcaagcaacaacagtgatgaattcggtagcgggaaagactttgctgtctaccaatatgtgagcccataccaggccttaaaaacggatgcagactttttgatttggtcatctgctgtcagcgtggtcggagaaattgttgatgccatttataaagtgaatgatttattgatacccgaagtctactcttttatgacagataacacaacttccagcgacttaataaagaatgtcgaaacggctcgctccactatcgatggtttaattgaatctctagggtggattgaactaaattaccgttgtgagagacaatgcaattgggatgaagtttgttacactccttcctggggcccatctccaatgggtatgactgaaccaggttcccacaatgagggatttggaacccactttgatgaatctcgacaaaggttggttattaacagtaaactacagtgtatcaatataaatgatttgatggttaatcgtaatcattagcgcctcctgtgagaaggccattgtgggacagtataaagggtatgatttctagataatctaataatgattatgaagtttttgagatttggggtgatacacatctatgaattactaagagatttgagacacagcgacagtcatgccagcaagatttaagattttctttatttagtgtttatatacatatcagatatctgttgagtattttctattttaccaaaaaaaaaagatatgaaatcaagataaaacgtcgtatgaaagacaagggagctcagcagcaatatcataaagtaaagcaacagcgcttggtttatgtacaatgaacgatctgaaaattagttggcagcggagctacgaatacatgtcaatattacgttacgattgtataacaggggaggagaatcgtgcactttgatgggtatatcgaaagatggtgactatgctagagtcactgtcagtgaggagttgcgatgtatgaaagattcactgacataaagtggcgcgattcatgtagaagtgtaaatcacttttgacgcaatgatggaagagatacagaagagatacggaaaaaataaaacaaaaaacaactgaaataagtactaatggattatatttattgccgccattattatttagcctctggtggctcaagaatctgcagttatttaattatttaatcgagcgtgtaatgctctgatgattttcaatccggtcatatcaaatcacaagttgagccattatattcatgttttttgtacattcaccacgttctgcatattaggtactgaaacacgtcaggctataacggcgctttccacctacactccggccttcgttactgctccgaccgttctctggtctaattgttcatcctgcatgctaatggggattatgcaatctttaaatgcttacacttggatgaaagatcaccaagtcttgtttttaggtgtaactactgggtactgtggtgccctgtcttccttttctagtatgctgctagagatgttcgaacactctacaaacttaactaacggtaatatcgctaaccacacaaaactgccgaacagagcttacggtataatggagtttttatctgtcttgctcgttcatcttatggtttccatgggtagtcttattttcggtaggcaacttggtaaggaggttattgttgcttatggatctagttcgttttcgaagccatatacccctccctcagacactgtaaaggaaaatgctggtgatgttgatacacaagaaatggaaaaaaatattctagagtttaaattcaaaactccagcaccattttttaagaaattttttgatattgtggataaactcgcgtatgcactagcttttccattaattattttgtttgtggtgctgtgtgcgtattatgagaactattcgaggggcaagtggacactaccatgtctatttggaattttcgctggtttcctaagatattggttggcagaaatgtttaataaaacaaacaaaaagtttccattgggtactttcttggcaaacgttttcgccactttattgattggcatatttaccatggtgcaacgtggtaaaaaacacttttctacggacgttccaattgtgaactcgttgaattcatgtcatattgtttctgcgttaatatccggattttgcggcactttgagtaccattagcacgtttatcaatgaagggtataagctatcatttattaacatgcttatttattatactgtttcgattgcaatttcatattgcttattggtgataactctcggatcctatgcttggactagaggattgaccaacccgatttgttaggatcttttctttatacttttccctgcataatcatcccactttttttttttttttttttaattcattttcaagattttagacgttgtataatacatttttacccactactgcggtttattgtaatattttgtgagattttatgaatgcgttccatcatctatttactacaaaacgataaatttccccgttttcttttacttttacttcatttaatataattcatatttatttcccatgtaccaattaattactcataaaaagaacagaaatagaaaaaagttgtatataacaagccaaaaaaaagaaaaaaaaaggaaaaaaaagaaaacacagcttatttcaaattgcaatctgcgtatttcgtaagtaacgaatgatctcacagcattgcttttttttttttttatatatatatgtacattacctatgtcacatatgaccatgatgaatacaacactaaaaaccaaggcctactattcaattgttctctatatgatttccattctagcaaaatcgagtgctaccgacctgccgttttctttacctttcgaaccattgagctgttagccttctcttcacagaaactgaaagtcattaaaagcctccccttcaacaattcccttgtcttttgtttcagctatataatgcgtttatagctctaattgtggtcgaataggaagaatttgcgttaacacccgtaactagctttccatctgtaatagagtagtcatcccagggatggattggcgccaagtacttggctccattcttgtttgcaacgcgttcaaccgttgtcaattttctgctcctcaagatgtcgtcaactcccagggcgatttcaccctcgagtgggaaacctgttatagctttgccttcgattaatggtcttgttgttttgatatctattaatccatcgaaaaggagcggtccatgacagatggcagcgatcacacccccattggcatatatcttggatgcaatatcttgcagatttttagctttgggatagtcaaatagagcaccatgtccagcagatgcaaagaatactttatagtcgctggcgttgacttcatttgcggtcttgatcctcgctaacgccttattgaaggcggaatttttcgtttcaaagttcatcttatcttcgccaccaataaagctctttggcaagtaatgttcatcccagccaaatccaccagtctcagaaacgaagtccacttcgaaaccatgcttttcgaatgtatcgaacgatcgcaaaatctcaactacaaaaacgcctgttttcgcaccatctttgtagaagggaccgtggtatgaagtaagagatattagcgctctttttggagtcattgcaaggccagttttctttttgaatgaaggagaaaagtgttctagaaatatgttttagttctaagtatcgttgtctggagcaagcaaagaaaagcagacctgtatgtgcaactttcctgttttccattaaaatctcaagaaccgaccccttgactgtgctcatatatcaagtatcggttttaaagtcccctaattgtgataattgcaagaacgacagtcagaaagatatttttttttttctttctctttacctatcctccataaaaatacctatgctgatactgaatatcttcatttgcagctatgcaatatttcagataccccattttacccaagagtttcttactggtggttggattttctttaagacgagaagattaccagtcctggatgttcgtgaatgtgcctattgcgtcatcagcgactccgcgccaagaaaagaaatactcgcatgctcggatttatagaatcgcataatggaaataccttccttaaaggatggagataaggaaaaaatgacaagaacaaggaagtacttgggagctttctccgacatggtaaatatttgaaactcacgcagctctcctggaaagttggatctggaaaggtaaggttgttttttttacagacatcaaccaaaatcggttcttgtagtagacaatgtcacagatcgccacaagttgaaaaaaaagtttcgatgaactggataaggggagaggtcacaaacaaagtgtagggggtgagtagtatagtggtaacttgttcatttacctaaataacattctcactagaaaagagatattgaaagactcctcgtttacctaacttggctggttcttaggtatataatagaaacatggatctggcaggttatcacttacagtttgcactcccaccaggttacaattttcattatatatagttattttttaccaccacttcttcttctttcactttgtcttgcaatagaaataccaaaacaaggtgaggaaaaaatcgaatctcaacgataaaaatatgtccatcacgaaggtacatgctagaacggtgtatgattctcgcggcaatccgactgttgaggttgaaattacaacagagaatggtctcttcagagcgatcgtcccatctggtgcctccaccggcattcacgaagctgttgaacttagagacgggaacaagtccgaatggatgggaaaaggggtgaccaaggcagtcagtaacgtcaatagtatcatagggcctgctttaatcaagtccgaattatgtgtaaccaatcagaagggcatagacgagctcatgatatcgttagacggaacttctaacaagtcaaggttgggcgccaatgctatccttggtgtttccttgtgcgttgctcgagctgctgccgcacaaaagggaattactctctacaagtatatagccgagttagcggatgctagacaggacccctttgttattcctgttccttttttcaatgttttgaatggtggagcccacgccggtggctctttagctatgcaagaattcaagatcgcgccagtcggggctcagagctttgcagaagccatgaggatgggttcggaagtttaccatcatttgaagatattggcgaaggagcaatatggaccttccgctggaaatgttggtgacgagggtggagttgcccccgatattgacactgccgaagacgccttggacatgattgtggaagccattaacatatgcggttacgagggtagagtgaaagtaggaatcgatagtgctccttctgttttttataaggacgggaaatacgacctaaatttcaaggaaccgaactctgacccatctcactggctcagtccagcccagttagcagaatattaccattcattgctaaagaaatacccaatcatttccctggaagatccctacgccgaagatgattggtcctcgtggtctgccttcctaaagactgtcaatgttcagattattgcagatgacctgacatgcaccaacaagaccaggatcgcccgtgctatagaggagaaatgtgcgaatactctgttgctgaaactcaaccagatcggtactctgactgagtctattgaagccgccaatcaggctttcgatgctggatggggtgtaatgatatcgcatagatcaggtgaaaccgaagatccgtttatcgctgatttggtcgttggtttaagatgtggtcaaattaaatcgggcgctttgtcgagatcagaaagactggccaagtataatgaacttttgcgtatcgaagaggaactgggggacgattgtatatatgctggtcataggtttcatgatggaaacaaactataaaggattgtcttgtttccttttttttttttttttttttgtttttttatgactaaataaagtaaatcatatgaggttttattttttatttcgttgatttgggttacagtatggaaatggggcatttgacacaagttattttattcatatgttttatcttgtaggaaatcaaaccgtttttaaagttttccattgcctacacacaaaatcattacgaatctgtctgaacaagggtggacgtgtgggggaaggctgttccaatcaagaaatgcttacaactctactaacactgcagtttttcagctttctgattaatctcttcggtttaaattttttagcagctattactttctagtaacccttataacgcggttggtatcaaatcttcctgatagtacaagcagacctttgaccccattcttgttgtgtcttgaaatctttttttctgacaaaagtaagaagttacaccataatagagaagttaaataatgaaagtgtatcgatcatagaaatgattttatttttttcaactactgttacggtcaagaaactaatactgaggataagttttcgcaacaatgattttggtacaagtgatttaaagtcttgaattacttcaacacaatttgctttgcgacggtttagaataacgtaatcgtatcaacgaatccactaggcgcgcgtaaaaattacagactctaacaatatacgactcccagcacatacctactattctgtacaattccgggaaataggagggtacagtattattttttctcggcgatcgtttagggtatactggagataggcttagcaatacgcttctgaacgaggatctatagcaactaaattcagacattctgctataccaaaaaaggaagtatcacaggcacggaaaagggttttataaggcacctcggcacccctataactggcattctcacattcggcgcatacgaatagacaaaggccccagaaaacaataccttcgcatacagaatctataaagatgcatgcctcgtttaaaaacaaaaacatcttcatagtgatcatgaagttgtgggaaagatgagatatggagaatatgtgaagtgctaaaggagcatctgttaacgaatcgtttaagtggtgatgaccaatgaaggaataggtataaatagagatacttcaactatatgccttcgagaatatgtctttattcatttctttcctgttaagcttatatcagcactaacaaacaaaacaaatacaatggtcaaattaacttcaatcgctgctggtgttgccgctatcgctgccggtgttgccgctgctccagccactaccactctatctccatctgacgaaagagtcaacttggtcgaattgggtgtttacgtctccgatatcagagctcatttggctcaatactacttgtttcaagcagctcatccaacagagacctacccagttgagattgctgaagctgttttcaactatggtgacttcaccaccatgttgactggtattccagctgaacaagtcaccagagtcatcactggtgtcccatggtactctaccagattgagaccggctatctccagtgctctatctaaggacggtatctacactgctattccaaaatagagagaagcttttacgaacgaaattccatagacattaaaaagtaaagaaaatgaaataaaatatgttattctattgatataaatacaatttctcatatgtaaatgtatattaatatgacaactcatttttgatcaataacagtgtttgtggagtattttctcaatacaataaacccaaaatagaaacttctcttttgcgtcactgttctggaaaagggtgcatggtaataaagctaatagggtatgtccaataagcaatactgaacttggaaatgtgcggcttcgcagccttttgtctttctataaaaatgtgtcgttcctttttttcattttttggcgcgtcgcctcggggtcgtttatagaatatgcgtcacttttaaaaataagattgcagatcagggcaaaacaagtagcaagtcatagcaagagaccctgatttttgtgacataaatattattatttctttgttaggttagttttttatgtaactgtaactggaatagagttgaggggatagcgcccacatgtgtgtgagccactaccgtattattgctcggtgaataaagagtgtcacaacaatgggatgacataatattctaatgtgaagtctgtgtaagtacgaaatattctgaagtggcatccgttcaagcaaatgggaatattaaggaacttttacgttaatgacgtcatggtagtgctcgtacttcaagtcaatatgtttatgtattattgttgaagaatggaatatttttatgtttaggtgattttgatggtgattttttggttatattaacataagtgtatataaattaagtggttagtatacggtgtaaaagtggtataacgtatgtattaagagcagttatacaatatttggggccgccgaatgagatatagatattaaaatgtggataatcgtgggagttatgcgtaaatggcacagggtatagaccgctgaggcaagtgccgttaataatgatgtgagtgcatttagtactgatgaagtgagagatgggccatggagtggaatgtgagagtagggtaacttgagatgatatatactgtagcatccgtgtgcctatgccatatcagtatacaagtgagggtggatacggcatgtggtggtagggtaagtatatgtgtattatttacgatcatttgttaacgtttcaacatggtgggtagaacaacagtatggtgagtagcggatgatggatggtagggtaatagtagggtaagtggtggtggagttggatatgggtaattggagggtaacggttatgatgggcggtggatggtagtagtaagtagagagatggatggtggttgggagtggtatggttgagtgagacagggtaacgagtggagaggtagggtaatggagggtaagttgagagacaggttcatcatatatatgtcactgtattgcatgctggatggtgttagacaaggccgtagggacatatagcatctaggaagtaaccttgtacgaaaataggcaatatttcctgtttaggcgattgtgacgcagattttagtccaacgatctagcgtcaaggaatttttttatagtgggacattgcaccaaggaagtaacttgatacgtcgtgggtgaatgggtctgttttcttattcggcggggtaatacatttttgggggaagtttgtctgtctgacgcgccatatgtaggtacgccaaaaagggctcctctacttcgaagcgcgaggtcgtatacctaataaggaaatgtaatttataactttctattatattggtcttttcgagagcggaagaagttgtaggctaagcgcaggctaagcgtaggtccatatttaaagtatccaagagaatatccacgaagcggctgagcaacgaacagaatcctggttctcctcgactaagcagatagttaagatactgtgcaccatggaaattgaaaacgaaagtacgtaccgactactttatttttgcaggccggaaatcaagcgatgaatgagacatccttctgttttctatgttgggacagacagtcgcttatcttagtgagatttcttattaactgaattttctttgctgctgctggagatttgcacctgcatagcgcagattctgcttcttctcaatagagtagcttaattattacattcttagatgatgataagacggaaactggacaatcttttgtttatattgatggatttcttgtcaaaaagcataacaatcaacatactattgttaatttcgaaacttacaaaaataaaatgaaagtttccgataggcgtaagtttgaaaaagcaaactttgacgagtttgagtcggctctaaataacaaaaacgacttggtacattgtccctcaataactttatttgaatcgatccccacggaagtgcggtcattctacgaagacgaaaagtctggcctaatcaaagtggtaaaattcagaactggtgcaatggataggaaaaggtcttttgaaaaaattgtcatttccgtcatggtcgggaaaaatgtacaaaagttcctgacatttgttgaagacgaaccagatttccagggcggaccaatcccttcaaagtatcttattcccaagaaaatcaacttgatggtctacacgttgtttcaagtgcatactttgaaattcaatagaaaggattacgataccctttctcttttttacctcaacagaggatactataatgagttgagtttccgtgtcctggaacgttgtcacgaaatagcgagtgccaggccgaacgacagctctacgatgcgtactttcactgactttgtttctggcgcacctattgtaaggagtcttcagaaaagcaccataaggaaatatgggtacaatttggcaccctacatgttcttgttactacacgtagatgagctatcgattttttctgcataccaagcaagtttacctggcgaaaagaaagtcgacacagagcggctgaagcgtgatctatgcccacgtaaacccattgagataaagtacttttcacagatatgtaacgatatgatgaacaaaaaagaccgattgggtgatattttgcatattatcttgcgagcatgtgcgctcaatttcggggcgggtccccgtggtggcgctggtgacgaagaggatcgatctattacgaatgaagaacccattattccctctgtggacgagcatggcttgaaagtatgtaagttgcgtagtcctaacactccacgaagactcagaaaaacactagatgccgtgaaagctttattggtgtcgtcttgtgcttgtactgcaagggatttagatatatttgatgacaccaacggcgttgcaatgtggaaatggatcaaaattctgtaccacgaagtagcgcaggaaaccacgctgaaggactcttatagaataactttggtaccttcttctgatggtatatcagtatgtggaaaactttttaatcgcgagtatgtccgcggcttttactttgcatgcaaggctcagttcgataacctttggggagagttgaacaactgcttttatatgcctacagtggttgatattgccagcctcattttgcgtaatcgagaagttttgttcagagagccaaagcgaggaattgacgagtatctggaaaacgattcttttcttcaaatgatacctgttaaatatcgtgaaattgtgctgcccaagttgagaagagatactaacaaaatgaccgcggctcttaaaaataaagtcactgttgcaattgacgagcttacggtgccacttatgtggatggtccattttgccgtaggatacccttaccgttatccagagcttcagctactcgcttttgccggtcctcagcgcaacgtatacgtcgatgatacaacaagacgcatccaactgtacactgattacaacaagaacggttcatcggagcctcgacttaagacgcttgacggactcacttcagattacgtgttttattttgtcactgtgctaaggcaaatgcaaatatgtgcgcttggtaacagttatgacgcttttaatcatgatccttggatggatgtggtgggatttgaggatccagatcaagtaacaaatcgagacatttcgaggatagttttgtattcctacatgtttctgaataccgcgaagggctgtctggttgaatacgcaacttttcggcagtacatgagggaacttccgaagaatgcacctcagaagctgaattttcgggagatgcgtcaggggttgattgccctaggacggcactgcgtaggtagcagatttgaaacagatttgtacgagtcggcgacgagtgaactcatggccaatcattccgttcaaacagggcgaaatatttacggtgtggattccttttcgttaactagtgtcagtgggacgaccgccactttattgcaggaacgagcttccgagcgctggattcaatggttaggccttgaaagcgactaccattgttcattctctagtactcggaatgcggaagacgtagtggcaggtgaggcggcgagttcagatcatgatcaaaaaatttcaagagtaacgcgaaaaaggccccgagagcccaagagtacaaacgatatcctcgtcgcaggccagaaactctttggcagctcctttgaattcagggacttgcatcagttgcgcttatgtcatgaaatatacatggcagacacaccctctgtggcagtacaggccccaccgggctatggtaagacggagttatttcatctccccttgatagcactggcgtctaagggcgacgtgaaatatgtgtcgtttctgtttgtaccgtacacagtgttgcttgctaattgcatgatcaggttgagccgatgcggttgcttgaatgtggcccctgtaagaaactttattgaagaaggttgcgatggcgttactgatttatacgtggggatctacgatgatcttgctagcactaatttcacagacaggatagctgcgtgggagaatattgttgagtgcacctttaggaccaacaacgtaaaattgggttacctcattgtagatgagtttcacaactttgaaacggaggtctaccggcagtcgcaatttgggggcataactaaccttgattttgacgcttttgagaaagcaatctttttgagcggcacagcacctgaggctgtagctgatgctgcgttgcagcgtattgggcttacgggactggccaagaagtcgatggacatcaacgagctcaaacggtcggaagatctcagcagaggtctatccagctatccaacacggatgtttaatctaatcaaggagaaatccgaggtgcctttagggcatgttcataaaatttggaagaaagtggaatcacagcccgaagaagcactgaagcttcttttagccctctttgaaattgaaccagagtcgaaggccattgtagttgcaagcacaaccaacgaagtggaagaattggcctgctcttggagaaagtattttagggtggtatggatacacgggaagctgggtgctgcagaaaaggtgtctcgcacaaaggagtttgtcactgacggtagcatgcgagttctcatcggaacgaaattagtgactgaaggaattgacattaagcaattgatgatggtgatcatgcttgataatagacttaatattattgagctcattcaaggcgtagggagactaagagatgggggcctctgttatctattatctagaaaaaacagttgggcggcaaggaatcgtaagggtgaattaccaccgattaaggaaggctgtataaccgaacaggtacgcgagttctatggacttgaatcaaagaaaggaaaaaagggccagcatgttggatgctgtggctccaggacagacctgtctgctgacacagtggaactgatagaaagaatggacagattggctgaaaaacaggcgacagcttccatgtcgatcattgcgttaccgtctagcttccaggagagcaatagcagtgacaggtgcagaaagtattgcagcagtgatgaggacagcgacacgtgcattcatggtagtgctaatgccagtaccaatgcgactaccaactccagcactaatgctactaccactgccagcaccaacgtcaggactagtgctactaccactgccagcatcaacgtcaggactagtgcgattaccactgaaagtaccaactccagcactaatgctactaccactgccagcaccaacgtcaggactagtgctactaccactgccagcatcaacgtcaggactagtgcgactaccactgaaagtaccaactccaacactagtgctactaccaccgaaagtaccgactccaacactagtgctactaccaccgaaagtaccgactccaacactagtgctactaccactgctagcaccaactccagcactaatgccactaccactgctagcaccaactccagcactaatgccactaccactgaaagtaccaacgctagtgccaaggaggacgccaataaagatggcaatgctgaggataatagattccatccagtcaccgacattaacaaagagtcgtataagcggaaagggagtcaaatggttttgctagagagaaagaaactgaaagcacaatttcccaatacttccgagaatatgaatgtcttacagtttcttggatttcggtctgacgaaattaaacatcttttcctctatggtattgacgtatacttctgcccagagggagtattcacacaatacggattatgcaagggctgtcaaaagatgttcgagctctgtgtctgttgggctggccagaaagtatcgtatcggaggatggcttgggaagcactagctgtggagagaatgctgcgaaatgacgaggaatacaaagaatacttggaagacatcgagccatatcatggggaccctgtaggatatttgaaatattttagcgtaaaaaggggagagatctactctcagatacagagaaattatgcttggtacctggccattactagaagaagagaaacaattagtgtattggattcgacaagaggcaagcaagggagccaagttttccgcatgtctggaaggcagatcaaagagttgtattataaagtatggagcaacttgcgtgaatcgaagacagaggtgctgcagtactttttgaactgggacgagaaaaagtgccgggaagaatgggaggcaaaagacgatacggtctttgtggaagcgctcgagaaagttggagtttttcagcgtttgcgttccatgacgagcgctggactgcagggtccgcagtacgtcaagctgcagtttagcaggcatcatcgacagttgaggagcagatatgaattaagtctaggaatgcacttgcgagatcagcttgcgctgggagttaccccatctaaagtgccgcattggacggcattcctgtcgatgctgatagggctgttctacaataaaacatttcggcagaaactggaatatcttttggagcagatttcggaggtgtggttgttaccacattggcttgatttggcaaacgttgaagttctcgctgcagataacacgagggtaccgctgtacatgctgatggtagcggttcacaaagagctggatagcgatgatgttccagacggtagatttgatataatattactatgtagagattcgagcagagaagttggagagtgaaggaaattgttgttacgaaagtcagtgattatgtattgtgtagtatagtatattgtaagaaatttttttttctagggaatatgcgttttgatgtagtagtatttcactgttttgatttagtgtttgttgcacggcagtagcgagagacaagtgggaaagagtaggataaaaagacaatctataaaaagtaaacataaaataaaggtagtaagtagcttttggttgaacatccgggtaagagacaacagggcttggaggagacgtacatgagggctatttagggctatttagggctatgtagaagtgctgtagggctaaagaacagggtttcattttcattttttttttttaatttcggtcagaaagccgggtaaggtatgacagcgagagtagaggtagatgtgagagagtgtgtgggtgtggtgtgt

SEQ ID NO: 12219 - DNA, 948061 bp, Saccharomyces cerevisiae
aaatagccctcatgtacgtctcctccaagccctgttgtctcttacccggatgttcaaccaaaagctacttactacctttattttatgtttactttttatagattgtctttttatcctactctttcccacttgtctctcgctactgccgtgcaacaaacactaaatcaaaacagtgaaatactactacatcaaaacgcatattccctagaaaaaaaaatttcttacaatatactatactacacaatacataatcactgactttcgtaacaacaatttccttcactctccaacttctctgctcgaatctctacataataatatatcaaatctaccgtctggaacatcatcgctatccagctctttgtgaaccgctaccatcagcatgtacagcggtaccctcgtgttatctgcagcgagaacttcaacgtttgccaaatcaagccaatgtggtaacaaccacacctccgaaatctgctccaaaagatattccagtttctgccgaaatgttttattgcagaacagccctatcagcatcgacaggaatgccgtccaatgcggcactttagatggggtaactcccagcgcaagctgatctcgcaagtgcattcctagacttaattcatatctgctcctcaactgtcgatgatgcctgctaaactgcagcttgacgtactgcggaccctgcagtccagcgctcgtcatggaacgcaaacgctgaaaaactccaactttctcgagcgcttccacaaagaccgtatcgtcttttgcctcccattcttcccggcactttttttcgtcccagttcaaaaagtactgcagcacctctgtcttcgattcacgcaagttgctccatactttataatacaactctttgatctgccttccagacatgcggaaaacttggctcccttgcttgcctcttgtcgaatccaatacactaattgtttctcttcttctagtaatggccaggtaccaagcataatttctctgtatctgagagtagatctctcccctttttacgctaaaatatttcaaatatcctacagggtccccatgatatggctcgatgtcttccaagtattctttgtattcctcgtcatttcgcagcattctctccacagctagtgcttcccaagccatcctccgatacgatactttctggccagcccaacagacacagagctcgaacatcttttgacagcccttgcataatccgtattgtgtgaatactccctctgggcagaagtatacgtcaataccatagaggaaaagatgtttaatttcgtcagaccgaaatccaagaaactgtaagacattcatattctcggaagtattgggaaattgtgctttcagtttctttctctctagcaaaaccatttgactccctttccgcttatacgactctttgttaatgtcggtgactggatggaatctattatcctcagcattgccatctttattggcgtcctccttggcactagcgttggtactttcagtggtagtggcattagtgctggagttggtgctagcagtggtagtggcattagtgctggagttggtgctagcagtggtagtagcactagtgttggagtcggtactttcggtggtagtagcactagtgttggagtcggtactttcggtggtagtagcactagtgttggagttggtactttcagtggtagtcgcactagtcctgacgttgatgctggcagtggtagtagcactagtcctgacgttggtgctggcagtggtagtagcattagtgctggagttggtactttcagtggtagtcgcactagtcctgacgttgatgctggcagtggtagtagcactagtcctgacgttggtgctggcagtggtagtagcattagtgctggagttggtagtcgcattggtactggcattagcactaccatgaatgcacgtgtcgctgtcctcatcactgctgcaatactttctgcacctgtcactgctattgctctcctggaagctagacggtaacgcaacgatcgacatggaagctgtcgcctgtttttcagccaatctgtccattctttctatcagttccactgtgtcagcagacaggtctgtcctggagccacagcatccaacatgctggcccttttttcctttctttgattcaagtccatagaactcgcgtacctgttcggttatacagccttccttaatcggtggtaattcacccttacgattccttgccgcccaactgttttttctagataatagataacagaggcccccatctcttagtctccctacgccttgaatgagctcaataatattaagtctattatcaagcatgatcaccatcatcaattgcttaatgtcaattccttcagtcactaatttcgttccgatgagaactcgcatgctaccgtcagtgacaaactcctttgtgcgagacaccttttctgcagcacccagcttcccgtgtatccataccaccctaaaatactttctccaagagcaggccaattcttccacttcgttggttgtgcttgcaactacaatggccttcgactctggttcaatttcaaagagggctaaaagaagcttcagtgcttcttcgggctgtgattccactttcttccaaattttatgaacatgccctaaaggcacctcggatttctccttgattagattaaacatccgtgttggatagctggatagacctctgctgagatcttccgaccgtttgagctcgttgatgtccatcgacttcttggccagtcccgtaagcccaatacgctgcaacgcagcatcagctacagcctcaggtgctgtgccgctcaaaaagattgctttctcaaaagcgtcaaaatcaaggttagttatgcccccaaattgcgactgccggtagacctccgtttcaaagttgtgaaactcatctacaatgaggtaacccaattttacgttgttggtcctaaaggtgcactcaacaatattctcccacgcagctatcctgtctgtgaaattagtgctagcaagatcatcgtagatccccacgtataaatcagtaacgccatcgcaaccttcttcaataaagtttcttacaggggccacattcaagcaaccgcatcggctcaacctgatcatgcaattagcaagcaacactgtgtacggtacaaacagaaacgacacatatttcacgtcgcccttagacgccagtgctatcaaggggagatgaaataactccgtcttaccatagcccggtggggcctgtactgccacagagggtgtgtctgccatgtatatttcatgacataagcgcaactgatgcaagtccctgaattcaaaggagctgccaaagagtttctggcctgcgacgaggatatcgtttgtactcttgggctctcggggcctttttcgcgttactcttgaaattttttgatgatgatctgaactcgccgcctcacctgccactacgtcttccgcattccgagtactagagaatgaacaatggtagtcgctttcaaggcctaaccattgaatccagcgctcggaagctcgttcctgcaataaagtggcggtcgtcccactgacactagttaacgaaaaggaatccacaccgtaaatatttcgccctgtttgaacggaatgattggccatgagttcactcgtcgccgactcgtacaaatctgtttcaaatctgctacctacgcagtgccgtcctagggcaatcaacccctgacgcatctcccgaaaattcagcttctgaggtgcattcttcggaagttccctcatgtactgccgaaaagttgcgtattcaaccagacagcccttcgcggtattcagaaacatgtaggaatacaaaactatcctcgaaatgtctcgatttgttacttgatctggatcctcaaatcccaccacatccatccaaggatcatgattaaaagcgtcataactgttaccaagcgcacatatttgcatttgccttagcacagtgacaaaataaaacacgtaatctgaagtgagtccgtcaagcgtcttaagtcgaggctccgatgaaccgttcttgttgtaatcagtgtacagttggatgcgtcttgttgtatcatcgacgtatacgttgcgctgaggaccggcaaaagcgagtagctgaagctctggataacggtaagggtatcctacggcaaaatggatcatccacataagtggcaccgtaagctcgtcaattgcaacagtgactttatttttaagagccgcggtcattttgttagtatctcttctcaacttgggcagcacaatttcacgatatttaacaggtatcatttgaaggaaagaatcgttctccagatactcgtcaattcctcgctttggctctctgaacaaaacttctcgattacgcaaaatgaggctggcaatatcaaccactgtaggcatataaaagcagtcgttcaattcttcccaaaggttatcaaactgagccttgcatgcaaagtaaaagccgcggacatactcgcgattaaacagttttccacatactgatacaccatcagaagaaggtaccaaagttattctataagagtccttcagcgcggtttcctgcgctacttcgtggtacagaattttgatccatttccacatcgcaacgccgttgttgtcatcaaatatatctaaatcccttgcggtacaagcacaagacgacaccaataaagctttcacggcatctagtgtttttctgagtcttcgtggagtgttaggactgcgcaacttacatactttcaagccatgctcgtccacagagggaataatgggttcttcattcgtaatggatcgatcctcttcgtcaccagcgccaccacggggacccgccccgaaattgagcgcacatgctcgcaagataatatgcaaaatatcacccaatcggtcctttttgttcatcatatcgttacatatctgtgaaaagtactttatctcagtgggtttacgtgggcatagatcacgcttcagccgctctgtgtcgactttcttttcgccaggtaaacttgcttggtatgcagaaaaaatcgatagctcatctacgtgtagtaacaaaaacatgtagggtgccaaattgtatccatatttccttatggtgcttttctgaagaccccttacaataggtgtgccagaaacaaagtcagtgaaagtacgcatcgtagagctgtcgttcggcctggcactcgctatttcgtaacaacgttccaggacacggaaactcaactcattatagtatcctctgttgaggtaaaaaagagaaagggtatcgtaatcctttctattgaatttcaaagtatgcacttgaaacaacgtgtagaccatcaagttgattttcttgggaataagatactttgaagggattggtccgccctggaaatctggttcgtcttcaacaaacgtcaggaacttttgtacatttttcccgaccatgacggaaacgacaattttttcaaaagaccttttcctatccattgcaccagttctgaattttaccactttgattagaccagacttttcgtcttcgtagaatgaccgcacttccgtggggatcgattcaaataaagttattgagggacaatgtaccaagtcgtttttgttatttagagccgactcaaactcgtcaaagtttgctttttcaaacttacgcctatcggaaactttcattttatttttgtaagtttcgaaattaacaatagtatgttgattgttatgctttttgacaagaaatccatcaatataaacaaaagattgtccagtttccgtcttatcatcatctaagaatgtaataattaagctattgagaagatgcagaatctgcgctatgcaggtgcaaatctctagcagcagcaaagtaaattcagttagtaagaaatctcactaagataagcgactgtctgtccccttcaagcacaacatagaaagcagaaggatgtctcattcatcgcttgatttccggcctgcaaaaataaagtagtcggtacgtacgttcgttttcaatttccatggtgcacagtatcttaactatctgcttagtcgaggagaaccaggattctgttcgttgctcagccgcttcgtggatattctcttggatactttaaatatggacctacgcttagcctgcgcttagcctacaacttcttccgctctcgaaaagaccaatataatagaaagttataaattacatttccttattaggtatacgacctcgcgcttcgaagtagaggagccctttttggcgtacctacatatggcgcgtcagacagacaaacttcccccaaaaatgtattaccccgccgaataagaaaacagacccattcacccacgacgtatcaagttacttccttggtgcaatgtcccactataaaaaaattccttgacgctagatcgttggactaaaatctgcgtcacaatcgcctaaacaggaaatattgcctattttcgtacaaggttacttcctagatgctatatgtccctacggccttgtctaacaccatccagcatgcaatacagtgacatatatatgatgaacctgtctctcaacttaccctccattaccctacctctccactcgttaccctgtctcactcaaccataccactcccaaccaccatccatctctctacttactactaccatccaccgcccatcataaccgttaccctccaattacccatatccaactccaccaccacttaccctactattaccctaccatccatcatccgctactcaccatactgttgttctacccaccatgttgaaacgttaacaaatgatcgtaaataatacacatatacttaccctaccaccacatgccgtatccaccctcacttgtatactgatatggcatacgcacacggatgctacagtatatatcatctcaagttaccctactctcacattccactccatggcccatctctcacttcatcagtactaaatgcactcacatcattattaacggcacttgcctcagcggtctataccctgtgccatttacgcataactcccacgattatccacattttaatatctatatctcattcggcggccccaaatattgtataactgctcttaatacatacgttataccacttttacaccgtatactaaccacttaatttatatacacttatgttaatataaccaaaaaatcaccatcaaaatcacctaaacataaaaatattccattcttcaacaataatacataaacatattgacttgaagtacgagcactaccatgacgtcattaacgtaaaagttccttaatattcccatttgcttgaacggatgccacttcagaatatttcgtacttacacagacttcacattagaatattatgtcatcccattgttgtgacactctttattcaccgagcaataatacggtagtggctcacacacatgtgggcgctatcccctcaactctattccagttacagttacataaaaaactaacctaacaaagaaataataatatttatgtcacaaaaatcagggtctcttgctatgacttgctacttgttttgccctgatctgcaatcttatttttaaaagtgacgcatattctataaacgaccccgaggcgacgcgccaaaaaatgaaaaaaaggaaggacacatttttatagaaagacaaaaggctgcgaagccgcacatttccaagttcagtattgcttattggacataccctattagctttattaccatgcacccttttccagaacagtgacgcaaaagagaagtttctattttgggtttattgtattgagaaaatactccacaaacactgttattgatcaaaaatgagttgtcatattaatatacatttacatatgagaaattgtatttatatcaatagaataacatattttatttcattttctttactttttaatgtctatggaatttcgttcgtaaaagcttctctctattttggaatagcagtgtagataccgtccttagatagagcactggagatagccggtctcaatctggtagagtaccatgggacaccagtgatgactctggtgacttgttcagctggaataccagtcaacatggtggtgaagtcaccatagttgaaaacagcttcagcaatctcaactgggtaggtctctgttggatgagctgcttgaaacaagtagtattgagccaaatgagctctgatatcggagacgtaaacacccaattcgaccaagttgactctttcgtcagatggagatagagtggtagtggctggagcagcggcaacaccggcagcgatagcggcaacaccagcagcgattgaagttaatttgaccattgtatttgttttgtttgttagtgctgatataagcttaacaggaaagaaatgaataaagacatattctcgaaggcatatagttgaagtatctctatttatacctattccttcattggtcatcaccacttaaacgattcgttaacagatgctcctttagcacttcacatattctccatatctcatctttcccacaacttcatgatcactatgaagatgtttttgtttttaaacgaggcatgcatctttatagattctgtatgcgaaggtattgttttctggggcctttgtctattcgtatgcgccgaatgtgagaatgccagttataggggtgccgaggtgccttataaaacccttttccgtgcctgtgatacttccttttttggtatagcagaatgtctgaatttagttgctatagatcctcgttcagaagcgtattgctaagcctatctccagtataccctaaacgatcgccgagaaaaaataatactgtaccctcctatttcccggaattgtacagaatagtaggtatgtgctgggagtcgtatattgttagagtctgtaatttttacgcgcgcctagtggattcgttgatacgattacgttattctaaaccgtcgcaaagcaaattgtgttgaagtaattcaagactttaaatcacttgtaccaaaatcattgttgcgaaaacttatcctcagtattagtttcttgaccgtaacagtagttgaaaaaaataaaatcatttctatgatcgatacactttcattatttaacttctctattatggtgtaacttcttacttttgtcagaaaaaaagatttcaagacacaacaagaatggggtcaaaggtctgcttgtactatcaggaagatttgataccaaccgcgttataagggttactagaaagtaatagctgctaaaaaatttaaaccgaagagattaatcagaaagctgaaaaactgcagtgttagtagagttgtaagcatttcttgattggaacagccttcccccacacgtccacccttgttcagacagattcgtaatgattttgtgtgtaggcaatggaaaactttaaaaacggtttgatttcctacaagataaaacatatgaataaaataacttgtgtcaaatgccccatttccatactgtaacccaaatcaacgaaataaaaaataaaacctcatatgatttactttatttagtcataaaaaaacaaaaaaaaaaaaaaaaaaaaaggaaacaagacaatcctttatagtttgtttccatcatgaaacctatgaccagcatatatacaatcgtcccccagttcctcttcgatacgcaaaagttcattatacttggccagtctttctgatctcgacaaagcgcccgatttaatttgaccacatcttaaaccaacgaccaaatcagcgataaacggatcttcggtttcacctgatctatgcgatatcattacaccccatccagcatcgaaagcctgattggcggcttcaatagactcagtcagagtaccgatctggttgagtttcagcaacagagtattcgcacatttctcctctatagcacgggcgatcctggtcttgttggtgcatgtcaggtcatctgcaataatctgaacattgacagtctttaggaaggcagaccacgaggaccaatcatcttcggcgtagggatcttccagggaaatgattgggtatttctttagcaatgaatggtaatattctgctaactgggctggactgagccagtgagatgggtcagagttcggttccttgaaatttaggtcgtatttcccgtccttataaaaaacagaaggagcactatcgattcctactttcactctaccctcgtaaccgcatatgttaatggcttccacaatcatgtccaaggcgtcttcggcagtgtcaatatcgggggcaactccaccctcgtcaccaacatttccagcggaaggtccatattgctccttcgccaatatcttcaaatgatggtaaacttccgaacccatcctcatggcttctgcaaagctctgagccccgactggcgcgatcttgaattcttgcatagctaaagagccaccggcgtgggctccaccattcaaaacattgaaaaaaggaacaggaataacaaaggggtcctgtctagcatccgctaactcggctatatacttgtagagagtaattcccttttgtgcggcagcagctcgagcaacgcacaaggaaacaccaaggatagcattggcgcccaaccttgacttgttagaagttccgtctaacgatatcatgagctcgtctatgcccttctgattggttacacataattcggacttgattaaagcaggccctatgatactattgacgttactgactgccttggtcaccccttttcccatccattcggacttgttcccgtctctaagttcaacagcttcgtgaatgccggtggaggcaccagatgggacgatcgctctgaagagaccattctctgttgtaatttcaacctcaacagtcggattgccgcgagaatcatacaccgttctagcatgtaccttcgtgatggacatatttttatcgttgagattcgattttttcctcaccttgttttggtatttctattgcaagacaaagtgaaagaagaagaagtggtggtaaaaaataactatatataatgaaaattgtaacctggtgggagtgcaaactgtaagtgataacctgccagatccatgtttctattatatacctaagaaccagccaagttaggtaaacgaggagtctttcaatatctcttttctagtgagaatgttatttaggtaaatgaacaagttaccactatactactcaccccctacactttgtttgtgacctctccccttatccagttcatcgaaacttttttttcaacttgtggcgatctgtgacattgtctactacaagaaccgattttggttgatgtctgtaaaaaaaacaaccttacctttccagatccaactttccaggagagctgcgtgagtttcaaatatttaccatgtcggagaaagctcccaagtacttccttgttcttgtcattttttccttatctccatcctttaaggaaggtatttccattatgcgattctataaatccgagcatgcgagtatttcttttcttggcgcggagtcgctgatgacgcaataggcacattcacgaacatccaggactggtaatcttctcgtcttaaagaaaatccaaccaccagtaagaaactcttgggtaaaatggggtatctgaaatattgcatagctgcaaatgaagatattcagtatcagcataggtattttcatgaaggataggtaaaaagaaagaaaagaaaaatatctttttgactgttgttcttgcaattatcacaattaggggactttaaaaccgatacttgatatatgagcacagtcaaggggccggttcttgagattttaatggaaaagaggaaagttgcacatacaggtctgcttttctttgcttgctccagacaacgatacttagaactaaaacatatttctagaacacttttctccttcattcaaaaagaaaactggccttgcaatgactccaaaaagagcgctaatatctcttacttcataccacggtcccttctataaagatggtgcgaaaacaggcgtttttgtagttgagattttgcggtcgttcgatactttcgaaaagcatggtttcgaagtggacttcgtttctgagactggtggatttggctgggatgaacattacttgccaaagagctttattggtggcgaagataagatgaactttgaaacgaaaaattccgccttcaataaggcgttagcgaggatcaagaccgcaaatgaagtcaacgccagcgactataaaatattctttgcatctgctggacatggtgctctatttgactatcccaaagctaaaaatctgcaagatattgcatccaagatatatgccaatgggggtgtgatcgctgccatctgtcatggaccgctccttttcgatggattaatagatatcaaaacaacaagaccattaatcgaaggcaaagctataacaggtttcccactcgagggtgaaatcgccctgggagttgacgacatcttgaggagcagaaaattgacaacggttgaacgcgttgcaaacaagaatggagccaagtacttggcgccaatccatccctgggatgactactctattacagatggaaagctagttacgggtgttaacgcaaattcttcctattcgaccacaattagagctataaacgcattatatagctgaaacaaaagacaagggaattgttgaaggggaggcttctaatggctttcagtttctgtgaagagaaggctaacagctcaatggttcgaaaggtaaagaaaacggcaggtcggtagcactcgattttgctagaatggaaatcatatagagaacaattgaatagtaggccttggtttttagtgttgtactcatcatggtcatatgtgacataggtaatgtacatatatatataaaaaaaaaaaaagcaatgctgtgagatcattcgttacttacgaaatacgcagattgcaatttgaaataagctgtgttttcttttttttcctttttttttcttttttttggcttgttatatacaacttttttctatttctgttctttttagaagtaattaattggtacataggaaataaatatgaattatattaaatgaagtaaaagtaaaagaaaacggggaaatttatcgttttgtagtaaatagatgatggaacgcattcataaaatctcacaaaatattacaataaaccgcagtagtcggtaaaaatgtattatacaacgtctaaaatcttgaaaatgaattaaaaaaaaaaaaaggtgggatgattgtgcaggaaaaggtatgaagaaaagatcctaacaaatcgggttagtcaatcctctagtccaagcataggatccgagagttatcaccaataagcaatatgaaattccaatcgaaacagtataataaataagcatgttaataaatgatagcttatacccttcattgataaacgtgctaatggtactcaaagtgccgcaaaatccggatattaacgcagaaacaatatggcatgaattcaacgagttcacaattggaatatccgtggaaaagtgttttttaccacgttgcaccatggtaaatatgccaatcaataaagtggcgaaaacgtttgccaagaaagtacccaatggaaactttttgtttgttttattaaacatttctgccaaccaatatcttaggaaaccagcgaaaattccaaatagacatggtagtgtccacttgcccctcgaatagttctcataatacgcacacagcaccacaaacaaaataattaatggaaaagctagtgcgtacgcgagtttatccacaacatcaaaaaatttcttaaaaaatggtgctggagttttgaatttaaactctagaatatttttttccatttcttgtgtatcaacatcaccagcattttcctttacagtgtctgagggaggggtatatggcttcgaaaacgaactagatccataagcaacaataacctccttaccaagttgcctaccgaaaataagactacccatggaaaccataagatgaacgagcaagacagataaaaactccattataccgtaagctctgttcggcagttttgtgtggttagcgatattaccgttagttaagtttgtagagtgttcgaacatctctagcagcatactagaaaaggaagacagggcaccacagtacccagtagttacacctaaaaacaagacttggtgatctttcatccaagtgtaagcatttaaagattgcataatccccattagcatgcaggatgaacaattagaccagagaacggtcggagcagtaacgaaggccggagtgtaggtggaaagcgccgttatagcctgacgtgtttcagtacctaatatgcagaacgtggtgaatgtacaaaaaacatgaatataatggctcaacttgtgatttgatatgaccggattgaaaatcatcagagcattacacgctcgattaaataattaaataactgcagattcttgagccaccagacgctaaataataatggcggcaataaatataatcctttagtacttatttcagttgttttttgttttattttttccgtatctcttccgtatctcttccatcattgcgtcaaaagtgatttacactgctacatgaatcgcgccactttatgtcagtgaatctttcatacatcgcaactcctcactgacagtgactctagcagagtcaccatcttttcgatatacccatcaaagtgcacgattctcctcccctgttagacaatcgtaacgtaatatcgacatgtattcgtagcaccgctgccaaataattttcagatcgttcattgtacatgaaccaagcgctgttgctttactttatgatattgctgctgagctcccttgtctttcatacgacgttttatcttgatttcatatcttttttttttggtaaaatagaaaatactcaacagatatctgatatgtatataaacactaaataaagaaaatcttaaatcttgctggcatgactgtcgctgtgtctcaaatctcttagtaattcatagatgtgtatcaccccaaatctcaaaaacttcataattattattggattatctagaaatcatacccttcatactgtcccacaatggcctgctcacatgaggcgctaatgattacgattaaccatcaaatcatttatattgatacactgtagtttactgttaataaccaacctttgtcgagattcatcaaagtgggttccaaatccctcattgtgggaacctggttcagtcatacccattggagatgggccccaggaaggagtgtaacaaacttcatcccaattgcattgcctctcacaacggtaatttagttcaatccaccctagagattcaattaaaccatcgatagtggagcgagccgtttcgacattctttattaagtcgctggaagttgtgttatctgtcataaaagagtagacttcgggtatcaataaatcattcactttataaatgacatcaacaatttctccgacaacgctgacagcagatgaccaaatcaaaaagtctgcatccgtttttaaggcctggtatgggctcacatattggtagacaaaagttcaatgtgagtgctgttgcattgatggcaattgactcattaatatcaccatcgctgttcagtatgttactaacagattttagtaatggagcaaatttaaggacaagctcatcaaatgctaactgccaatccatactttgcgtggcatcaaatccgacttccagcgccttttctaagtcatctaccatgtccaattgcttttcccatgtcattccttcatcgagtaatcttctgttgttaggatcaggagcaatgtacgtcctgtttatcccgctcactaggtacctatagtcgatatggattcgatgctccccgttgtcatgcgctgcacccgctctcaactgattgaagcttttaactgcgttgaaattagaaaaagccttctcccaaccatcttctctttccagaatcgccttttggtcatctgttagctgatcttcaactaggcttccattttcatccagaggccaaccttcttccttcgatattacggtaggtgctggtaagcctaggtactggttaggctggaccatttctaacattgaaacaagttcgacgttatcagccgaaaaatcacacaaaacgacctcaaagccaacctctaccctgataattccgtcaagcccgaatggcttcccccatttgcatattctagcagcgtagagtcgttcggccattcgttcgttttcaccatcatctgtaaggttcaatttctctttaataacatttgacaacattagctgcgtgtccatctctcctgagtcagttttcgcagcagaagccccatcaagatagagaaatttgttgaggtcccgtgctgctctataagtaagcattttttgtgaaccccgacctttttcgtctggtggtggtggtggtggtggtggcccttttggatgatcaccgttggtgccattgccgaacctcccatgccttctttccaaagattttctcccataggatggtgacctcaagccgaaagagtagctgaattcatggtccatagctagccattcgaaggtagttggcacttttgatccggcatggtacattaaagttcctttgggaattacagcgggaaaataagatactccgacaggatgtatatccgatggagactgtcttaaagcagcccgaatggaattaaagatagccgtactgttatcaaaatcaatgtctctgacgaactcatggtaattatcccatcgtatagaaggtaagtctgtgcttttaattgcagattgattgtgtggtagggcagttgatactatgccgtaagatccagataacttccaacagaaaccaagcagtacaatgagtagtacgcctatgatggctgagataccttgacgatggaatcgcattctctatctaaacagtggtcaatggattcttcgagagctaagaccatagatttcttaaaagaatttttttttttttttctgtcctcctaatatcttttatctttaatactgtaggggcgcaagtttctttttttttttttttttatgttgcgtttagtttttctcttggcaaaagtttttcgcaccccgatctttttttgcatacgtagttcactgccgctgcttacggcagcgtttcactttgtttggagaacggttgttaacttgtatttgatatggtgtcgagacaatgtcattgcaagttatataaacattgtaatacatcacctcgatgaaagagaaactggaatgatagatctctttttctcaaaatttcgttaatatgtaataataaggttcctgatgtaatttgtttttgtacaaattattttagattctggaggttcaaataaaatatatattacagccaacgattaggggggacaagacttgattacacatttttcgttggtaacttgactcttttatgaaaagaaaacattaagttgaaggtgcacgcttgaggcgctcctttttcatggtgcttagcagcagatgaaagtgtcagaagttacctattttgtcaccatttgagaataagcttgaaagaaagttgtaaccccaacttttctatcttgcacttgtttggaccaacagccaaacggcttatcccttttcttttcccttataatcgggaatttccttactaggaaggcaccgatactataactccgaatgaaaaagacatgccagtaataaaaataattgatgttatgcggaatatactattcttggattattcactgttaactaaaagttggagaaatcactctgcactgtcaatcattgaaaaaaagaacatataaaagggcacaaaatcgagtcttttttaatgagttcttgctgaggaaaatttagttaatatatcatttacataaaacatgcatattattgtgttgtactttctttattcattttaagcaggaataattacaagtattgcaacgctaatcaaatcgaaataacagctgaaaattaatatgtcgaagggaaaggttttgctggttctttatgaaggtggtaagcatgctgaagagcaggaaaagttattggggtgtattgaaaatgaacttggtatcagaaatttcattgaagaacagggatacgagttggttactaccattgacaaggaccctgagccaacctcaacggtagacagggagttgaaagacgctgaaattgtcattactacgccctttttccccgcctacatctcgagaaacaggattgcagaagctcctaacctgaagctctgtgtaaccgctggcgtcggttcagaccatgtcgatttagaagctgcaaatgaacggaaaatcacggtcaccgaagttactggttctaacgtcgtttctgtcgcagagcacgttatggccacaattttggttttgataagaaactataatggtggtcatcaataagcaattaatggtgagtgggatattgccggcgtggctaaaaaatgagtatgatctggaagacaaaataatttcaacggtaggtgccggtagaattggatatagggttctggaaagattggtcgcatttaatccgaagaagttactgtactacgactaccaggaactacctgcggaagcaatcaatagattgaacgaggccagcaagcttttcaatggcagaggtgatattgttcagagagtagagaaattggaggatatggttgctcagtcagatgttgttaccatcaactgtccattgcacaaggactcaaggggtttattcaataaaaagcttatttcccacatgaaagatggtgcatacttggtgaataccgctagaggtgctatttgtgtcgcagaagatgttgccgaggcagtcaagtctggtaaattggctggctatggtggtgatgtctgggataagcaaccagcaccaaaagaccatccctggaggactatggacaataaggaccacgtgggaaacgcaatgactgttcatatcagtggcacatctctgcatgctcaaaagaggtacgctcagggagtaaagaacatcctaaatagttacttttccaaaaagtttgattaccgtccacaggatattattgtgcagaatggttcttatgccaccagagcttatggacagaagaaataagagtgattatgagtatttgtgagcagaagttttccggtctccttttgttcttgttttggcgtattctccactattcgtccatagcacatttataccttagctaaatattttgtaaagcaaaattttcgttatctcttaaaaaatagaagagcggtttattaatatcaaataattgaaactgctgatatggtagctatatacaaaatctgctgtcaaaatttggcagtaaacgatcttcacggtagcggttcaaataaagaggaaaagtccttctcccttactgtttttctggaatttggctcgtcgttaataacagaactaaagatacagtaaaaggagagatcgcaatcaacttcattaattgtaacagtagcataatcacaactggttatctgcgttatagacaattcttactcacaatgatgggcgcttagttggctgtaaacgtcgctttttaaaactccgaaaagttaccgctacagaaaaaaaccataaatgtatgctagttgcgcagagaggtttagggtccaaaatttactaccctgtcgctcactacagcgactgtcccgaattaagcccgaagagacgcagaactgttgtatgaacctcatgaaaccactgatcttgaagatttagaccttcagaatcgttttcaattagaagtatacaagaagtctttgtacaataatgtcaagacagagctctgaattatagttcagccttgttatttttttttccctggttgctaatttgtatcttgtctaatgaaaataatttgaggcaacgtaatgttaccaatgtacaactgtttttttcctctcgttagcttcgttcttgctgtattcacgagctttttttttttgactcttccctaaattcttatatcaagtgtaattttcaataatatttgattccagtttagcgtacctcgagttttgcctacctaaaatgcaaatgcgatctgcaagaatttctattgaaagtacaactttagttccaaatctccaatttttgattgctcaaaagtaaatgatactttaccgtccctagacttcggagggcctaatatattctcaagtatattcaaatttatgacgccagtaaaggtaaatatattatgaatatagaagccacagacttagatgtttgtattaggagatgctttccttgtcgacgcatatgttgtctatgacatagaaaacccacggactttcaatgctcaggcaagttttaaaaatcgcgaagaagacattaaaataatatttgataaagccgctggtgccatttcgcttctgatgctttagctgatggtttacgcatctagtagccgaattggaacagaatatttctctgacatagccatgcctatagagtctacaactttttggcgtctgtaaatattcttctacagccctgatgcaagtggaagttctacttgtttgaatagttcaagtttcaatgaaaggaccatcaagaagaaaaattgggagtatagacgccgtcgatcaaatgtctcctttccattattatcttccttatcttatcttctttctatatggtttgcatagcggaaaagacacacaggcgggaattttacaatttaataacctcctttatacgtccgcttttttacatatatgtgttattcattagttgtacgatacccttcatgtctttattcactgaccaatctctcctctaggaaagttcaggggcaccgtcaattgatagaacaaagcaaacactatgaatactttcttctggtacacataacaattgctagggtctgatttcaaaatgatggtgatgataaaaataagtcctgcttcttaaagcttttgacattaccgtgtacaaaattatcagaccatcttcctcttttctgagaatgaaatgaaaaattttgtaactgacatagcggagacagtttcacaagtaatttggtgctaactgttgtttgacctttaggaaattttctagtaaaaggaagaattcatatgaagatggtagtgttttaatgtgggtgcttttgttatgggagtgctacaatgataggccattgtcaaagtttggaaacagtagacttcaatggtaaataaagttaaatttaaggcgattccgatgaaatctgtctttcagaaggtttgttatctctaatgctaatctttaacatttacgccacttggagtggaatatacgttcaagttctttttgacatgcattctggtctcgacctactaacttcttacgctactttcttggattggatgcgttgcttctagtacctcttcctgcaaaacttgatcctataattggaacagttcttgcacacctttcttttgattgacggtacaaaaattttagctttctcaggaacttcggcgtttttgagcagattcagttgcattcttcagcagtaacacgctggagtttttacgaatgtaggcagtataaagcaggatcatgaagtatggtgaactggatgtgcgcagaaatccgacagaatacgtcaaaaatattgtacgtgtcaaacttcccttgtaaagattgtcgagtttattttgacactatggtgttggcaccctctgctttgtttttagcttacaattgaggagagatgcataagcatatttgtttttcttacgctgagcaatagacaggaaaataaatggcgcttactactcaacccactgtgttagaaccaaaaacaacacagcttcaaaaatgatacgtgccatttgatggtaatacagaggccgtagtagtgtttcaatcaatagaatactagaaattgcaacacaggtcaaaaagagaataaaaaaatgttaggggttcatagttaaaaatatgatatgtttttgagtttggggagaaaaggctgcttttgttccatagtgcgtcttttaaaaattttcatccttgttattatcaaactttttcctgggcggtaacctagctgaataagaacgatttggctgcaatcgccgagaaaacaaccaagccaagaattcccaaaagggatatgcttgcatccgcattgttccctcggttctactaataagaaagagtaagagacaatgtttagcgctattaagttatgctatggttacatcattttggcggactggatcatgtctgtcgagaaaaacttgaccgataattcaacgaagtattggtgcctaagctttgcatcataatatcttacaagttttgctgagaacagatagaggcataaatgaatgatttacgtcttattttttgataaggaggtatcgacgtctgccagcttaagaatatgaaatctggcgcatgatttcttcaaaataactcagatattgtcaagaacagcccactattgcttggaagtgaaaatatacgccaaaagtgcattttactttctacaattcaccacagtcttcgagatatatttatcatttaaatcacatggacacccaccgaactggttacaagctatattcgcatcacacagaatgatgtggcgtctatgctatacggcgatgttactatatcattaacctctcttttcggttccgagcgctttcggctcaagaactggggatgactaaaaaaaaagaactgtgtacgtgatttctttgtcccctgcggttgcatagacatcgctgtcgcacggcaagagcgcacacagtcatcagtctacaaaacctaacttttcaagagcaaccagtataaatattttgagccattgagggcataaagcgaaaggcacattttcaaaattggtcttaggttcatcttctgatgttatgtcgagagctctgaaaaccaattattttgaaagctaacatttcaaaaggctatttcttctgaaatatcaagatggatatactcaagaggggaaatgaatcggacaagtttacgaaaatagagacagaatctactacgataccaaatgactcggatagatctggttcactgatcagaagaatgaaggattccttcaagcaaagtaacctgcatgtcattccagaagaccttgaaaacagcgaacagacagagcaggaaaaaatccaatggaaactagcttctcagccctatcaaaaagtcttgagccaaaggcacttgaccatgattgccataggtggtactttggggacgggactgttcattggtttaggttattctttggcatctgggccagccgctttgctaatcggttttttgttagttggtacttcaatgttctgtgtcgttcagagtgccgcagagctttcctgccaattcccggtttctggctcatatgccacacatgtcagtaggttcatagatgaatcggttggctttactgtggctacaaactatgctttggcttggctgatttcttttccaagcgaattaattggttgtgcacttactatttcatactggaaccaaacggttaatccggctgtttgggtggccattttttatgttttcattatggtactgaacttgtttggtgtgagaggctttgccgagactgagtttgctctgtcaatcattaaggttattgctatatttattttcatcattattggtatcgtccttattgccggaggggggcctaactctactggttatattggcgccaaatactggcacgacccaggtgccttcgcaaaacctgtcttcaagaatttgtgtaacacattcgtttctgctgctttttcctttggtggtagtgagttagtgctgttaactagtacagaatctaaaaatatttcagctatatcacgtgctgccaaaggtacgttctggagaatcgcgattttttacattactaccgttgtcattattggatgtctcgtaccttataacgaccccagactgctcagtggttcgaacagtgaggatgtatctgcctctccctttgttattgctttgagtaatacaggatcaatgggtgcaaaagtttccaactttatgaatgtcgttatccttgttgcggttgtgtcagtttgcaattcttgcgtttatgcttcttcaagactaattcaagctttaggtgcatctggccaacttccttcggtatgttcctacatggacagaaagggtaggcctttggttggcattgggattagtggtgcatttggtcttttaggttttcttgtggcctcgaaaaaggaggacgaggtcttcacttggcttttcgccctttgttccatttcatcattcttcacctggttctgtatttgtatgtcacaaattagatttaggatggctttgaaagctcaaggaagatccaatgacgaaatagcttacaaatccatactgggtgtttatggtggaattttggggtgtgtgctaaatgcattgctaattgcgggtgaaatatacgtatcggccgccccggtcggtagccctagctccgctgaagccttctttgaatactgtttaagtattccaatcatgattgttgtttattttgcacataggttttatcgaagagattggaaacacttctacatcaagaggagtgagatcgatctggatactgggtgttccgtggagaatctagagcttttcaaagcacaaaaagaagctgaggaacaactcattgcttctaagccattctattacaaaatctacagattttggtgttagatggtactcttgcatatgtaacctttaataaattttgcaaatcgaattcctttgtaacgtgcaaagcattttatagcctggcgctcgcattgttaagcaacaggcggtgcggcaacgttgaaatgtttcacgcagggttttttacgtactgcacggcattctggagtgaaaaaaaatgaaaagtacagctcgaagttttttgtccatcggttgtactttgcagagtattagtcatttttgatatcagagtactactatcgaagcatttttacgcttgaataacttgaatattattgaaagcttagttcaaccaagctgaaaagaaccattattcaacataattggaaatcatttcgttactaaatcgtccgaaaattgcagaaaaatggcacgtcttcctctaaagcagttcttagcggataaccccaaaaaagttcttgttcttgacggtggtcaaggaacagaactggaaaacagaggtatcaaagttgcaaatcccgtgtggtctactattccatttattagcgaatcattttggtctgatgagtcatctgctaacagaaaaattgtcaaagaaatgttcaacgatttcttgaatgctggcgcagaaatattgatgactacaacataccaaacgagttataaatcagtttctgaaaacaccccaatcagaactttatccgagtacaataaccttttaaacaggattgtcgatttttctcgtaattgtattggcgaagacaaatatttgattggctgtattggcccatggggtgctcatatttgtcgtgagtttacaggcgactatggtgctgagccagaaaatattgatttctaccaatacttcaagcctcagttggagaatttcaataaaaatgacaaattggatttgattgggtttgaaaccattcctaacatccatgaactgaaagctatcttatcttgggatgagagtatcctgtctagacccttctatatcgggttgtctgtgcatgagcacggtgtcttgagagacggcactaccatggaagaaatcgcacaagttattaaggacttgggcgacaaaataaatcctaacttctcgttcttaggaatcaactgcgtcagcttcaaccaatcacccgacattcttgagtctctacatcaagcactaccaaatatggccttgcttgcttatccaaacagtggtgaagtttatgatactgaaaagaagatatggttgccaaatagcgataagctgaacagttgggatacggttgttaaacagtacattagcagcggtgcccgtatcattggtggttgttgcagaacaagtccaaaagacatccaagagatttctgcagccgtcaagaaatacacgtaaatgcgtttttaaagaagttaaataattcttaacattatatatatgctaaaagcagcatgttacactaaatacattttataaacaatagaaagtatgttaatacaatgcttttcaaagcgaccatgactttccgtacttggccgacaaaaaaacagagtaaataaaatgtctattataatcgggcgagaattaataaactagcagtttagcacagcagaatttaggcatacacgatggatgaaaaggtgtagccacacgaacctgtcgagatccctttttctgtctactaaatccacataggccagactatttcgtaaagatatgtcccctgaatgccgcagcttgctgtatttaccgtcacttctttttgctcagttatactggaaatgacggcctcggcatgccaaagttccagaaacagtgcaatttcctgtcatatctcctatcaatagtttctttagcatatatgttgattaaattttgataagaataaataaaatggaaaaaatacgtactatacagacatatatttaatgcgtcacctgcctattcaataaaggattcgaagcattctacaaaagattctaaattatacgaatcagggtagtgaatacagatattcaggcccatctcttcacagtatgtataggaaagagacattaatgtggggcgatttatcgaacttgtaaatcccgtacttacaattttgaaagatttgtcatcgccgttcatcgataacgatatgtcggaaacatcattgatttgaatcaattttgtccttgaattttggatatggaaatcgtcgtcattgtcatacttcatcctccttatatcgtcatcattaaacccattcttttcccaactcctcagttttgccataataaaaccgctaacgtgctttgtaactttattaaattgatattccatcaatctttcattaaactcatcatcattatcctcgttatcgttactgttggtcaaaaattcgttggcggaaagttcgtcatcaattagagaaagtggacattcgacccttagttctttgaagaagagacccaatgacccacctaagcctaagtggtttcttaaatttatgggaatagtaaatactattgtaccgctgaaatccttaacgagaggttttaaacatatcattgcaataccacagatgaaacttcttagacatatatgctcttgattaacgattgactttaaatagttaaacctttggttgtttactatcccaaatactgttgtcccgcataatgaggtgtgcgcatttagaatatcattatactttttcagctgtgttgcagatactgacgagctgagggaagtttgattggttaaatagccgaaaggtctttttaaagtgttatagtatattgatttgaaaaatgactgagtttgcttgtggaagatttgtggtgtcatagcgggcaggtgtaattttgcgctatcatatatcgatttgggaaattttaattctgagagattgatgtcattgacatcaaacaaaatcctatcttcagagtgtgttactgtgctgatttcgtttaactcttttaaaaataatttgtgaaagttagctgctgaaaatatatcaaacaatacgtcgtgaccatgaaaaaccaatagcgcttcgtcaattacatatagtgtccataaaggtttatttgatccgggaacaaatctagtcttgttgaaggcatgacgcaagagataaggaggtggaacaccccaatggcaattgacctccttatcttttatggtttcaaactcaatcacattaacaatatcggaagttttcagctgcttcaatggctcgaattcccattcttcgtttacagttgcaaacaatgccggttgcgatttaatcaatctcttcaaagttgttgctattaggggcagagtcagacgagaatcatctttggaagaatttgttccgagcgtgacttcatcagaatgccagtcagcgtcattttctctacttaaagattttgaatatgtactcgaaaaaatagttccatttctttggtcattcaaagattgagtgagaatttttttttcaaaacttgatagtggcctaaacgtagtcattatgataaagtgaggatgtgtctgtgttgtgagttacaaatgcacttctttggacaggtataacaaggataacgtatacacccttttatatatgaccgtccccccatacaaatttgtgctcgtatgccgagtgtgatctactcatcgcttcgttaatgaatcgtttagccaagaatatagtaaacgtgtagcagagtcatacccctgatggctgcagacgcagggaatactcagcctcgaaacagttttcaatttatgtgcgtatgcatggctataatcttctatttctgtcacctttcgtttattctaaacgaatttgcgacgttcaacgaaagcgcgttgaaaaaattaatctctgaagttaaacggtcggaaaacagacaaaaaagttgttgttattacttgtagaggaaagagctatttcatagctcgtttgggaatgcaggggtgacgtccttcttcgggtgtgttgtcctaactttccttaaacacattgggctatcataccagtgaaaaagaaacatacaatggtcagattcgctttatttggctacgagaatgtggcggctaagttccctcaacaactattccaccaatcttgatggcttttctaaggctctaagtagacgttaaggtggctaagattctaaaattttgccatttttcgaggttgtgcttcgccctatcccttggaaaacatttctaatcatcttaaattctgtgattgagaacgttttaacgttatcttaaacgtttccatagaagaacgaacgtgaaggtttgtagctcgttaaaaggcgatcttgaatgatgtgaagaagtgtaaaaggcttaggaaagttgcttgttgacccggtgtcgttcaatatactcctattacccaaatggcagtttcatagagtgatattatttcgttgccttgtgtaagttagaagtacttcttgtcgattgtgaattcggatagccgctagaacgccaatcattgcggaggtttgccatcgcatggataccatagccatctgcacattctaatatagattatattactttagaccatgtcatttcataatcgttggtttaagcggtgttgtttccacagtttgtatgagaacttttgtccaaagtaaagtatcagtaacgtaatctgagcaaacctacattaaatcgtaactccgcgagattcttttgttcaggtggatcagcggcgtggtttacttccgatttgctcatcgtgcgcatagcagcatttattcctctaattcgctcgataatcaacctttccgcactacgacggtggcaatagttggaccttaagatatgcctatctgaatacaattcttcaactcacatcagtgggacactaaataaagcatatggtatgaaatactatgaattattgaattattggcagacacagcagcgacaagtcagagtgcttacaaaaaaaaaagagttgatccggctaaagaaagtctgatttacgtatttatccaggttcaaacggattgccaaaaatagtcgataacctcggagtaagcaaagcaacaatatatttgttcttcgaaaaggtaaacttcttaacttctatagaagcattgtactagttctctcgaagaaaaaaactaagaaagctatagctgtatcttaccaagccatgaacttgaggaattggtaatccttattaggaaatacgctaaactaggtaatagcagatgatttactagcttactatctcacactaagtctggcaacgcgcttattttttaatacttttatacgaaccaatgaaatttgatcctcccctttttcgtctagttaaatgaagagatacaagtaggcctttctattgagtacttagcaagatatgtatttctaagaaacatcaacagtttcagcccacaaccgattcataaaatgtctgcctggaggaaagctggtatatcatatgctgcatatttgaatgtggccgctcaggctatccgttcttcattgaaaactgaattacaaaccgctagtgttcttaacagatcgcaaacagatgctttttatacccaatataaaaatggcactgcagcttctgaacccactccaataacaaaatagtttaacgcttcctgggaactgcagctctttttttactcgctgatatacattttaaatattctagcaactgtgtatgaaaacttacgtacttttatacgggaaactaataatgactacaatgatattgaatactggccgcttcgaagagtggtataaagtttgtatcattgcattaaaagaaaaagaaatatatgtcccatcatcgccaatcgcaatgttgaatggtcgtttaccacttttgcggctgggcatatgcagaaacatgctgtcccgtccccgactggctaaactgccatctataaggtttcggtctttggtcaccccttcttcatcgcagctcattcctctcagtcggttgtgtttaaggtcacctgcagttggaaaatcactaattttacaaagttttagatgtaattcatccaaaacagttccagaaacttctctgccttcagcctctcccatatctaaaggatcagcaaggtcggcacatgcaaaggagcaatctaaaactgatgactataaagatataataaggttatttatgttggcgaaacgggattggaaactgcttcttacagccatacttcttttaaccatatcatgttccataggcatgtctattcctaaagtcataggtattgtccttgacacacttaagacgtcatctggatcagatttttttgatttgaagataccgattttttctttgcctttatatgagtttctttccttttttactgttgctttactgattggttgtgctgctaattttggtagatttatattattgaggatactaagtgagcgtgttgttgcacgcctaagggcaaatgtcattaaaaaaacgcttcatcaagacgcagaattcttcgacaaccataaagttggggatttaatttctcgtttaggatctgatgcttatgttgtttcaagatcaatgacccagaaggtctcggatggggtcaaagccctaatttgtggggttgttggcgtggggatgatgtgttctttgtcacctcaactatcaatattgttactattcttcactccacctgttctttttagtgcctcagtgttcgggaagcaaattagaaacacctctaaagaccttcaagaagctactggtcaattgactagagtcgctgaagaacaactctctggtatcaagacggttcagtcgtttgttgctgaaggtaatgaattgtctaggtataacgttgcaattagagatatttttcaggtgggaaaaactgcggcatttacaaacgcaaagttttttactacaactagtctcttaggtgacctaagttttttaaccgtccttgcgtatggctcctatcttgttttacaatcacagctctccattggtgatctgactgcatttatgctgtacacagaatatacggggaatgcggtattcggcctttctaccttctattcggaaattatgcagggtgctggggccgcttccaggttgtttgaattaacagataggaaaccttccatttcaccgactgtgggacacaagtataaaccagatcgtggtgttatcgaatttaaagatgtttcatttagctaccctacaaggccttctgttcaaatattcaagaatttaaattttaaaattgcgccaggatcgagtgtttgtattgtgggcccttcaggtcgtggtaaatctacaattgcactcttactgctaagatattataatcccactactgggactattacgatagataaccaagatatctctaaattgaattgtaaatccctaagaaggcatattggtatcgttcagcaagagccggtactgatgtcaggtactattagggataatatcacttatgggttgacatataccccaacaaaggaagaaatcaggtcagtagcaaagcagtgcttttgccataactttatcacaaaatttccgaacacatacgatacggtaattggtcctcacggcaccttactaagtggaggacaaaagcagcgtattgcgattgcaagggctctaatcaaaaagccaactattttgattcttgatgaagctacatcagctttagatgttgaaagtgaaggagccattaactatacgtttggtcaactaatgaaatcaaaatcgatgactattgttagcatcgcgcacaggctaagtacgatcagaagatcagagaatgttattgtccttggccatgatggatcagtggtagaaatgggcaaattcaaagaattgtatgcgaatccaacaagtgctttatcgcaattacttaatgagaaagcggctcctgggccatctgaccaacaactgcaaatagagaaggtcatcgaaaaggaagatttgaatgagagtaaggagcatgatgaccagaaaaaggacgataatgacgataatgataataatcatgataacgacagcaataaccagtctccagagacgaaagacaataattcagatgatattgaaaaatctgtcgaacatctcctgaaagacgcggcaaaggaggctaatccaattaagatcacaccacaaccgtgagtcatccgcatcgcatatacccattcttatctcgcacatttaaatatatactatatataatactgttaaatgccaaataaaaaggattttcattacccgaatcgatacttttggtagcataaacaaataacattgaaacaataacaaagtgtaatgtggccgcacgaatctttgtctgtaacagccttaaagatttcagtagcactgccatggataatgatggacccagatctatgaccattggggatgacttccaagagaacttttgtgaacgtttagaaagaattcacaatacattacattcaataaacgattgcaactcattgaatgagagtaccacaagtatatcagagacattgttagttcaattttatgatgatttggagaacgttgcctcggtaattcccgacttagtcaacaagaaaagactgggaaaagacgatattttgttgtttatggactggttattattgaaaaaatatatgctatatcaatttattagtgacgttcataatattgaggaaggttttgctcatttgttggatttactagaggatgaattctcgaaggacgatcaggatagcgacaaatacaatcgatttagcccgatgtttgacgtcatagaagaatctacacaaattaagactcagttggagccatggcttactaacttgaaggaattattggatacgtcattggaatttaacgaaatttcaaaggatcatatggatacattacataaaatcattaatagcaatatatcgtattgtctggaaattcaggaagaaaggttcgcgtccccgatacggcatactccatcatttaccctagaacaactagtcaagttattaggaacgcatacggagacaactgagccaaaggtaccaaaattttctccggcagaagatattttatcaagaaagttcttgaacctaaaaaaaaatatccctccaattgaaaaaagtttgactgatatcctacctcaaagaattgtgcaatttgggcaccggaatataacaaacataactactttgcaaacaatcttgcaaaaaaaatacgagctgataatgaaagattatagatttatgaattcagagtttagggaattgaaagtcgaactaatcgacaaacgttggaatatactctttattaatttaaatcatgaactattatacattcttgatgagatagaaaggttgcagtcgaaattactgacaacaaagtataccaaagatatcactataaggctcgagaggcaattggagagaaaatcaaaaactgtttctaagacattcaatattatttacagagcattggaattctcacttttggacgctggcgtcgcatcgaagacaaatgaattagctcaaagatggctgaatatcaagcctacagcggataaaattctaatcaaatcctccgcttcaaacaaaatagctactagcaagaagaagattccaaaaccgaaatcattaggctttgggcgaccgaatagtgttattggaactataacccaggatttccaggagagagtcgccattaatgaaggtgacagtaataaaacaccggaaaattcaactacagtggctttgaaaggtaaaaagcttggtaaagcgttactgcagaagatgaatattaaacctgcaacaagcccaaattcatcaaatgcgattaatccattttttgatccggagtcgccaaacaaaggaaaactgatactaagtagtgttcctcccttaccttatgacgaaaccgatgaaaccaccctccgtgtttctcgtggggaaaatgaaaagtcaccagactccttcattacatctcggcatgaaaataaagtacagattacagaaactcctttgatggcaaagaataagtctgtgcttgacatcgaaaaagataaatggaatcattaccggtccttgccctctaggatccctatatacaaggataaagtggtgaaagtcaccgtagaaaacacaccgatagcaaaggttttccagactccgccaacaaaaatcacgacacctaatagtcaagtttgggtcccttcgacaagaagaagaacccgattgaggcctcccacccccttatcacagttactttcaccaagagaagggcgtttagataaaaccccaacttattgatactaacctaaaactgtatacttatacatttttatatatcctccctctcaccctctccattcatagaatttgtaatactagtttaaataatgtaatattatgtgtaattttaaatagtccatgaagattccgcacgttttcattttacagtttttgacacctttacccgacgctttataaaaaaaatagtataagcatcacgacataagcagcctcaggtcattaaaacaataaaagactgggaattataaacgtacaacggtaaggtcattcacgcagtgtatatgaatgactgaaagtgctatagatgaccaaaggtttaatcttacaaaggagttacaacgacactcatgcagagatcaagggaaaataacacaaaaggatgatgctttagattttataagttacagttcttttcaatcctcttttaatactgaccaaaaaagcgcgaacaatggaagtactgtgagaagaagcataaggtcgatttttagaagagcagccgaattgcctagagtccatatggggcctcttacttattcacatgggataaatgagcttgttaacaagaaattaagaaaagactgtgatctcagcacgctatgtcgcgtattgcaaagaggaatcaggatgattaggatgacaagaagaagaaggaagttctatgaatttaaattaatcaataacaacgggcaaataatatggaaagatggttcgaagtatctggaattagactccgttaaagacatcagaatcggtgatacggcgagtacttatcaagaggaagtagatccgaaaagattgagatcggacagtaaactttggattgctattatttataaggtttccaacaaattgaaagcgttacacgtagttgctttgaatgaattggactttaacacattcttaagctgcatttgcggtttagtgaagttaaggagggaattaatggaaagcatacttttgcctgataattcgcaattcgctaggatacattggcaaattactgtttctgaaaaagaggaagatgagaaaaaggacacattgagctttgcagatgtgaagaaactatgtgataaatttcatatttatgtgtcaactggtcaattgttagagtttttccaattagcagacatcaatcataacggactattaaattattttgaatttgaaaagttcattaaaatcttaaagaataggaaagaggtaaatatgatttggtctaaatttacaaaacctccacactcccacttatcatttgaaaatttttttcaatttttaattacagagcagcatgagcaagtggatcgtcaaactgcatggtcatattttattaagtacagagaaccgactcagctgacgatggggcaagatggttttaccaagttcttgaaggagcaaccatatttggtggaggttaaagaggagttatattcaaagccattaaaccattattttattgcatcttcacataatacttatttattggggaaacaaattgcagaaactccatctgtggagggatatattcaagtcctacaacaaggttgtaggtgcgtagaaattgatatatgggatggtgaaaatgggccagtggtatgccatggatttttaacgtcagctattcccttaaaaacagttatacgcgtgataaagaagtacgcttttataacgtctccgtatcctttgattatttcactggaaataaactgtaacaaggataatcaaaaattggcaagcctgataatgagagaggttttagcagaacagctgtactttgttggcacaagaactgataaactgccatcaccaagggaattaaaacataaaatactgttgaaatccaagaagacgagtgaagcaactagaggtcttagcgttaatgagccatttccatcttcttttagttcttcttacgaatcagctaatgaacaggaattaagaatgaaagatgactccacgaacagtagtagcgcaacaaattcttctagtatgcaacgcatcaaaagaattggattaaaaaagcacgctgatataattaatgatgtttctaacatttctggaatacatggcatcaagttcaggaatttctctttaccagagtccaaaacgatagcgcattgtttttcactgaatgagcgcaaagtagaatacatgataaaagacaaacacttaaaattatcgttggataaacataatagaagatatttgatgagagtctatcctcacgttttacgatacaaatcatcaaattttaacccaatacctttttggaaggccggtgtacaaatggtggctacgaattggcaaactaatgatattggacagcaacttaatctggcaatgtttcaaatattagatcaccaacctgatggaagttttaaatcaggatacgtgctaaaaccaaaaaagttgctacctgtagtaacaaaggcgaaaatgattccattaatttacgaacattttgaaaatggtagtgatcctgttactgttaaaattcgaattttatctacacagttattgcccagattgaatgatacatcgccaagcagaaataacaccaattcctttgttaaagtggagtttcataccgatgacgagccgacaatgcccatctcaatcgataagggtacaaggatttctgccactgaagcatccactaagagttctcaagggaatggattcaacccaatatgggatgctgaagtttctatcacattgaaagatacagacctcacatttataaaattcatggttatctctgaagagacccagattgcatctgtttgccttaagctgaactatttgaggatgggatatcgtcacattccgttgtttaacatggagggggaacaatacatattttgcactttatttattcatacacaaattttataggcgatctttttccggccaaatacacatattcataaatacgtacatatacctacttgcatataccaacatgattacctagaatggatatatcaaatgggacgacgaagtaccacgacaatacacaataacaacttctgtttttcgctgattgccttctcttcagcagaaagttgatgcatatttcgcgtagcgcgttgacgcgtcttctttctgaagttttgtgcttttgttatcatactatataaagtaaaaagaaaggagaacatattaagcattactgaattaggatcctttggaagaaataaagtaagagacactgaaagatgatatcaccatcaaaaaagagaaccattttatcaagcaagaatataaaccaaaaaccacgagcagtggtaaaaggcaatgaacttcgttcaccatcaaagagaaggtcacaaatagacacagactatgcactaaggcgaagtccaataaagacaatccaaatttctaaagctgcacaatttatgctgtatgaggaaacggctgaagaaagaaacatagctgtccacagacataatgaaatatacaataataacaattctgtgagcaatgagaataatccttcccaagtaaaagaaaacctttcacccgctaaaatttgcccttatgaaagagcatttttaagggaaggaggaagaattgcattgaaggacttaagtgttgacgaattcaaaggttacatacaggatcctctcaccgatgagactataccactgacgttgccactgggtgataaaaaaatcagcctacccagttttataacgccgccaagaaattcgaagatatctattttcttcactagtaaacaccaaggacagaacccagagacaaagatatcccgttctaccgatgacgtcagtgaaaaaaaagtagtgagaaaactgtccttccacgtctatgaagatgagtaaataatgtacacagttagcgtctaataattaattaacgataccaatttaattcattcacgtattcctcacctcgtgtgtaaattactaacagagtagtaataataataagaatcaataataataataaatccatccttgtgtattacccgggttagagggtagaaaaatttttgaaaatcgcgatgagctgaaaattgaaaatatttggttataacataagatcgataaattaggaacagtgcattatacagtggactcattcggttagaagctttagacgtcgtaccttttatatcgatacaaataaaaataaaattataccatgggaaaggctgcgaaaaagaagtactccggagcaacttcgtccaaacaagtctctgccgagaaacatttgagttcagtatttaaattcaacacagatctaggtcagcatattttgaaaaatcctttggtggcgcaaggtattgttgataaggcacagattagaccctcagatgttgttttggaggttggtcctggtacaggtaacctaactgtaaggatcctcgaacaagcaaaaaacgtagtggcagtagaaatggatcccagaatggctgcagaattaactaagagggtacgtggcacacctgtggagaaaaagttagaaatcatgcttggagattttatgaagactgaattaccatactttgatatctgtattagtaacactccttaccagatctcatcgcctctggttttcaaattaattaaccaaccaagaccaccaagagtatctattcttatgtttcaaagagagtttgctttaagattactggcaagaccaggtgactcattatactgtagattatccgccaatgtacaaatgtgggctaatgttacacacatcatgaaagtgggtaagaataacttcagaccgccaccacaagtggaatccagcgttgttagactagagattaaaaatccaagaccgcaagtggattacaacgaatgggatggtttgttgagaatcgtctttgtgaggaaaaacagaacgatttcagctggcttcaaatcgaccaccgtgatggacattctggagaagaattataagacatttttggcgatgaacaacgaaatggtggatgatacaaagggttctatgcacgatgtcgtcaaggaaaagattgacacagttctgaaggagaccgacttaggcgacaaaagagcgggtaaatgtgatcaaaatgatttcctaaggctattatatgcttttcaccaggttggtatccatttttcatgagctctcttatcaattatgtaagtgcttgtatactatttacctaagataagaaaaaaaaaagcaattcaaaattaagcttatcttgacagcggggctggtttgtttctagaagacaaaaagtggggaatcatttttacgtaactccccctgataagaaggactcacatccttataggtacgataaagaatggttgtatctttcctatttttcgaaatcgttatcttatatagttgaactactacggttaaaaagcttaagcctcagccctcttagtcaaacttcttttttgaaggcaccagggtgcataaaagtgcgtctattgtttcccagtggaactctgttgagatagcgatgtttgtttttttttcacttaacggcaaccaataccgatagcgacgtcgctggcagtgtagagtggccgtacggcgtcgctagatggcacggcactgattgcggcgggagtcgctaggcggtgatgcatttccgcacagggaccagaggaagcttcccaggcggtgacagtaagtgaactcattatcatgtcttctccaaaacattcgtgacatctagtcatgctcctcgcaattcactccgattggtatagctttttcggtagttttagctactatgcttaggggaaagaggagaaaccgtaccgtcagtctcagtcaaaaaattttgatattcaatctgatagcaaagttggaacttggggttatctggcccttttttgttatcatattcgtatacccaacaacatatcggttccaccggtcctttttatatataaaagacgatgtgtagatgcactcgagtattcttggagaacgtaacttgtattgagctagagtgctggataaagtaccacatactaacgttcttttatagagccaaacataattcttttgcactttcaatataaggtacaagtgaaacacaggaaaaaaagaactaactctaagtaatgaagatgcctctaaagaagatgtttaccagcacgtctcctcgtaactcttcttctcttgacagtgatcatgacgcttactattcgaaacaaaatcctgacaatttccctgtaaaggagcaagaaatctataacattgacctggaagaaaacaatgtgtcctctcgttcatccacctctacatcaccttcagcaagggacgactctttcgcagttccagatggtaaagacgaaaacacgcggttgaggaaagatttaaaggcaagacatatttctatgatcgccattggtggttcattaggtacaggtctgcttataggtacaggtaccgccttattgacgggtggtccggttgcgatgttaattgcatatgcctttgtcggccttttagtcttttacaccatggcctgtcttggtgaaatggcttcttacattccattggatggttttacaagttatgcctcacgttacgtggatcctgcattaggttttgctattggttatacttaccttttcaaatatttcatcttacctcccaaccaacttactgctgctgctttggtcattcaatattggatcagcagagaccgtgttaaccctggtgtgtggattactatattcttggttgttattgtcgctatcaatgtcgtcggtgtaaaattctttggtgaatttgaattttggttgtccagtttcaaagtcatggtaatgttgggtctaatcctgttactatttattattatgcttggtggaggtcctaaccatgaccgcctagggtttagatactggcgtgatcctggtgcgttcaaagaatattcgacggctatcactggtggtaaaggtaaatttgtttcgttcgttgctgttttcgtttacagtcttttcagttacacgggtattgaattgacaggtatcgtttgttctgaagctgagaatccaagaaaaagtgttccaaaggcaattaaattgacagtttaccgtatcattgttttttacctatgcaccgttttccttttgggtatgtgcgttgcatacaatgaccctcgtttactttccacaaaaggtaagagtatgtctgctgcggcatctccattcgtggttgccattcaaaactcaggtattgaagtcttacctcatatcttcaatgcttgtgtcttggttttcgttttcagtgcttgtaactcagatttgtacgtttcttccagaaatttatatgcgttggcaattgatggtaaagcgccaaagatcttcgctaagacaagtagatggggtgttccttacaatgctttaatactctccgtgctgttttgtggcttggcgtacatgaatgtgtcttcaggatcagcaaagattttcaactactttgttaacgttgtttctatgttcggaatcttgagttggatcaccattttaattgtttacatctacttcgataaagcctgccgtgctcaagggattgacaaatcaaaatttgcttatgtcgctcctggccaacgttatggtgcttattttgctttattcttctgcattttgattgctttaatcaaaaacttcactgttttcctaggtcataaatttgattataaaacattcatcaccgggtatattggcctgcctgtctatatcatttcttgggctggttacaaattgatatacaaaaccaaagtgataaagtctaccgacgtggatttgtacacatttaaggaaatatacgatagagaagaagaagagggaagaatgaaggaccaagaaaaggaagagcgtttaaaaagtaacggtaaaaatatggagtggttctatgaaaaatttttgggtaatatcttctagatgcctttttaatcaaagccttagggcaacatgaaactatattcatccaatcaaaaaaatgagcacaagaatttctctttgatcatttttcttttacctttaataacaatcgttatcaacattttttatttccagtcctaccacagcattattgcataattaatttacaggaagattttcttgaaaaaatagaaagaaaaatacccattttttcaaggaaaataaaatttatatattacatacatttctataaaacagtttaaattcaaaaatataaacaaaaacataaaaataagaaaagttcaagtcttcgttattttctgtttgtggagtaatcgatcttattaacatatatgtggagacttttcaaatatagccacctgcaacatggaaccatagtgtacaggtatcacttaatcctccaaatcatctaattcaaagtccgatgtggagagtagctcggcagtagccacaacgttttgtttggaggctctcatattaatgacccatatagtagaactaacgataactgccataccgcaccacgtccatatgtttggccagtggtgaaagagcacgacatcccagaaaacagcatatataacttgagtataagtcattaacgaaccccttcctgcacgctccctctggattcccattgttaacagaatttggtgaatgaatccagaaatacccaagttcagaaatagcccccactgcttccacgaatgaggcagttgtaaagacatcgagggaattagaagcacaccgagggctgccacaacagtagtaaccaacgagaaataactgacactcatgatggcatgtgccttgttaccgatatatcttatgataatgtaaacactactcaatccgcaaacccccaataaactcaccccgatagcaatgagtcttaatttgggattttgagtctcaacaatatcgtcttgtggagattgctggccttgggtctgctcaccaaacaaaaatgtaggtctaataattaacaccactccagaaaatgaaattagggaccccaaggcttcaagtttactaaatggctcacccagcagtaaaaatgaaaggaaaatggttagggttggcgacatgaaggtgattaagacagcgtcacttatacttagatacattaaagaaaagtacattccaaaaacaccaaaaaaacccattatacctcggagtatcaaccatttcctgcatggtgctgggccccatggaatatctggaacactttgtttattccaatgcatgtatactagcgtacaacagtacgtgatagacatccttactagcaggatttgcagaggattaattcttgattgcgaagtttccagtgggtcattttctaggactttggtagaaactaccatagaagaattgaaaaaataagacactataagtaagataagtccataattaggctttagataatctttactaattctttgcagcgtcattgagagaggaggtgtttattctacttttctgttggggcagctttcgtgaatgtaataatgagataattttccctgtctcctttgtttttttttccagatgactcaattagtgactaaagaaaaggatgccatatggaagacagatatctataaaaaaaaaaaatgctataaatactttttaaactcaactacaaaagcgaaaatgtttaccttcttttggaaggtttagtagtcgtatctctttcaatgattccgcctgtatcctccagacgctcttcctcaagggtcacctgatctcttctttcccaccaacggtcttcacataactcaaatgacttcgtctttaactgtttacccttaaggtttctgttgttagaaatagaccaggttaagaaatttgcaccttcccttaagtagaatgctcttaaagtttcgaacggttttgggtgtggtagccaagacctttcgtctggaatctccatctgcgcttgtttgtcatcgtcgctctcgctttcctcatcttcatcaccttcaaggggtcctgcatcttgttcctcttcgccgtcgtcctcatcctcctcatcgtcctcgtattcaaactcatcttcgtccgaatctctatcacctagtctctttgcttcttcgatggcagataggtcttcccagtaaaccttgacaccatccaacttgttcaaatctatactataaaatgagtttataggataatctttttcgcccagttcccagacaccactgtaaatgaacaacgagtcgcccactacacaagttgctgcgttaaatcttgggtgaggtaattgatttgagatggtaatatcttcttggttgtccaaatcactgtcatcttcgttatcttcgtcgtcatcgatagagttaggacccgttgtgctgttgtcatcattgtcatcgtcgtcgtcatttagattagacttggccagaatggaatttagtaaatcctgcagttccttttcttgatctttattagattttcttttacttgtggcgggtgaatttttactattcgtttgacgctgaggtttaattctaagtttagaccatttgttcaactctaggtggaacatatataggtcgttatagaaaacggactctaaggattcctctgtctcttgtaaatcgtagacaccaccaaaagcaacggacttgttttgcttccatagattgaacgaatacccgactcttggtgagggctggttcttgaaattctttaatttttcccactgccacttctttggatcaggcgttaagttcagtttccatgcatcattcaagatttttcccttcattaaatttttattatttttggcaatgattttacagtaaccacccattaatatggcagaattatctgtaggaatgaaacaatgacccgatctagcgtcaggtttgctgtttgtctccaatttggtccatttgtaggttgagatatcaaaacaccacaaatcatttaggtaagaagtttgaccattccccaaatctctaaatccaccaaataatatgaaatagtttttccaagcaataattctatgacctgatctggcgctgggtgaagagtctctaccgccaaactccaacttagtgaatttcctttcaacgcagtcaaacagccatgtatcagaatagtggtagaatttagattgttttggggacgaaaattcaccaccgtgtaacagtgctattccggaaggatgcacagcgacagcggcactggatctgggcaaaggtgcattttgcgaaacgtattttttccaagagttgttctttatggagtatgaatacaaatcattatagaaatgtgttagtttggtttctggatctgtaaattcaccaccgaaaatgaacaattcatgtttattgtgttgcggatttgcaaacatcaacggatgagtacgacaagagggtttttccacagaagtgatgtctacatgctctaattcaatttgctttttgctaaagctagagagaatttcatcgagatcttgatcactttcatcatcttcttcgccgtttaaagacttattcttgttcttctgaaactttttctcctgctttttttggtttttctgattcttcagttcagcacgtgcctttttggcctctttatccttcttattcttctttgccattaatcacttctacgagtctagtagatctcttctccttcctataagtggttaatgtattcttcgagaagctcatcatttttttttttcattttttttttttttttcagttttctacaatttcatcaaatcaatggttaaaccgggcagaaaaactaccaagcgttacttttactgatgttagtactactaccgcagttattgcgactactacattaactataactatacaagaaaaaaagtaaagagggctcgtaaagcaaagcttggtatctcctacatagtcaatacatagtagtgagtcgcctatagccattctgtaatgccatttgttaagacgtgtccttaaacccttccgaatcgccgcgggcgacatcataatgtcagtacctaataatggttattattcgtaccctgtggttagagagctatggaagctagcagtaaatgtctctagttcttgctatcactaccatattggagaggcttcaggcccctcccctgagccgatcctcggaatgactaccccgattcccggaatgggcgttcgatgattggctctttcctgtaaagcctttttgcgtttcttataggctatatataatcttcatcactgttgtagacgttaaacaagcatccaacaggaggccggaccgaacacacgggggagtgactctagctctttcttctgggatattcatatcgtttctccattacatacagtcatttttttgcatttttaaattcgtgacttttagtactgcagctgttttttttctcacgtcaagaaattccataaagtctaactattaaacggataagagatacaatcatgttgagatttaccaattgtagttgcaagactttcgtaaaatcgtcatataagcttaatataagaagaatgaactcctcgttcagaactgaaaccgatgcatttggtgagatacacgtgcctgctgataagtactggggtgcccaaactcaaagatcctttcaaaacttcaagattggtggcgctcgtgaaagaatgccattgcctttggtgcatgcatttggtgttttgaagaaatctgccgcgattgtgaatgagtctctggggggattggatcccaagatctccaaggctattcaacaggccgctgacgaagtggcttctggtaagctagacgaccactttccattggttgttttccaaacgggttccggtacccagtctaacatgaatgctaatgaagttatttccaatcgtgccattgagatcctaggaggcaagattggatctaaacaagtccatccaaacaatcattgcaaccaatctcaatcatccaatgatactttccccactgtcatgcatatcgctgccagtttgcaaattcaaaacgagttgatacctgagttgaccaatttaaagaacgcccttgaagccaaatccaaggaatttgaccatattgtgaagatcggtagaacacacttgcaagatgccacgcctttgacactaggtcaagagttttccggttacgtgcaacaagttgagaacggtatccaaagagtggcacattctttgaaaacattgagtttcctggcacaaggtggtactgccgttggtacagggttgaacaccaagcccggattcgatgtcaagatagccgagcaaatttccaaagaaactggactaaagtttcaaaccgcccctaataagttcgaggctttggctgctcacgacgccattgtcgaatgtagcggtgctctaaacacccttgcttgttctcttttcaaaatagcgcaagatataagatacttagggtccgggccacgttgcggctaccatgaactaatgctgccagagaatgaaccaggttcctcaatcatgcctggtaaagttaacccaacccaaaacgaggcattgactcaagtgtgtgtgcaagtcatgggtaacaatgcagctatcacgtttgccggctctcaaggtcaattcgagttaaatgtcttcaagccagtcatgatcgccaatctattgaattcgatcaggttaattactgatgccgcatattcatttagagtgcactgtgttgaaggtatcaaagccaatgagcctcgtattcatgagttgttgactaaatctttaatgttagtcaccgctttgaaccctaagatcggttatgatgccgcttccaaggtcgccaagaatgctcataagaagggcattaccttgaaggaaagtgcattggaattgggtgtattgactgaaaaggaatttgatgaatgggttgttcctgaacacatgctaggtcctaaataaacgagctaaatacctaataatatacaagttttttatgtcttattatatgaaggaaaataaggaagtggagagaatttgtgattcagcaatggtccctccgctaaggtcccgcctctggccagttatgtcagaagaggagcataggcatacattccatttttgatggcttaatggggcccataaatttacatcactacattattattcctatacaagttataataaaatagttcataaatgaatattttgcgtcattttttaatttcttgtcgtcgggtaagggacctagtattacccgcatcacggaaaggggaattttcagaaatgataacgaataagagagtacaccagaagagcaaatctctttaagaagtttagcagcaaatatcggtttaaaaacaaacaaaagcaaaggaaaagaactactaaatcttcgaggactttcccaatttttaaaacgctgaaattgtattagaagagaataactgtctaaaaagagcatgtttgcatccgctggacaacaacaccctcaaattgttcctaaggaagaggaatccatattaaactacctccttgaagtgagatcctccttggctaaactcaagcaaaataggacccagtatttgaactctaaggatgtccaaactacttaccaacacgtcttgaccaaagtcagagagttggacgatattaggaagaatagtcatgagacgcccgctaagagcgccgccaccctgattcatagtactgaattgcataatagagttgactccgtactggatgatgtctttcaattgctctcgttgtgttttttaactgttgggctaaaaaattctgcacctgcgacttatgcatcgttatctactgtggagagtcttttggaacatttaaatgaatcaaacgtcttcacccatcacgatttgagtcctattaaggaaaggctggaagaaatcagcaagattgtcgaacaaaaaaactctagtcctgcgtacgatgaggatggaaatgatgaccgattaagggaaatcgacaacgaaaggaaaaagaataaaattgaggaagacctattactacgtgctaaattaaagcattgcaaggacgaatatgatatattggaaggcaaattggaggaaattgatccgtctttgtctactgtaatggaaaagttattccgaattagaagaggtttattgtcattagttgcatctgctaaaaaaacaatgtctaaatctgatattaataccaactctttattgcaggaacaaaatgatttgcaaacgaacaatgaaagcttaacggatgacaaacatttagtatctcaagagtatgtccatgagaaattatcagttttgaagaacgaattaagtgaattagaatctaatcgtgacgattctggtaaattcaagtccttggagtctcatcaggtggcagaaaaaggccaaagtgtccttaatggtttattggatgattgccatgatttagttaacgatttatcacaccaaaaaaatggcgggttgactttagatccatatttacagccaatatatgaacagctgattgatataaagactaccttagaaaatttaatgatcacaagaagatggactttgagagaaaccgatttattttcttaccaaaaaaaattgaacgaaattgataacaaaagaatcaatggtaagtttccaacaaaatctcaggactcaaaggggcaatcaatacttttatacctgttgcgtagatgttatgccataatttataaactgttggaaagttcagagcccgtatctgaagcgttgcagccaattcacaatcaactatctacagttcgtcgttgcctattagaattgaaaagaatgggaggtgtgaataatgaaagagagttatacccttatcaaatgaaattggcttcattggacaacctgagaactgaaggtatattctatgactctgatggcaatatacctgaaggccaaggtatattgaatgctttattagcagaatgttttgatatcttgcatgaattaaaagtggaagccgaggaaaaagcacagaactctacttcaagtgatggttctgacgacgatgacaacggagaatcaggcatagactcgaactcaaacgacagcgagcctgaatctgaatatcaacaggaatagaggagagtgtttctttatcttccatttctccctattttcttggtagaggaaaacattataaacaataaaatgaaatacagaaagaaaaaaagttattctcttatgtctatgtatataacaaaccctgaatgagcatctatataaaaacaaaaatatataaacaactttatgtcattatcataattgtcaatgggaggggggagaaaaagaggaataaggacatacgtaccctgtgtctttgtccatgcaccgtagaaattgctttttttatatatttttcagacattacgtcagccttattgtataatcatcaccactttgcgtgatatatcttacccatgggtaactcttatactgcaatttgggttcgttaattttaagataacgtacttgaatacctgaagtagtaaagtagggtatttgaaatttgatttggacaggtcccttcaagatttccgcgttactttttggcattgttctattgccatcctcgttatttgatattgaaggcagtcccaattcggcagacattgagtactctttaccaccgggaaaacttcttattttccataagattgcacttttttcagggacatactttagagacccgtgtgaatatttaaaagtcggtgtatccgcgtcgtccgggaccggtatcaatatctctacattagttgcagtagattttcttttaatttgggccttggccttacagtgaatttcaattctagaattcgaatgaacttgaacgtttacatcacaccaaattaacggttttatcgtagtagatagtctgtagttcattaaatcgaactttccatcaggaggtataaacgttataattttttcattctcgaatttgcttaatcggacacattgatgaaatttcaaatcttccaattcaatattaactttcttcttgtttgtggccgatgatgatgttattgatggttttttatcagtttctgtgttattatcggatgttgtcgcgctcgctgatgggatatttgtatcatcatccaaatatttggagaaaatgcctttatcattaatacctaatttcagatcaggcataccagacaattttgagttaaccttaacatcgccgataatttctgatctcaaaacttgacctttttgagtcatgagcatattaatagattcgacgatatccagaaaggcttcatttttcttgtgagtgatgccttctggcctccaactgactgaatttgttagtgcgacgggtggtctagtagcattcctcttcttcttggcggatttaactagtttgaaggatttttgtgttatgtactgtttcagcatcttagtttctgtgatctgtggtataccataatccatcacttcgtccagtaattcatatattataacaaaattatctctaatagattcttcttcaacggtttttaagtagtcacttaatacctccactaatttgtgcaaaaaagtaaaaatggcagccgcattggcactaagagaagtcacaattgccaccacgtatagatcgttatgctgtataaatagatattccagaccattgtggttcaaacatggaggaatcagatttgattgttcctctaaatccgagagtaatatagggaatttgtcaattgcagaaagcggaatatcatctctataccttcttgataggagtggtttcccattatgatcgcaaaaatacactgcagaagccattctgtgtccctccaagttcgtaatttacaattttcaaaaatactcctatatttaattgtacgacttagtttctctatatgcttttttttgttcagcccactttccgtttaactcttaatttttcatcgtctagcaatatttcaatacgttcaattaacatcgctatcaacgactttcaaagactattatcataattagagataccctttctcgcttagttgaagttacgtctaatgatggctatagtatatcgagcgtattttataccattgaaatatcttcatctttattacataactattatagatccatagcagtcctattgatagtatgcagtaattttagcgcatagaaaacgtttatattgggtcgaatgctcaattattttcagatggaggaataccttgaagaaaatatatatatataaagacgcactattcaaataatcatcagtgccaacattaactgtttccctaagatgcgttcagttgtgattcttttttttttatgtcgcaactgtctgtcgtagttctgtcagctaatgttacgagaatgtccaactgcagtgttaggtttctgaaagatgagaaagtttctgccggataagttatcaacgaaattatggtgaatacttgaggtatgtgactaggatggtagcgccgctagaacgccaaaatcagaacgaagattttggtttctgccgaacaatttttactatattaataaaaatgaaggaacattcttaaattattgacacctatttttgcataattcattatttctacgtataactttttgtatattttgtaaaaatcgatgtgtctattcattcatattctagagcggcggtccagaagttagcttccaattcacaaacttcagcatatattgtgaccagtgtatcaagtttttctggagggtatgtttccaagatgtgattcaacagcttttcgccttcaagcatagcttcgtggcaccatgacgatgagtaagtttcacaccattcacggtaaacggagccttctgctgcagttacttcatccttgatcttggtcaaagcgtgaacatagcccattaagcaaggattaagagctataactaactcctgccagttacctcttctggaaacatcattaaagtaacgacagtaagcccttaatgcaggacctctttgaatcttttgtaagtagtcgggatccttaattccaaattcctcccttaatctcctttcatgttggcaaagcccattacgaacgcattcgacaataactagctctttctccaggtcttcaagacacggggatttactacccgcgatgcaggaaatcctggcataattgactaagtacaggtaatcttgttcgataaaaaattggaacttcttaggctctaaggaaccgtctgctacttttctaacaaaatcatggttcacataggagtcccagtggggcttaactttagggtgatttatcagatatttatagaaacttcctccagggattttgttaagagaacttttgactggctttttgtgtacggcatctgatgcagtgaaacattcgtcactgagcattttttctaatggaatttcgatggcgtagacatgattaattggcccgttgtccttaacagtctctttcgtgacatcgcagccaatggccaccgcattttggacgtactcaataccgccataaacggattggggaagggaataaccgcgagccaaatttgatgcaatggcggaagctagggtgcacccggtaccatgagtgtgggttgtattaacaaaattacccttgaaggttataaacctttgttcggcccctaagtaaaggacatcagtgatgtactttccttcttcatcattccatggaatgtgaccacctttaaccaaaatattggaacacttggtgattttggcaaggtcttttgcgacttcgaaaatgtctcgcaatttgcttatttctctgtcttcacctaacagtttgaaacactccggaatgttaggagtcaaaatgtcagcaaaaggtgcgattttctccgtaattaaactggctatatcctttccagctaaagaagagcctgaagtagcaacaaggactgggtcaactactagcttaggtctattttcgccgagctgcagcagtttttcgtgcaaaacctcgatagcagctgtcgtaagcatgccagtcttgatgacgtcacatttcatgtcttgtaaattggcgtccaaaatttgggaaactacttcctttggcgtgttattaatgctgtatactttaactggagtttgagcattcaaagcagtgatgcatgtcatagcatagcatctgtgtgcagtgatagttttcacatctgcttcaacaccagcaccaccgcttggatctgttccagcaatagacaaaactgtgggtaatttttcattgctggccaaagcgagatatggtggaggtgtattaatattaactgtagaataggtcattgtggcaagacagttgctttccttatgtatatttcctaacgtgatcagatttggaagaataaataatgatgcaaacaacaggtgctgcgtctaactttgtatagtttggctagtgcctataaataagagcatttctcttgccagatggagtagctctaagggtttccaatattcagtctggatgcatcgatctatcagaaaagagaagctatacatatacgtatcattaaagaaatacgagatcgcgaagtgagaacagacctggcagttactaaaaaatcgcgtgcactttcatggtgtgttactatggtacttcgtgtgtatatgcaaatatgggaagcggactctaagtcggtaataaaatgatgaaaatcgcgtttcttgtaaaacaaaagcgatttactttatttttggttaccttcattgttctttcggatatttgaggacattcatagcattttcatgatagttctggaaattttataggctagtgaaatttatacagcaacttcttgggagtgcgttgttgttaaaggctataatattgagcataaagaatatactataagttattctcgagaatattcgaatccacaaaggtaatcgataattctatataacaatatcacatcttctttttcgtattgtattttgtcgctcattatcccattacactataaatcctttcgtttcagctttcattaaacctgctgtgagcgatgataaaagggacggtttatcatttcttcactcttctaaacagggtaaagtaattcaaacacagagaaactgtacgtttgtatatcatatatttgttttggacagttgttacagttgcccgtgaaggtagcaatgaacctccccttgttttaacaaatttgttataccagcgaacgatggatgattgttgagcttgatgcgataatgttaaatgctactcttgaagctgagtgtccgctgtgatgatgatagcggatagcgtcccatataatgagagatggggaaaaaaattaattgaaacggacaggaattgaacctgcaacccttcgattgcaatcttattccgtggaatttccaagatttaattggagtcgaaagctctaccattgagccaccgcttcaactattgttgaaagtgttgtatctcaaaatgggatacgtcagtatgacaatacgtcattctaaacgttcataaaacacatatgttggaataaaaatcaactatcgaccatcacgtagtagtcatactaccaattgttggaataaaaatcaactatcgtctatcaactaatagttattgttggaatagaaatcaactatcatctactaactagtatttacattactagtatattatcatatacggtgttagaagatgacgcaaatgatgagaaatagtcatctaaattagtggaagctgaaacgcaaggattgataatgtaataggatcaatgaatataaacatataaaacggaatgaggaataatcgtaatattagtatgtagaaatatagattccattttgaggattcctatatcctcgaggagaacttctagtatattctgtatacctaatattatagcctttatcaacaatggaatcccaacaattatctcaacattcacccatttctcatggtagcgcctgtgcttcggttacttctaaggaagtccacacaaatcaagatccgttagacgtttcagcttccaaaacagaagaatgtgagaaggcttccactaaggctaactctcaacagacaacaacacctgcttcatcagctgttccagagaacccccatcatgcctctcctcaacctgcttcagtaccacctccacagaatgggccgtacccacagcagtgcatgatgacccaaaaccaagccaatccatctggttggtcattttacggacacccatctatgattccgtatacaccttatcaaatgtcgcctatgtactttccacctgggccacaatcacagtttccgcagtatccatcatcagttggaacgcctctgagcactccatcacctgagtcaggtaatacatttactgattcatcctcagcggactctgatatgacatccactaaaaaatatgtcagaccaccaccaatgttaacctcacctaatgactttccaaattgggttaaaacatacatcaaatttttacaaaactcgaatctcggtggtattattccgacagtaaacggaaaacccgtacgtcagatcactgatgatgaactcaccttcttgtataacacttttcaaatatttgctccctctcaattcctacctacctgggtcaaagacatcctatccgttgattatacggatatcatgaaaattctttccaaaagtattgaaaaaatgcaatctgatacccaagaggcaaacgacattgtgaccctggcaaatttgcaatataatggcagtacacctgcagatgcatttgaaacaaaagtcacaaacattatcgacagactgaacaataatggcattcatatcaataacaaggtcgcatgccaattaattatgagaggtctatctggcgaatataaatttttacgctacacacgtcatcgacatctaaatatgacagtcgctgaactgttcttagatatccatgctatttatgaagaacaacagggatcgagaaacagcaaacctaattacaggagaaatctgagtgatgagaagaatgattctcgcagctatacgaatacaaccaaacccaaagttatagctcggaatcctcaaaaaacaaataattcgaaatcgaaaacagccagggctcacaatgtatccacatctaataactctcccagcacggacaacgattccatcagtaaatcaactactgaaccgattcaattgaacaataagcacgaccttcaccttaggccaggaacttactgaatctacggtaaatcacactaatcattctgatgatgaactccctggacacctccttctcgattcaggagcatcacgaacccttataagatctgctcatcacatacactcagcatcatctaatcctgacataaacgtagttgatgctcaaaaaagaaatataccaattaacgctattggtgacctacaatttcacttccaggacaacaccaaaacatcaataaaggtattgcacactcctaacatagcctatgacttactcagtttgaatgaattggctgcagtagatatcacagcatgctttaccaaaaacgtcttagaacgatctgacggcactgtacttgcacctatcgtaaaatatggagacttttactgggtatctaaaaagtacttgcttccatcaaatatctccgtacccaccatcaataatgtccatacaagtgaaagtacacgcaaatatccttatcctttcattcatcgaatgcttgcgcatgccaatgcacagacaattcgatactcacttaaaaataacaccatcacgtattttaacgaatcagatgtcgactggtctagtgctattgactatcaatgtcctgattgtttaatcggcaaaagcaccaaacacagacatatcaaaggttcacgactaaaataccaaaattcatacgaaccctttcaatacctacatactgacatatttggtccagttcacaacctaccaaatagtgcaccatcctatttcatctcatttactgatgagacaacaaaattccgttgggtttatccattacacgaccgtcgcgaggactctatcctcgatgtttttactacgatactagcttttattaagaaccagtttcaggccagtgtcttggttatacaaatggaccgtggttctgagtatactaacagaactctccataaattccttgaaaaaaatggtataactccatgctatacaaccacagcggattcccgagcacatggagtcgctgaacggctcaaccgtaccttattagatgactgccgtactcaactgcaatgtagtggtttaccgaaccatttatggttctctgcaatcgaattttctactattgtgagaaattcactagcttcacctaaaagcaaaaaatctgcaagacaacatgctggcttggcaggacttgatatcagtactttgttacctttcggtcaacctgttatcgtcaatgatcacaaccctaactccaaaatacatcctcgtggcatcccaggctacgctctacatccgtctcgaaactcttatggatatatcatctatcttccatccttaaagaagacagtagatacaactaactatgttattcttcagggcaaggaatccagattagatcaattcaattacgacgcactcactttcgatgaagacttaaaccgtttaactgcttcatatcattcgttcattgcgtcaaatgagatccaagaatccaatgatcttaacatagaatctgaccatgacttccaatccgacattgaactacatcctgagcaaccgagaaatgtcctttcaaaagctgtgagtccaaccgattccacacctccgtcaactcatactgaagattcgaaacgtgtttctaaaaccaatattcgcgcacccagagaagttgaccccaacatatctgaatctaatattcttccatcaaagaagagatctagcaccccccaaatttccaatatcgagagtaccggttcgggtggtatgcataaattaaatgttcctttacttgctcccatgtcccaatctaacacacatgagtcgtcgcacgccagtaaatctaaagatttcagacactcagactcgtacagtgaaaatgagactaatcatacaaacgtaccaatatccagtacgggtggtaccaacaacaaaactgttccgcagataagtgaccaagagactgagaaaaggattatacaccgttcaccttcaatcgatgcttctccaccggaaaataattcatcgcacaatattgttcctatcaaaacgccaactactgtttctgaacagaataccgaggaatctatcatcgctgatctcccactccctgatctacctccagaatctcctaccgaattccctgacccatttaaagaactcccaccgataaattctcgtcaaactaattccagtttgggtggtattggtgactctaatgcctatactactatcaacagtaagaaaagatcattagaagataatgaaactgaaattaaggtatcacgagacacatggaatactaagaatatgcgtagtttagaacctccgagatcgaagaaacgaattcacctgattgcagctgtaaaagcagtaaaatcaatcaaaccaatacggacaaccttacgatacgatgaggcaatcacctataataaagatattaaagaaaaagaaaaatatatcgaggcataccacaaagaagtcaatcaactgttgaagatgaaaacttgggacactgacgaatattatgacagaaaagaaatagaccctaaaagagtaataaactcaatgtttatcttcaacaagaaacgtgacggtactcataaagctagatttgttgcaagaggtgatattcagcatcctgacacttacgactcaggcatgcaatccaataccgtacatcactatgcattaatgacatccctgtcacttgcattagacaataactactatattacacaattagacatatcttcggcatatttgtatgcagacatcaaagaagaattatacataagacctccaccacatttaggaatgaatgataagttgatacgtttgaagaaatcactttatggattgaaacaaagtggagcgaactggtacgaaactatcaaatcatacctgataaaacagtgtggtatggaagaagttcgtggatggtcatgcgtatttaagaatagtcaagtaacaatatgtttatttgttgacgacatgattttattcagcaaagacttaaatgcaaataagaaaatcataacaacactcaagaaacaatacgatacaaagataataaatctgggtgaaagtgataacgaaattcagtacgacatacttggcttagaaatcaaatatcaaagaggtaaatacatgaaattaggtatggaaaactcattaactgagaaaatacccaaattaaacgtacctttgaatccaaaaggaagaaaacttagcgctccaggtcaaccaggtctttatatagaccaggatgaactagaaatagatgaagatgaatacaaagagaaggtacatgaaatgcaaaagttgattggtctagcttcatatgttggatataaatttagatttgacttactatactacatcaacacacttgctcaacatatactattcccctctaggcaagttttagacatgacatatgagttgatacaattcatgtgggacactagagataaacaactgatatggcacaaaaacaaacctaccgagccagataataaactagtcgcaataagtgatgcttcgtatggcaaccaaccgtattataaatcacaaattggcaacatatatttacttaatggaaaggtaattggaggaaagtccaccaaggcttcattaacatgtacttcaactacggaagcagaaatacacgcgataagtgaatctgtcccattattaaataatctaagttacctgatacaagaacttaacaagaaaccaattattaaaggcttacttactgatagtagatcaacgatcagtataattaagtctacaaatgaagagaaatttagaaacagattttttggcacaaaggcaatgagacttagagatgaagtatcaggtaataatttatacgtatactacatcgagaccaagaagaacattgctgatgtgatgacaaaacctcttccgataaaaacatttaaactattaactaacaaatggattcattagatctattacattatgggtggtatgttggaatagaaatcaactatcatctactaactagtatttacattactagtatattatcatatacggtgttagaagatgacgcaaatgatgagaaatagtcatctaaattagtggaagctgaaacgcaaggattgataatgtaataggatcaatgaatataaacatataaaacggaatgaggaataatcgtaatattagtatgtagaaatatagattccattttgaggattcctatatcctcgaggagaacttctagtatattctgtatacctaatattatagcctttatcaacaatggaatcccaacaattatctcaacattcacccatttctcagttatactatcaatgttggaataaaaatcaactatcatctactaactagtatttacgttactagtatattatcatatacggtgttagaagatgacgtaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattatagccttaatcacaatggaatcccaacaattacatcaaaatccacatgctctacaatcaatatattatcatatacggtgttagatgatgacataagttatgagaagctgcccatcgaagttagaggaagctaaagtgcaaggattgataatgtaataggataatcaaacatataaaacggaatgaggaataatcgtaatattggtatatagaaatttcgattttattttgaggattcccataccgccgaggagagcttcgagtatactctgtatacatgatattatagcctttatcaacaatggaatcccaacaattatctaaaaattcacccacatctcaattttagagtttcatttcaacaaaacgcataacatatataccaacaatgaatactgtatacgttttttacaatttcttttggagaaaactccactgcctgtgttggacttcatacgagatttttttcaccgttgatttggaaacactagacaaattggagataaaggcgcttccttaaacaacaagcagactgctatcaagtatagtatacagatcaccatttattttttttttccccttggtagtatcatatacttttgaaaagttgtagtatgacagctcatgcaaatgaaaggattagcgatgtatcccctagtgctaggggttcaagttcggaatcgaagtatgacaagctctgccgagttcttttctttattgcaattacaaaaagctcattcactccggagcacatattgtataagcattcaatatttactgataagccaattttagctgatatagttacttttatgtatgcggcgtttgtttccattggatggtttctgatatggggggaaagagcatacagaactcaagaaatgggtcaacctccaatgtactcgaatataaactatcaccttttaagttttaagaaaagacaccccaagaaatttacatgtgcgttatggttggtatttttccttgcatatacggttttgacagttttaatttggttagttcagttgatttttcgaaaaggtaatgtttttcaaatgttattgcaacttattatattagatatcgccattgcattggtcaatgtagcaattgcattcacttttgaaatatatctttcacagaaagccgctatcgagattcgcgacgaaggtttaaataatcttgacaccgcttaatggaatggtagtcgaaaggtaagaagtacgcagcaaattcaaccagaatacacactgtaccttttaaaattttactcatagtagataatggcataaatcagtggtaaaaaaagaatacgcatgacaaattttgaaaaccgtacgtgacataaaatacctataataagatgaagacatcaattctcaagttccacttttcgccggttgagtgtatcggtcatagtacaaaggcagaaatgaataatagtaatattaatcgcagtttcctgttgtttagagaactgaaacgctttgtgggcatcaggtttagattaactgctacccttcttctgtatttgtctggccatgcttctcaaataaaccgctgcggataacatttcaagtggtttctcaagggagaatcatagtttagcttaacatacagcaaatcgtcactatcttgactgatgcccggtgtatagagaatgggtagttaatatcatctagatggggtttctttgaaaacaccagtttctttgaggacaccagtttcagtgcttctctctaccccatcaactattgcactcctacctgcgtaataagtatacgaagtctaaaatagtgggacgtcttgcttttttcggtagtttttcgtttcgataaaggcaacaatgctgtatattgtatgcaggaagttcttaaggaaaatacaggaatctttagaaaaagaataaatagctttccattgtatcatgaacaagtcactcttcatattatatgtcgtcgcttcttatccctttaagttatgaattgttgagcttaggattttaccacaactgaataacattttctttattctaataatcgattttttttaataagattagacttgagtgccatcagcaaagaaaaatacttttaatgtcctttttttaactctacacagaatttagttggctgtttcattgatttacaaaaatataaatatataccgttaaaattatagcgataaactgagtatgtggtctctcttttcccgcagaatatgaaagcttttcttttataaatcttataatattggtctctttttggtacgtttggcaaattggcattcatttatcatgaaaagaacaggaactatattacttgggtattgcccataccaaaagaaattaaagatgaggcactgctagatttaccgctatttatggtcccagttggcgaggggaacattccatggttaatgaagcttgtcttgggtgggcccccattgaggtaatgcgccgttgcgggattttggttttccttgttagactcatttaggtttagcaaatcaatataatcattggttgcgttattgctgttaggacccgtgatttgttcgtagatcctttgtttgttatttgtattcaccagactattcacactaacggtgctaccacatatactgtttgactgctgctgaccaaattggtacatacttggagtgattggtgatgattgttccatattccggctgaaaacgctgttatcagagagtgagctcatgtttctcattggagtgtggctttgagatgaggaagcgggcgaaggaatggatgtgctatttgaattttcgaaagagcatgatggggttgatatggtaagctttctcgaaatgttcaagttggatgcaatttgcagttttctttgtagatccaagtgatattctttcacttgattaatgaagggtagaacaccattgaccgttttatacacttccatcaaggagttaggaatggaaacaatgccgttcattaaggtactcaaaatttcaccatttttgctttctgatgtcattggagtcattaaaaaaggaccgtggtcttgattggtgaattgattgataatggagaatatgccgtgcgatacttcgaaaagttcatatctaagtaagtcgtactgccacgcggatacatcaatcaagaattttttcaaattaatcaacttgatctttagttttaagtcttcttcttcttcttcttcgttttggtagggcctctcgtctacagtggcatcactatcctgggataattgagactgacgtttttcagagcattgtttgtcataagtaacttgattttcataaagttcgtattgcatcaaacaattttcatcaacatttaaaacgtaatcattgatcattggttcataaatgttccaatttaaagtgtctagtatatgtctttccatttgtaaaaacattgattcatcaaagacctgaccatcaccacagtaatgaactagttcagagagtcgaggtatacgtgcccttgggttgggaccataaaatcttccgccagtagggatgactacattattgatgatgtgattacaaccgccccaagttttagcagccaaccagagacaagtagcgacaaccaatttggcttggtcccgtaacacgattctcttggaacaatagcggtcatataatctaactgaatgaaaaaaaataccatttgtcactcgagtgaccacagacagctcgaacaaaaaagtgataatgttggaccttgtttccacggggttcatttcaggctgctggtctattagttttggattaggtttgaacttacatgattgagcaataacattggtggagatttcttggtggtattcttgcagcatttcgaagtgagaaagtaattctgcattagatagctcaatcggatagtagtccggtttagcattgatgacgagtcccatacggggtcttggttcagcactagccattgtctgtcgttaaatttaatgaatgaatggaaaaaagaaaagattttcttttgtatgcaaattatgatgtggtaagcgaatgaattggcagctatagagtctagcaatgctgtatataagaagaaaatttgacgatgaagtaaagtagatgttaaaataaaagtaagttgtccttgatattatctattgccaattcactaaaaaaccagtaagaggagcataatagttaccagagtcgattgctatttttttatatatgaaagagatagtaagttaaacaagtagccagaggctgcgtgcgatacgcaaatagaaggcggatctgcgttctgcgtttgcgcaggccttttttcctttccgtttttcagtaggcctgtcagatcaacatttcgcaggttagatcctcaaaaagggccaacagttgtttcagttggtgttcatttcaatttttagcagttatacttaacaggctacgccaaatgtgctcttcgctaggtatccgcatgcggaaacataacggtttttggcgcgtttcgtgactagaacacgcagttttgaggttcagcgggacgaatttcgtgtacttccgttgagacaaatttcgcgatgatttccgttttcggaaagatggagccgggtaaagcgcgcatgaattgataacttggcacttttgaacctcagtatcattattaacaatgtatagttgctttagttcgcatttcagggtaaaagtgcggaggatacgaaaaagatgagataacttacagaaggaaacgaatagtggtttcaaaaaatgcctttcactcgtagagaaaacaataaaagttaccgcactccaacacaggcgatactggaggaatattttcaagagtaaatagaagcaaagatgcttaaaaatggatacttgaaccaatttttctgtagcggtatattacgctgctcttttaaaattatttctgacgcgacccgtttttgtgtcgctcggtgaaaatcacgaaaaacttgacactttgaaaactaatacaacataaagagactgaagacgaggaaatcaaaacaacgaaaaaagtcaatcttcgaaggagcatagaggcgaatgactactgaacaatgaatcaggaagacaacacgggcggagggggcatttttggtcttttcaaatggactaaggatgcgctgtttggtacggacatatcaccttcaatgaaatataaagatcaggaagaacgaagagaccgatctaggtatgcccaagacgacacaaatttttctatgaagtttggaaatgactccaacaggaggagtacaaacttatcgaggtcaaattcgtggtctggtctggattcaacgctccataggaagtacgagttactcccagagtacaacgagaacggctttaactcaattgttaacggtgaccaccacagcaaagagagaatacgatctttacgaagtcctgctccgatagtaccgagagaaccacttcgtaacgaacctacggatacatttggtcacagactacacacaaaaaggagaactataaatgagctttccaattcgcagataccctttataccacctcaggaagacgaccctttgctctcgaaattatttaacaaggatggagttaatgaggttagaagatcgccctataagttatcggttaaagatataccaggcaaatttccatctcccttaacaaaacgtgatgaaatagacaattactatgtccgggacgaagatgcttgccacaagaatagagagtataaaaaggcatattttgatctttttgcacaaatggacttgaacagtagagacctggaagatttgtgtgaggatgttagagagcagcgtgagcaattccacaggaatgagcaaacttataagcaagcatacgaggaaatgagagcagaactggtcaacgagttgaagaaatctaagacactctttgaaaattattattcattaggtcagaagtacaagagtttgaaaaaggtccttgatcaaacgatcagtcatgaggctgaactggccacttctagggaacggctgtatcaggaggaggatttgaaaaactttgaaatacaaacattgaagcaaagactatccgatttagagctgaaatataccaatttgcaaatagaaaaggacatgcagcgggacaattatgaatccgaaatacatgatttattattacagcttagccttcgtaataacgagagaaaagatacttctgctggttcgaatattttttcaacaggacaataggacaggactccattccacaatggaaataacagttacgactctaattcgcattcatgggacactgattacttaaaaaatatagacggattcatagaacgctgaagcagaaaagctgacacgtttctcccactgtaacattaaaaatacgtcatgatagcaatgataatgtgttaactacttaggtatgtacattatatagataacggaataaaaaaagatacgttcttattatcatcactcaacacgagctgtaattcccgcccattttttcttcattatcaggttgcgattttgaacaaaaaaagtgaaacttgaagttacgatgtgacataaatttgttaaaataaaaaagataaaattcaggatagaagtaggtgcaacgcgaaattgtctctgtctacttgtgccttgaacatcgaacttacaacagattaacaaagtatcgttgctcttttcattcgtctgttcgttatcatcattggatagggcttactttctcgcacgtgatttttcccacagtataaattttgagctataagtggtaataaaaattcaataaaaatatagggaaaacaagcccagtagttttgatttcttctatcatgtcagctatacaatcgccagcacctaaacctctgcagccaacttatccagctgcttcgccagcttccacgaatgcatatatgaagccgggcctaattggtagtcctgccgtcagtaatcataccgagcctaacaatggtaacaatgaaactgcggagcctcagggaccaaatcagagaattgatttgggtgccatgatcgaagaattaacctcactattgggaaaagaaagctggacgaaatatgctcagatcatcagtcttttcattttagggaagttatccagaaaggaactttctaatgaattagagctggtattttcaccaagcgctgcaagcttagaaaaatcaaatacaaatcatcaccatagtttagtacgacttcataaccaacttttattagggatttttgctaattcattacgtgaaaaccctcttgggagaaacggtaatgagagttcttggggatttggcaatggaagcaacaatccaaacaataaactaaaaagaatcaataagcataactctcaaattgaagtctataaaaaaattgtcatgtcgttacctctaaatgatcgaaatagacttaaaatgatcacgaaagaggccggcaaaagaggcttcattttttgctctgtatttcaagccagattaaataatatacccaaaattcccattgtaaccaatccagaaagtttgaagcgtgtcaagagcaataatttaaaaacgccgctggaatggtcacaagatataatgaatggattcaacgttcctttagcgagcgaaagccattctttaccagacacggattcgttttacttaagaatggttggtatagcaagagaacatgggttagtcggcacagtggacgcacgttgcgtagagcttatatcattggccctagatcaatatctaaaaaatataatagagtttactattgatacagttcgttatagaaggaagaaatattcagattattatgatttgaatgagagtgggctttataaatccgtatcagaaatggctgctgataaacgcgatgccaaaattaagcagttagatgatgataaaaatgaggatgaatgtgccgatgaagccaaaagtattaataacggcaataacagtagcaaggacgatattggcgacatatcaatgagcagcattacaaaggctggcgaagcagttaatgaggagttacatgaaaacagaacgatatcattaacgaatgaagacatatatgattcgttatctatatttccgaatttggttgaaccttcaggttcatactatgcgttaactaatttagggctagttaacgatgatgaactagtagatatgaagagcaatattgacgacttgccggacttcttaaatgaaaagccgactttcacgcctttggatgaaagaaacgttggtacaaggcatgaattaaattggttaattaaaggaatcttaacggaagattgatgtataaaaagtgtgtgtatgcggtatgttgtaattatattgaaagattataaaccttatttgtttcatatctaaatggctgtgttaagaaagacgataatgtgaccgagcttaagtgagctttttctttcttttacaaagttgtgtttgaacttcttctgaaatcgttaataatttattgacattttttgaatcgttcaagtttagcaagaaaaaggatttagtatcagaaattagttttttcagaacaagtgcaataggggtctcgcatgattccttcttaaagatgcttttatcaaactgttcaatggacttcagattatttaactcgataaaataaaagtccaccggtacggggtcattgttgccatcgctttttgaatctcgaggaaaaaactgcaccttgattatacccatcccagaatgaggtaaatttgggtgttcatcacaactaaaatttaagggcaaatcttcgagtccattttctatgatgacaagtttggaatccaaagaaattgagtgtttttcaaatttcaactttatgctatctttatcattgtgggaataatccaagagcatgtcctgagaaaattcgtcatctgataaaaatacaaactgtaaggtgatcacatattgtttttgatatattgtatccttttcggccaaaaattttattagagactctctcaatgagccatgtggagtggtgcttagagatattaagttgaaattttttttttggttcaggcacatatcatggtaaacgctatactcttgagtgaaaaatttatcttcagaaacttttaaatgcggtatcaccctattaaatttgtaaacatgttcgcttagaccttgggttattacgccattttcgtaatcaaataaaaggttctcaggcaaattttgctccatcacgtaagcgtaacagcgcatcgtgcctttttgttcaataatagagttttcaagtctcctactccgcaggagttctttttccacagtgttataggtatcattataaaatttttcctgtttagaggccatttctttcaaattttccatttggttttgtaaatgttccaaatcttgcgagttttgtaaggatttgcttattagtgggttgtttgccaattccaattgttttatattttcatttatttctgagatgttttgttccgaatattcagcttgtctatctatatccatgatctccttgtgtaacttctcactttccgattgtagagtggctatctgatcaagtaattcacgatgtttgtttgtcaaattttccatggattttaacttagcttctttgaatgcaataaaatccttcctcaattgtgattcgtggtttacttgtctttccaagttttgcttctgtaaattcgcccaatttatgttgagctcttgcagcgttttcttcaactgagatatttcctctgtgatttcgtggtcaggctcgacattttccattatttgcagctcattttcccaaaagataagcttattattgtacaattcttgagattcctgccttttcaagatcagattctggtcgagttcagcctgcaaggttgccaaagcggatttgttcttcttaattaaatcagcgcgttcaccgtccttggagttcagattttgcgtcaaatctctaacctgtttgagatactttgcttgtttggattttttcttataaagttcaaacctggacttattgagatctcgaaacttgatggttttgatttctctttcgcactcaatcaattgagtcctgagagtatgtctttggaaccttattttgtcttggcggtcttttaagtccttaattttgctcatgttgatgtttaatgatgcagatcgagatacagatgggaaggaatcctttacgggtggaagagccaatgaactcttcatagacgaaggtctagagccattcatggtgtttgtcgtgtttgtgatatccataaggtttcgagattttgatgaggacacattatcgggattgtgaaagattctattctttgaaagaaaagcgtgtttgttttgctgtgacgccataaagtacactggtcaggaaatggtgcttttgcgaggagaatgtgtgtgtatgtgtgtgttgttagggcatttcatattctatattcattgtttttttgttttttttgttttttcagttctttgtttacctattttttctttgccgcaattgcaaatattattaacttaattgcgattattgagactaaacaataaagacctggcagtggaggcatgacagaggatatcgcgaaacgattgtttaagagtatattataaagttgacttgtttccttataattataattataaatatatatatatagattattcacaggagaaattgggggcacaaatgaggggtaaaaatgcagacattaactaaaatcgttgttattaacgtttcttgtcatctggggcagagcgactctaatcccatcgatatcttttgacatcttaatctggcacccaagcctgcttgtctctgttagcccgtaagcaagatcgagcatatcgttttcatcatcttcaggttccggcagggcatcgtagtagtctggatcaacgatgacgtgacaggtggagcaggcacaagaaccgccgcatgcgccctccatgtccaggttgtgaccttgagcgatgtccaggatggtttcgccctcacagacttcgtacgtcttctgggagccatccttcagaataaaagttatcttcagttcttcgcctggtttcggttttttcaaatggccatggtttaagaacgaagacgtagagaagggcagaaatcttgtggttgtggtggtgcgtgtgagcagagatggagaggtgcgtaaaagatgtgctgcgatgttcgatattctagctgtgtgtccagcccgagtaacaattttcagcattgggggcgggttgagtatagatacgagaagcgcctatttcgtatgaggttttttttttctattattatgtatattaggcatatatatacatatatatattttgcatacatattcatttttaaaaaaatgcaactgctacacgctttgaaagattcaatgaaaagtttttccgacgaccagaattggctagcaaaaaaacgaaaatgtaatggagtcatgcaaacatgactaatagtaacaaaaaaaaaagatatagtagaattgagtaagtaagttctatgtatattgttgttattttctctaaaaaaaaaaaaaaactatgtaaaattaggaattaagaatatgcttggaaggaatgccgatttaaaatgtgtaggatatgcgatgcaaggggtcgtgagaacaagtagagatgtggtaaaatgcgtcataccgatgacaaccacagtctgtagttctgttgtgcgacattggcaaaggcatcgttacttgcaaaggcaaacccagaggcagagttagattccttactagcagcagcaactgcactggcggcgttgccgttaaattccatatcgaacatgcaatcgtcttcagtactcgttattatgttgctgtccgtcttatctttagtgtgcgtgcattctgactcatcgacaatcgggtacgatagcggaaaagttagcaattcttgctggtaagattgagaaaagtcatcggcataagtcgatctgtccgggctatgcgagagcatagggggctcgaaagcaacgtttgaaaacgaaagagggaagacctcgtcttcatagcgcgagatgggggaagattccacagaggacattgtaaataattgtaattgtatattattgtgtgtaagtttggttggtttggtgtagccaatttagtttggttttctcaagaataaaacaagtaagaaagaaagagagttgctccagaccctttccgaaatcaagatgagtcctgttcttatatatacctttttacgcagagccgcttctttatgcaccgtggagtaattaccgaattgcaaaaccacccgggtgtggatgtggatgcaaaataacagtgaaatgagtaataacaatggtcataaacatgtggtgtgcaatgtgtcatcttcgcgcgcgtgctaaaaaaaacgaataacggtggtgatcccgcggctttccacactgacggggtcacgtgtgtttattctgttttcttctaacggcttctgtagatttccggacggttccacgcagcgccacagcttggttccagatcgacggaagagaacgtgcaaccctttgggctggttatgaaacaacgcagatggagaatatggctcacaaccccaagggacttcttggtttggttttgtttacagttttttgcttggcaaaggtgccatcgtttgtcatgatagcatgacggtagcaggcatcattgattttgcaactgttgcggaccaggacagtgggtatggtgtaacttctgtaacacacccacaaatgtggttgagtctctaatggagatgagtgagtgggcgagccaggatagggtctttggcatgtgcggtgcttacccggaagggagatgcgcacgtgactgttgaaaaagggaaaagcagaggtaatgaatgacgaagtcggttcattgcatgtgctgttacacttcttaaatagatatcgattaagaattactataatgatttgttacttattttttattaactagctttgggggagagccatggaaaatagcactcggtcttgtggcggagttggatttgcttgactgtggccccctcacgctgtttaatgacgacgagaggcagcaatgatgttgttcatttcttcgaccttagccttggctctggtgaaagaacccaatctcttcttggcgacctttctggctctcttttcaccggagtttctgatcaaatcgatcaatcttctttcatatggggacaaaccggcgatttctctaaccaaagatctgacgaacttggttctgttggaggcagcacccttcttgtaggagatctttggggctggagtcatttgggtgactttcttacccttgttcaaaccaatagcgatacctagaggaaaaaaatagaatatcttatgttagtaacaagcacactagtactcacgtagtatacgagcaaaataaataaacaaagactccacggagtactgcaacgctgggtgcaggatataaacgatgtttgcatatctctggagcttaatctcatcctgtttgtatttctgttgttggcttagtggttcagttcattttgcttttgctctacagttcattagttcaggtaaacataccagtcttgacagccattttgtattatccttgcttctctattctgttttgactatggtaatacacgaacttaagacttaacgctaattaaaacgaatattcaagaaatgcaatgatgtgcctcttcctctgcctctctctctctctctctcctagtgcattcatgctagcttccctcgtcgggcttccctgaacagccttggttggcaacccaatgaaaaagttccgcgcacgcggtatgtgcgtctttcgcaaccagacctctcggtcatggtcgtctcccgcacggtaaagcggaaacaaaaacccaacacatccgtggatgtacgggtgaaaatacagtcaaaaaaaaaacaacaacaacaacattgtctaaacgagtcgtgatgcattttttaacacaaattggagaggcacacaatgtgcacacagcgcaaaactatacatctatttaaaaacttttttaaaaccagtccagcctttcctccctttagccttagaatctcgttccaataacgatgccgtggacacttgctccttattgatgttaatcaactcatcgatttccgcttgcagttcagtgattctttcctctaattggccgttctccctcatcacctcattgttcctggatatggtcctttccaagtcttctctcagatctgcctttggtagtgacgcgtccgggttcggtaaattttgcttgcgaatctcttcctcaatttggcttttgatatcagtgattgtatttatcaggtcgtttttttcatccaacagcatctccatattcaatctgttctgaatcagctcgttagcggcgctgatattctctttgttcaaaattgaatagtcgtgttctagcttctgcgcctctctttgtagttggtggttttgaattcttagtgattcgtagtggtcctcttttttttgctctttttcatggatttctacgtactctcccctgtatcttcttaatgttaatggtgtgatatatacacctgtcattgcatcatgaacgaaaagatcgacattgtaggaaaaagtgccgtcatcattgcccttaaatgagttcccatttgacaatcccatttgcactacagaagcgtcatcctggtttcccattaaatagtaattgaagagttcgtcctttaaaaaatccaatagttcatcgaatctcaattttactaaagtttcttcattctttaacattaaatttacagcaaacttcaaaagcacttcaataccctctacgaatacaatatcaaaaattcttaacacaaactctaacggaaacttgtatgcgaaaaatgtcaaaaaccattgtgtagcgtacattgtggagctaattccctcacggatcaagcgattgtacaaagaaggtgaatgctcctctaataatctatcaaattgataaagcattaacatcagcccaggcattcctggtaagaaaagctctcttaatccataattcttcattaatccaacgagtagtccaaaagattcggcctcgttttcacagtttattaatagcggcgctgcaatgaaccccatgccttgcgtgtacccaacatctggatcataaacagaatacacctttattaccttgtatagtgactccattttgtcctcggccacaaacttcgttctccttaaatctctacgtattgttgcttcatgaagacattcggtatccaatagagtttcatatatatcttccatttctcttgatttggaattcgccatcagctgccaaatgatacctcgaatttgtggtggtatcccattggtaacatgggcttctaaattttctggttcgttgcttgccactgtagcataatcattaactacttgagtccagaaggaccaatcaattttaaacatttctctatcttcttcattaacattctccacttcgttatactcggacaagttctccagaaatgacgtaaatgtcgattttaaaaagctttgaccttcctgcaacgactctctagtttcttccccctctttattcaaatggtgactggtcttgcggtaacgactagcgatcaaattaatttctgcagtggactctaattgcgcagttttggaaccagtgagaggaacatgatgataactatttcttttagtttcttcgaagtttttacggaacttctctgacttcatttcttcctctagtggcggtggaacagcattcttcgtcttcggtggttgttccctttgtttgccccttggaggtaattttggtgacgttgatgtcgcaacattttgtctaggtggtaatggtggcgaagatgtagtgggaattgcggaaacctcgttctcgcttgagttatcacctttttcatttatgatttgtgtgggtataggtggtactttcctagcagtttctgaggaaagattctctgctgttacgggcccatcttctatagcagctttttgttccttgttttcattcaagtttattcctgcggctacctcattggtaatatgaatctggttattatcattttctgacgacctttctggggttacttcactacttatagaaatgtcgttcgcatttgcagctgtcgtagtaccagattcgtcatcgagaaatttactcgaggatgatttctcacctccagaattttttccagttacttccctattttctggactactaacaacctctttcgtatcagcgtaaaccttctcattctctttgactgcatcatattctttttcaatattcagcccatttggggcttgcacatccgttgtcacatctttttcaacatccaatggctcatttaaatcaatttcagaactaggttctctcgtttcttgcctttgttcattaacgttttgttcagtgatttgggtgtcttcatcaccagagatcccaataggttcttctcttgatacatttgtgggtgcttcatggcctaaactttgttgcttgtcatttagttctttgtccgaatggaggggctcagttggaattatagctatctcttcatattggtctgatggcgttgattttatctcttcctccattgaacccaaattattcgaatgattatcaccttcgtgaacttcagaggcgatcgtatctgtatttttctcaatagatttgtctgaagacattgctctattaacgttctactttacactggtggtaggagctgttttattttgagtattaactaatcaatctcaattacgttcgatccaaacccttttttttcgttatatgagcgaagcttctgaataagccctcgtaatatattttcatgaagaatttaggtccaaaaaaaagatgggcattaattctagtcatttaaaaaattctatagatcagaggttacatggccaagattgaaacttagaggagtatagttacataaaagaaggcaaaacgatgtataaatgaaagaaattgagatggtgcacgatgcacagttgaagtgaacttgcggggtttttcagtatctacgattcattttactctttttttgggtttggtggggtatcttcatcatcgaatagatagttatatacatcatccattgtagtggtattaaacatccctgtagtgattccaaacgcgttatacgcagtttggtccgtccaaccaggtgacagtggttttgaattattaccatcatcaattttactagccgtgatttcattattcatgaagttatcatgaacgttagaggaggcaattggttgtgaaagcgcttgagaatttgtttgagttgttatgaggttcggaccgttgctactgttagtgaaagtgaaggacaatgagctatcagcaatattcccactttgattaaaattggcgccaccaaacaaagcagacggggtcagtggcactaatgattgcagctgttgctgttgccctagaaaaggcgtgactgagcgatgcgaaggtgtgcttcttggtattgtcactggagagttacgagagggtggacggttagataacagcttgactagatcactgaaacttgctcctgatttcaatggcacaggtgaaggccctactgagccaggagaaacatatttaacactgatattgttgacattttcctccggaagagtagggtattgggcgatagttgcagaaccgacaatatttttaatggcgctaccattactattgttataactgatatgcggtaatgggattgcacactgtgataacagaaacggcgcacatacctcttccagtacttgaatgtatttttcacaagtctggattttaaaagtggccagtttttttaatagcatcagaacagtgttaatttgttgtaataattgtgcggtctcgttattctcagcattcgattttgagtttgagagtagagtctttatgggtactaggactgcattgaacaagtaataagaacaattccaggcaaaatatggggtgacattatgattgtccatatagctacttacagacataacagttctttgtgctgcatcgcttaacatgatggagcatcgtttaacttcataactttgatgatcattttgatcctgttctagttgtgactttttctgggtaaaattagtgaaaaaatctcttaatacataaatgataagagacaactgtttccacttcagttcgaatcttgtaaaggatagccaagggtgttccttcaacaaattggttagagcggtggtggaaatatccatttgtaaaaactttggtgcctgtctcgaaacctcctcaatctcattacaaatcatcaagcatttttttgcacatataggacttttttctgcagttactgttttgtctagttcatagatttttgtgaaaacttgtaagagccttgctgtttcaatgatgccatgatatatggtgggacctgttgtggtacgctgcacatcgtcgacagaagaagggaaggagattgtattctgagaaagctggatggatcgaccataaagcagggacaattggatctcccaagagtagacagaccaccaaattcggcgtctttgttccagaatgctgctatcactgaaggacgaggggaggtccctattcaagcccaatgatatggccattcttatggaaaagctgtgaaaattatagctagtatttgttttctgcctccactgtgtatatcgcgacagaagatgtagggctgtcaccaaaattatggaacctgactcgaagaccttgctcgtcaaatgagatttagcattttgatagtaaaaaacatctatatcagtagattccccctctatacaccaggctccaatggctaatatgcagttaaaaaggatttgccattgatccttcgacgcgatttcaatctggttattatacaacatcattagcgtcggtgagtgcacgatagggcagtaggggtgaaaattattgagataactttgaagtaaacgggatgttgtggatctagaagccaacgtgtatctatccgtaatcatggtcgggagcctgttaacgttagagttcgtgtaattttccggtttaaagccaatagatcgaagaatacataagagagaaccgtcgccaaagaacccattattgttggggtccgttttcaggaagggcaagccatccgacatgtcatcctcttcagaccaatcaaatccatgaagagcatccctgggcataaaatccaacggaattgtggagttatcatgatgagctgccgagtcaatcgatacagtcaactgtctttgacctttgttactactctcttccgatgatgatgtcgcacttattctatgctgtctcaatgttagaggcatatcagtctccactgaagccaatctatctgtgacggcatctttattcacattatcttgtacaaataatcctgttaacaatgcttttatatcctgtaaagaatccattttcaaaatcatgtcaaggtcttctcgaggaaaaatcagtagaaatagctgttccagtctttctagccttgattccacttctgtcagatgtgccctagtcagcggagaccttttggttttgggagagtagcgacactcccagttgttcttcagacacttggcgcacttcggtttttctttggagcacttgagctttttaagtcggcaaatatcgcatgcttgttcgatagaagacagtagcttcatctttcaggaggcttgcttctctgtcctctcttaaaatgatggcgtgcattacgtagacacaatctggagatgaagctgaaaatctggggaaggatgacggaaaaaatagctcataaaacagaaaaaggcccgaagtaacaataggaaaaattaattgcactaaacaaagaaaacgatattatggtgattaaactgatacagaattatgtaaatactttgaaattatagaaggtttgtagaataaaaaaaatactgggcgaatgctgtctcaaaggacgcggacgttttgaaacttcttgccgctcacgcacccaaaccaatcgcccctctggggcctccatgcaatgttgtttatctcttgtgttttattggcatacatcatgttaggagtctctagtgtcttgcacacctgcttgctgttgttgtttaaacttaagggatcctcgtttaaaccggatcctgcgccaccgtctgtcatctctgtgtcgccgtcagggtcctccaaggaagttccatgaatactgggggatttgctacctgcagcgttaatttccataaaggagctgttcaagtcccaatagagcacctggcagtcatctccgcacgagagcaaaacattgcgctttgtgggatgccatttaatcccgtttaccgaagaaccgtggccttgtaagtttagtataggggattctgggttcctcatatctagaataatgattttgttcgagtcagctgcaaaagtggccaacacatttgggtcatacggtgatggctccagcctcaataaggcgtccgaacctttcgacgacggtgttatagtacccgcagtggctccagacactgaggaagagggaggctcgtaaataattgtactgtgcgcaagcgatcttaaatcaaatactcgtacactaccgtccccaccacaactagcaaataattgggtcgattttgtcaaaaaccttacatcaaaaacttcgctgtcgtgagcgatcaattgggtcttaacgtagtgactgctttgcagatcccatacaatgcatgtggtgtcgatggaacttgagattatcaagttagtatcgaccgtgttccagtcaaatgatgttattggtgggaaagtgcctatgaccttcatgtcatctgcggccgcgggattggcggggtgctgtctattgtatttacacagagatagatttatttgttcttggaactgtctttcctcagggctaacgctccaaatccgtaaggagtcagaacacgtcgcgagtttccttggatacaattgagaggggacccattggattttgctcacaggataaaccacatctgcgtccactacgctttcccagctcagtagatcattagagtgcagaacctgcaacttatttctgctgtcctctttgtacgaacccaagcagacgtagtcgtcggcgctccaatcgagcccaaagagtggatagtgtgattgatattcgcacacggaggccatggaagggttcatcagattgcttacaaccggaatatttgcagcatagcccctcgcctgctgtaactgagaatgatttggtgaaaaaactggtggcgagaaatctaacggtgaatacatcggcgatcgacttgcatagtacgtggcacttaggtcacagccactattccttttgctgttaccgccattggtagtgttgccagacattccaaagggagatgggcctctaccttgatcttgtgccgccgaggaaggcccattagtaccactcaagtaattgttcttgttatatggctgccgctgcgatgagccaaacgatattgagctccttttattgccattgtgaaagggatccatttgaagggcgtgtatttgctcctataattcctttccttcttgttgtctgttgaccctttaggttgtatgccactctcgaaaacctaaagaactgattactaaattatttatacaagatttcagatgacaagatggttcaccccttgcccctggtcttcctcccagtaattattcatattccattttttttcataaacgcacgctaaggaaaaagaagagactgaaaattcttgcatattagaatataaaatgatatatactacatttatatacatccttaaactgtgaaagaaagaatagcgatacaaatgtctaggcagtccctaggacagtgccggagttgtcattgtggagaggcaatggtgtttctgtggacattaacggttcgtaatctttagttctgtcgatatcctcatctctgtaatacttaattccccaaggtattaatcgaattaaaccgtctaaacttttttcgattttggtgatgatccatcctggtggagtgatcttgttaaaccacgattccttgtagcctatggcgtaaccgacacataagccgaaaaaatgaccccagaaactggagccaggtataacgacggcaattgcgactaatagtactaggggtgtatataatgtcggaattgagtagtctgtgcgaaagatccttgttctagggcggatctgtgattctttaaaactatagtatgcgaataaggtgaaacaccacccactggcgcctgcaactaatgcttctggatatagcaacttacccaacaaacagtacagaattccggcaaatagagcactcaggttcaaaaaaacacctgtgtacacagtcccatgcgtttcttcgaagagattcaagggtgcccagatggctagcacattgaacagtaaatgaggcaatgataggtgaattaaaggataaagcgatagcctgctcatttgcagtttgaacaatgactctggcgccaacgacaggtcttcccttagggcaaaaataaaacttaacaggtaaatagcggttagaaataccacaaggcctgtggtcaacgcagctggtggatgaccaccgggaaaaacgtacgacttccaattcatagcacgaccaaatagcacaacctaacaaccagagtgaattgctgttctcagtgcttccaattaagcctttcccatccccctattcttcttgtatcgatgcagttcaaaaaaaaaaaaaaaaagaggctttagatctcaaagggccgaaaaaagtgaaaaattttctcgagaaatcataaaagcagccatcgccatatataaacaatctatgcatatgtatgcagcatggcatcgcatctttcttggcgacccggtagtagcatttaacttccattagaaccatataaaatgcatgggcctacttcaaaagctatttcccgcaatgtgagaagcgtgaagagaccaagaagagcacctaggcccgtggtctccacgcaggctatgaacaagttgtctaacgtaacactctctgctgaacaagaaaagttgagagagcgcgttttgtcgttcatgcgttccaacttatctcagtacaagtctgactggaaacatccggccatgtttgtaatccaaggggacgcaggtacaggcaagtctgtgattctaaactccttgttcaatgaaattcagaaactatcccagttctcaccttcttctgaagatatcttacatgggacacataattatctggtagtcaaccatcccgagatgttaaagttatatatccggattagtgacagtttcaaatatatttctaaatcgtcactagaacggcccacttcgttgatcaacaatctacagaagagaaaagtcatggccgatgtagtcattgtagatgaagcacatttgttggccacttctaaggatgctttcaaaagattttatggcgaaaaccatctcaaagacttaatgtccctttgtaaagtgcttgtattggtttacgatgataagcaagctttaagaatgggttcctattgggatgaaggttctaataacggtgccactttaaaggacttttacaacgagattccaccaaaatccagagactggtacactttaaaacagcagtttagggttgctgccccacaaaacgtgttgaactggattgaccaaattagtgtcgcaggtaaaatcccaccaattgaatctgtgctatctaagggcaatgcagattgtgctgacgataaaattaagaattttgatttcaaaatttgggatgattgtggcgccatgtacgaggcaatcaaggagaaagaccgtcaatacggccaatgtaggatgctatctacttacgattttccctatcgcttggacggaaaagactattacgttgaatgtggtgacaatttcaaagttcgctgggatcgctatactccacgtgaagtgacgccttggagtgagcgttgcgacacgattgatgaggtaggtagtgtgtatactatccaagggtttgatctgaattatgctggtgtaattttgggccgttccattgggtatgatgcggctaatgactgcatcaaactaagaccagagctgtatgacgatagggccggtttcaccaaaaagaaaaacattcacaatgcagaggacgttaagcaaaagattattatgaatagcattaatgtcctcttaactcgtggcgtgcgtggtctgtatgtttatgcatacgatcctgaattaagagagagactgcttcgtccatcaaaaaaataggaagtacatagtatagacaaattttataaatattaacttttatttgttgcgatcttcactaatctacgcagattttgccttcggtatattagccttcttcttgttgagtgcttcccaagtgattccaccaaatactataaacatccccacccattgctggaaacgtacactcttaccgaagacaataatactcaaaatcatcgagaccattttcctggtgactgttatcatgatcaaaactaaagagccaaattgttctagagtatagaaaataaagcattgtcccatagcgccacagaacgaataaagcattaaatagccccacacttgtgggtccatcgtcaatacagaaacggcattatcccattgtttgcagtcgatcacaataaaatacaaaatattccacaatatcacgaagaggttcagtgtaaacatcaagtgtgcacctgttatcaaagtttgttttcccttttctttggccttattggcctttagtagcttatcttgggtggcgttggtcaatccatcaaggaataaactagagaaaagtagtccaaacccttgtaatttgttatcatttccgctctcattaaaggatctcttcaactttttaccatcgttgccacctatagtgaaaatagtgacaccgagacttaccaagagagctacaacttttttttggcttgctatgggcgtcctatacaaaagcaaatgcaccaacaacacggggatcatcttgcatgactttgctaacatgtaagtgagataatccacgtgctttaaagaagttgtagccagcgggcctgaactactctgtgtaaatgatatcaacatcaattgtttccaatgatctttaatcatttttctgggcggatattccaccttcttccagtttaagtacaggtagcccatcatcattgccacagaagcttgtatgagggatattacattagggaattgaaactttcccatggagtttggccaggttcttgtagccaaaggctcctgtactaatgcccacgtcaaaaaagtagcatatataccaatcgcacagatcaccaaactggatgtacttcccgccatacaaatatacgaatactgccttgtttacttcttcttgttacgttgtaattctggttctaattacattgctgtcattttttcatgttcgatgggatctacaaaacaacctttagaagcgatctcagggaagctttggaagagaaacagctgatgattctggcattccacaaactacaacaacgaaccaaacgacatattccattgcagtgatttgattgggagtaagcttttataaacgagcagaccaatatgatttacgtagtatttcgttgtctttaccacatcgttgttcgtgataagttctgaaaattttttttggagtatatttgctagagttaatccaacaatattagcataaacgagcagctggagactaggttatttgaattatttgagcatcaaagtgatcaattgtattatattacagtgtaattttctttttttccatattgaatcaaaaactagccacgcttgaaactaaagatggttgcctattctccaatcattgccacctatggtaatcgtgcagaacagtttttagaaacagactcagacttcgctaagtatcatgcgaaattgaataaaaagttgcaacacttgaggagccgttgccatttggtcaccaaggatacaaagaaatactcaagtaaaaataagtatggcgaaattaactccgaggattatgataataaaactaaattgattggtgttttgattttactacacgctgaaagggacttggcactggctgaaactttgaaattgagagctcgtcaaagaggaaagttaaagaaaagtgaagaaaaggttttatccacaagattgaagaaggcctgcaagactgctgataaattggttaacgtcactcaaaatgaacagcaatggataactcgtgcccaatatttagcgttcgctaaattggtacattcagagtacctaattaatggaaaaaggttcaagaggaaggacaatgccaaaatttcgaacaacctagccctcgttttcgccgcattggaacacttgaagaatctaagcttattagctgaagaagttgtagataacattgttaataaataccagtactctctcaagcagtacgcgggaaatttaattacaacgcccgaaataaataactttatcgtggaaagagttcaatctgatgagaacaaggacgatgagcttgtgaaattgttattagacaatggattcaatatgaaaaaaattacaacctcaactgaagatcaaaaggttaccactaacataaactggagatctttcaacgccaagataatcgatgctgaagttgctcaatttttggaacaaggtctatctatccacccaactcagattactcaatatacacagaggctatcaaaattggagaaagctttagaccgtcatgaatttttcatcgcaaaccacgacgatcaagatgacatagacgagatggttgaaaatagttctgaaaacaatcagataattttagcctacattaaatataatattcttttgacctctatatctcgtgaaagagatttgtttactcatttatggaatcaatggctgaaattaaatacttcattaccatcgaagttaaccaaatataaagaaatggaacgtattgtgaagaatttgacaaaatatttatcggacataatggagctacctggtgtgtattcagatgacgagctgctaagccaattagacttatgcaagctgtatttccagttatttctgaatacgggctgcctgagtgttttatatcagtcgaaaggcagatatatggaggcgttagctctatatgtggacgcttaccgaagattagaaaacaaattatctgaaattgaatctctagacgaaatcttacttccagcaaatcttttgtcattgaattctgtccgaagcttacaaaagagaatcgaaaacggtggtaatagtgtcattactttggcggaatacgaaaaaagaaatcatggtggcagcttagggaaatatgatttgacagtgattgaaaaattggatagtaaaaaaatactgccaacggacatacaattgaaaaatttattccctctcaagccaaaaatgctgcccattcctagtaaaccaacactttttgatttggccttcaactacataacatatgataagcaagagccctcagcttctcaagtgaaagattcagtcacagaaaccgagagcatctctcaaacaccaatttctaatgagcagacggaaggagagcctaaaaagaagcgtggtttcttgggcctatttggtcgttaatatttttctagtatgactgtatttatagtactatatagattattccatttaaacaaatgatgattgccaactatagtagccaaataacgaagtgcattacttaacacatcttatttttatctactgaagatatcgccaaattacagcacatgctaaaaagaagatgtttagggtcctttacataactatacgttaaattatttttgctgctgaaaataaggaaaataaaaacaaagataaaaatagaaagaatgggaaaatttagtaacagcttttgcccaatatgctcaaaaccgagttatctattacaaagcgttccttttatagaaaaaactgacaatcaaatgtagtaattggctattgttaacaacaacgttggaatggaataatttccacgtctcgatttttggttcaacttgagtctttatcaagtctttaaatgagaaagaatcgacatcatccgagtatcgtttatcgggcccttttcttttgtcaatcatttgaataccgaatctagaaccatccgatgtggaaattttgaatattatatctgggaatttaggaccgctcgaaccaaagacttttacagtcagttcagctagtttttcacccctgatggttttaagcactcctctttcatacaactgctttgtgttccatttaaacttcattccctgcaattcagaacgttctcttccttgaactttttttactgcattcttaaaatttccaaatttacttttgtgcaccggcgaaaaatccttggctttctggaagtcttttatcgtatgatcaacatgttttttaagccttgataattctatatctaagctgtggttcatttccgaaatttttgtgagtgtttcctttgtgatgtaaatttcctgggttacataatcaatggcatagttgggatttttaatagtgttcgcaatatcgtttaagaaattttgtaacttattatcagaagagcaaaaagtccccgtactttctagttcatgtatttttttcaaagtaacatttttgagtgtgaagtatttcaatggtttcagcttctgtatcattggatcatccctgattttaggattttgctccagaaaatttgcaaaatttggttcatcttgaggtagaattgtactaattgaaaggtcatacaaattggtatctacatcctcaatttgcatcatgtacacaaatgcccttttaacttggtcgtagatttttctcatcttgtcatcactaacgaggaatcgatatgcagatgcatccaattccaaggtaacacgtcctgatcttggaaaggatgaattgtccaagttcttttccaaaatatcatgcaaaatatctgcttccggaaattcatttaaatactcttcaaatttaccactgatttccagaaccttttcagttaacaattccaatttggggcttggcgataccatatccaaataaatcaatctatctccctcttgttcatactctggatctactaacacattataaaggacatctttgatatgaggctttatttcgttagcgtactggttcaatggatccaaaaagccatcaaaatttttgatttcaaaaacagtcgccaaggatttcattagaatgtcaattttttggttatttttttgaacgttgctgtctttgtatccgtaatattcccggttgaccaaatattcagacacaaaaacgttcactagaatacttgatatggcccttaaagagtcaatctcctcaatattcttatctgccgcgtagcagaagattttagtgcagaggtacctgatttcaacgggaatagtgtgaacctttctggtataaatttcagcgaccatttcaatcgcgtgccataggcaccttaaattgtcaatgaacttattcttggtactcgcatcatccacaggcgaacaatgctgaggagagctaaagccgtgtatttcttgataaattttgtatggatcactttcaaaatccactactggatctgacaagtaatccaaaactgggactattatagagaagaattctggagactctcttctcaaaaaatcttgaagaatggtttgccaaaattgtgatcggttgtcaagaaagctttcaatactcggtgcttcattaatcgcattttgtaacatttcacaaacaaaccttgtgaaataggatctctctctgtcgttcatcctttgattcactgttccaaatgtcatataaacattctttgcaacaaattctggctctttcaaatacagcaatttccaataagagggatcaacttgcaacatatagaacagtttttcatacttttgatatttagacttcggaatcgtagaatcggaaataccgagttcatgatctttatcttttaatagtccaaacttatccaatactccgttaatatttagttgttgtcttatgctcttcagtaatcgttccttcttcatattttcggaatcaagagaggcttggcaactctccaactggttttggacctcttcaatggttgctgttccattgagcaaatgaacgaattttttgacagcccaaagacttggatttggacagtctagaagttccaaatatgccgatctttgcagacttttcctaatccagctttgaatcataataaccgaccttacgtttctcttgtaaaaactcgacttttggtccaagctttcacgtactaaagcgcctctagaaaatgcttgaaataatgctaaattattatactccacaatgtcatcgactaagtctaatgtgtagcggactagaatacctctaaccaaaccctggaggtcgtgcacagtttcactgagattattttcgggcgcaaacagtgactgtaccttatgtcttacagcgtttccgcgtatacaggctgataattgaataatattacagttttcttttccaagtgaatatattattgatgctaggcacgaacgcgtaaatattcctctaatcaagctttgcaattttgagatattttccttatgtacatcatgtacagcacttaatatcgcgtcctctgaacacctcacaacgttacctctgatgattgccgaaaacttcataatactttctcgctcatcgttcaactttgtattgagggacatcaccttctttctcacataagaagcacgcatataagactgcaattttgtcagaggataatgtgatatctcaatatcatttaattttgtgttaacggttgtcttcaacaattttgaacgacaatatgcttgcaaaagttcgacagtacacgaaaaccttgagagtgtaaatttcaatttatcgtatttatatcgaattctgcttcccttaattcgcgattgaatcgcctcgacatgaggaacgtcaatctttgctcttcttattggcaaatacattgatgacaatactctaaatttatttcctcttaggcatgcttgaaaccttagtatgtcctgttcaaaaaggttcagtaaccttttttgaatgtataggttaaaacgggtattaactcctcgacaaatattttgcagttgaactaccttctctaaaaattgttcctctgtcatcctttctcttctcatgggagaataatgagaaggtgagtatttgaacgtctggtaataattcaaatcttcctctcttgcacgactccttctcgtataaaattctgtatcatatgtcaagtatttcgagatggtaggagaatagtacgacagacttttgttttttattgggctatattctaaagatggtgtagggcccagaagactcggctcaatgggtgtgaatttcctcttctcaacaacgacatccaaatttgacatttttggagcttcattataaggtgaaggtgtattagaaaaatcggagcaattagcatctgttatattctttcttggggtaattaaaatttcttccaccggtatattcggcctttcaaatttattaaagtcttttatcaatccgcttcttttttcttttggttcctcaggggaagctggtgcagtattgatattagttcctaaggacttgaagtctctaattctaggccatgcttttttacaagctgcgatttcttctttggtaaaacttatttggcccgatacatttgttaaagcgggcgttttgcctggccatttcttattaatcattgatataagaatatgcagggtttcgaaaacctgagggatattcttcttgttatagagatcttgcaattcaaatctaaaagagtccggaacaccgacatgttctaccaaaccaaaaaaggcattaatgttctgagtgtgtttaaattgtagtttatcacctgcaggaaatataaccgttgtcaaatctggatttatcctctgggttagcttggccaaaaaaacaccattcctaagtgagtctccaacacataactctatttctgatggtagtgcttcctcaataacagcttcaatccatattttgacttctgatactctgcataaaaactcatagtacctcagttctattttcgaataattacttaagtctacggtatattttcctacgagtttgttaggaagggatggcttcagctttgatacggaactttctactttttttgacaaaattgtcgcagaactgttgctagctgacgtcttagtctttaaatgacttggcgacgctatgtttaacgaagagttgattttggaacttgactgcggtctcagaggtggagtcacattggtgcctaggttttcaacataacgatttagataagaattattattgcctggtttcgaaggagagcctgaatatgctgtcattgtttttgcaccaccttgttacatataattgaactggtgcaataagtttttcaaaaaaataatctatgttttggccaactactttcttattttcaataaaaagctgttgttttctgatgtcaataacagggtttcttaatttcaagatggaagaatttgtaatgtttacactttcctcttttaggatatgctattaatggcatgcttaaatcactatatacgaaataaacaattttagcgatgcgtagctcaatataaagcgctataagtaagcgcgaaacaactgcattgtatccttgttacaaatatcaaaatcttcaaatgcaaaggcagaattgtcctcagtttcttcgctttggaaggggttagagaaatcttgtataattaggtggtcccgagtgcttgcgttgaaaatgcatttgtgacaattttctatgattaccacttgtttgcaatcgatacttggcgagagtttctctatcaaaattttgcaatttttcaagtcacgtaaacggatttggaaatccttgtcggaaggagaccgtagaaaaattatagaatccgtacaatcagttatgaaaatactccctgtttgaaagaaaatcctttgtaagtttatgacacatttagtaatattgcgaaagcacaaagaaccagaaagggcactattgccactataatctgttgttgatgtaacagtacaaaactctaaattttcaaaagctgaatcacccttctccaagacataatgctttttcaaagtagtggtatacgccggcgcattcgcaagctccgtacgttcaacattcttatgaacggctgatgatgaatttttctgtttgaaggagaatagtcgttttttgccctttgactcagataattttgcattaatagattttaatacattttctatatcattggagaagtgttctttttcataagatgtcaaagaatgtgacagagtattcagctcacttcgaagacttatggtcttcttctgcaaggtcttatagtcactcgtctctgagagttctcgttcgagctctacacaaaaaaatagtatacgaaaatatgcaatgttaattagttggacgcataatgaaagcagatgagtttcaacataccctttatcttcgcagtaaagtccatttatgcttaagctatttcagttatattcttaagtatatttcacgatttcagattcttcgcgttttgtatgacacactagacgcgtcggaatagtgaaaactctaaaaaaatacattgtaatgttttacccagttatttccatgcagatgccctatttacatacttatttattcattcgaatacctatacgttatattatgttttgtttataacctattcaaggccatgatgttctacctaatctacctcttccatttcggtgtcagctggaacctcttcaaccggagctgcggtggatgcttctggagcagtctctgtttcttcatcctcatcaatgttcaaacccaaagagatcaatctgttaattcttgatgcaaaggaagttggttcgtccaaactgaagccggaagtcaacaaagcagtttcatataataacttagtcaagtccttgacagtcttgtcttgagcaccaccttcgtcaactctctttttcaattccttgataattggagattttggagaaatttcgaaagtcttcttggaagacatgtaggaggacatggaagagtctctcaaggcttgagccttcatgattctttccatgttagcagaccaaccaaattgaccagttctgatagcagctggggcatccaacaatttgtaagaaacaacaactttctccacttggtcacccaaaatttctttcaaggccttggtcaatggttcatattctttgatctccttctctctttcagctttttcttcgtcagtttcttccaattcgaaatctttagtaatgtcaaccaaagttttaccttcgaattccttcaattgagtgaaggcgtattcatcaattgggtcggtcaagaacaaaacctcgaagtttttagccttcaaggcatccaaaaatggagacttttcgacagcctttagagattcaccagtgatgtagtagatgttcttttggtgttctggcattctggtaacgtaatcagttaaggaagtcaactcatctacggacttggtagagttgtaacgtaacaacttagccaaagcagccctgttttgggtatcttcatgtacacccaacttgatatttttggagaaagccgagtagaacttttcaaattgttcagagtcttcagcaatttcgttgaaggcttcaatcaactttttgacaatgttctttctaataaccttcatgatcttattttgttgtaacatttctctggacaaattcaatggtaaatcctcagagtcaacaacacccttgacgaaagataaccactctggaatcaagtcttcagcttcatcagtgatgaaaacacgacgaacgtacaacttgatattattcttcttctttttactctcaaacaagtcgaatggtgctctctttggaatgaataagatagctctaaattccaattgaccttcaacggagaaatgcttaacgtacaatgggtcttcccagtcgtttgaaatagacttatagaaagcattgtattcttcttgagtgatatcagatgggtttctagtccacaaaggcttagtcttgtttagttcttctatctcttgaacttcttctttaacttttttcgtctttggcttcttttcctcttcttcatcgacttcttccaattttggtttcttgtcgtcttcatccttcttttcctcatccttcttttcctcgtctttcttttcttcttctggaattggaacttccttttcaacttccttggtgacgactaattggattgggtaggccacgaactcagaatgtctcttgataacttcctttattctcttttcttccaagtactccaattggtcatctttcaagaataacctcaagatggtacccctaccaattctttcattaacttcgtctagagtaacagtgaaagaaccaccagcgttggattcccagatgtattgttcgtcgtcgttgctctttgaaataacctgaactctgtcggcaactaagaataaagagtaaaaaccaacaccgaattgaccaatcatggatacatcggcaccagcagatagagcttccatgaaggctttggtaccagacttggcaatggtacccaagttattaatcaattcagccttggtcataccaataccagaatctctgatttccaaaactttttgctctggctttggagtgattctaataaagagatctggttctgtttccaattgctttggatcagacaaagatttgtatctaattttatccaacgcatccgaggcattagatatcagttctctcaagaaaatttccttgttagaatagacggtgttgatgatcaaactcatcaactgagtaatttcagcttgaaattcaaaagtttcactagccatatctttgcgtgtttgtttgtgcttttgtttataggactctattttctatcaggtatgatttcttgaactctaatacagcgggaagaaatgaggaggtcacagatgttaagaattgaagggataagctgcatatttatatgttttagggggtggcggaaggacctggttggtattaagatgagaattaaccgctcataaaaccatgcgcgtgtttttcttccacggcgttctagaaaaaaaagaaaaattcaaaaagttctgcgaaactcgaaagaaccagaattgttcgaacaatatgtgacaagcgtatgagttaataatccgattaagctttattcctgttcttttttacgtgtatgtaaaactggtttatggattactgtgttgagagagggggggtgacaccctccggaatgtgatatatcacacgcttgcacgttggttcatatcgtaaccacgaagaatacaaatacgcacacgcaagctaagttatattttaaaatattctgtcatcaagcttccaaatacttctaaccatctcttattctcctcttagtagccattctttgccacgaggaataaaaagtcccgcgccactaattacaggaaaagaaaaataggacaattccatttgatgtcaccgtggtaatatcaccatgaacgatgatatgaaattttcatagaataagaaggaaaagtaataaaagaaaaagagaatctgagaaaaaatcgatgagttaattatcatttgtgtaaaacaaaaacgaattgtaatacgataggcaaaattgttcgcgctctatctcaaagaaagtaattatttccaaatagaaaaaaaaaatctacatatacgcagatatgggcctacacagtgaaccgttagatcaagaggaccaagacaccataatactcgatgcaagagctggcgatttggattctctgaaagatatatttacaactttagtcagtcccgagttactttcgacttgtaaggaaagtgaatctgattctacggctttacatatggctgctgccaacggtcatatagagaccgttcggtatatactggagacggtttctcgcgcaaatagtgccgaagacttgaaagcttttgttaatgaggtgaacaaaacaggcaacacggctttacattgggcgtcgttgaatggcaaattagacgtggtcaagctactgtgtgatgaatatgaggcagacccctttattagaaacaaattcggccacgatgctatctttgaggccgagaacagcgggaaggaagaagtggaaacatactttttgaagaagtatgatgtcgaacctgaagatgatgaagaagacacacaaactgagggcaagaattcggtccaaatcacaaagggtacagaaattgaacaagtcaccaaggaagccaccgaggctttaagagaagaaaccgagaaactgaatataaataaagactaaagtaaagagcttgttttcttcgtggaataaaagccgtaatatccattgagcatgatattttatttcttggtaccggagaagataaaaggatggaaccagcagaaatgcattaataaatacaaaaaatttagaaaagagttacagtaataatgtatatttctctcacaaactaagtaaccgcttcaaaagcgtatattttgaatgcattgaactttccatttcattacccgcagagccggagtcctcatcaacgacggagtgaaaaattttgtaattgcgagaaaaagtgaaattgatggaaaaaaagaaaaagaaagtagaagaagacattataagagagactaggaaacttcttgcacatcaaccgaaaagcgcctaggcaaccagtcatataataagcacgcacgagatgtcctccgatttagctgctgagttaggattcgaccctgcactaaagaagaaaaagaagactaagaaggtgatcccagatgattttgatgctgccgtaaacggcaaagaaaatggttcaggagatgatttatttgccggattaaaaaagaaaaagaagaagtccaagagcgtttctgccgatgctgaagctgaaaaagagcctactgacgacatagcagaagccttgggtgaactatccttgaagaagaaaaagaaaaagacaaaggacagcagtgtagacgcgtttgagaaagaactagctaaagctggtctagataatgtggatgctgaaagcaaagaaggcactccaagtgctaattccagcattcaacaagaagttggcctaccttattcagagttattatctagatttttcaatattctaagaactaacaatccagaacttgctggtgatagaagtggtccaaagttcagaattcctcctcctgtttgtttgcgtgatggtaagaagactattttctcgaatatccaagatatcgccgaaaaattgcatagatctccggaacatttgattcaatatctcttcgcagaattaggtacgtccggttctgttgacggtcagaaaagattagtcattaagggtaagtttcaatccaaacaaatggagaatgtcttaagaagatacattttggagtatgtcacttgtaaaacttgtaagagtattaacaccgaattgaagagagaacagtcaaacagactgttctttatggtctgtaaaagttgtggttctaccagatccgtctcttctattaaaaccggtttccaagctaccgttggtaagagaaggagaatgtgatgttggtgctttacctgttagcatatatataataaatacggatttcgtttatcttgtgtattttattcgtttcattagatatttaatgtttaaatgaagaaaaacttaaagtaaaaattttcattcacaaaataaatctaaacagcggtaggtaatcttcattgatcagagtgaacacattgcatggagccagccaatcatcgtgtcctgtttacttcccaaggacaggaaaaagctttgagaagcaaaaccgatcaagtgtctaaatcttgtaaaagatttaataattggctggtagtaggcctttgtataggatccacttgaatgcatttcttgattacactcaaaagcccctcagaaaatctggaatttctcgggaaactgtacttaccagtgtttatagcgtaggttaaagaagctccatgtatctgctcttctcgctcaaagggggagataccgaacattaaagtatagaacgtacaacccaaagaccaaatatcaaccttagagctcaaaacctgatttaatttcaagttcagaagttctggtggagtatatggcaacgtacaattgtcattgacccattcttgtagttcgctgagttgatgtctgttttcaattgttatatcagcttgagagcaggagccgaggtcaccaattactggtaaaccgtctgaagagaacaaaatgtttgaaggtgtaatatcgcgatgtgcatatgctattgaacctgctgagttggaggaaagcatgtccatctctaagggggtgtcttctaggagcatcgccgtttcatcgctataagtcatagaaaccgcatcgacatttactctggaagtagcgttatcttgtcttgacgcaggatcatgtaaacaaagtaaacctcttgtaactccaagcattatccttacgcattctgcctctgatacaaaggtgccctcgagtaacctccgattaatagagtcttgtaaactccctaatgaataatagggtagtactatgtaaattgtttttgacccatctttttcctgcattacttgtgagtcgatactttttataacataaggactttgaaaccgtttgtaattttcaatttctcgcataccattggatatactttccacactaggacaaataatcttctttagtgcgtataattctggtgttgcgatgccgttgtctataatcagagaattctttgacagttgtaccaaatacacaaaggacattccaccttctccaagtagtcgttgaatcctatatcgtttatcatttaccctaatagtagcatcggaaaatccgcgacagcagcacaagttctggaacaattccaatacaatagaaatcattgatcggataagatggtacaatcgttattttatccctagtcagtcgctgagattacaggctctttttgtctactctctgtttcgtctttttggagaaagtatggttcaacatcttacaaaaccagataccgaaaatgtccctaactcggtgtcataagacaggacttatcaaaacagaaaggatcttgcaaaaaagaaaaagagcaaattatgtaaactttgggggtcaacacagttgtatcagtcgtattggttagacccaatatagcggttttctttacttctttgtttctacacttattaaagtctatttaactccctttcacgtgatcagtttgaaagaaacgtgaaaattatttttttcagcgaactttttgaaggttttcaatagaagatgaaagctaaatgaagactgtacattcacacgggaaacgagagaaagaagttcagttagttgaagccagcaatactactttctctagcagtctagcacaagttactttgaaaggaaataaaaaaaattgtcagcatgtcgattcaaactagtgatccaaatgaaacatcagatttaaagtcgttatctttaattgctgcccactcccatattacaggtttaggtctagatgaaaacttgcaaccacgtcccacatccgaaggtatggttgggcaattgcaagcccgtcgtgctgctggtgtgatattgaaaatggttcaaaatggcaccatagcaggtagggctgttttggtagcgggccccccttcaactggtaagaccgctcttgccatgggtgtttcccagtctctgggtaaagatgtaccattcactgctattgcgggctcagaaatcttttctttagaattgagtaaaactgaagcactaactcaagcttttaggaaatccatcggtatcaaaatcaaggaggagacagaattgattgaaggtgaagtcgtggaaattcaaattgatagatctattactggtggacacaaacaaggaaaattgactattaaaactaccgatatggaaacaatttatgaattaggcaataaaatgattgatggcctaactaaagaaaaggtattggctggcgatgttatttctattgataaagctagtgggaagattaccaagctaggcagatcctttgctagatctagggattatgatgccatgggtgctgataccagatttgttcaatgtccggaaggcgaactgcaaaaaaggaaaacagtggttcacacggtgtcactgcatgaaattgatgttattaattcaagaacacaaggatttttggcattatttactggtgacaccggtgaaattaggtcagaggtaagagaccagataaacacaaaagtggcagaatggaaagaagaaggtaaagcagaaattgttcctggtgtattatttatcgacgaagtccacatgttggatatagaatgtttttcctttataaatagggctttggaagatgagtttgccccaatcgtcatgatggctacaaatagaggagtttccaaaaccagagggactaattacaaatctccacatgggttacctctcgatcttttggataggtcaattattattacaactaaaagttataatgagcaggagattaagacaattttatctataagagcacaagaggaggaagttgaactgtcatccgatgccttagatctattgaccaaaacaggtgtggaaactagtttgcgttacagcagtaatttaatctctgttgctcagcaaattgcaatgaagagaaaaaacaacactgttgaagtggaagatgtcaaaagggcttatttgctatttttggacagcgctagatctgttaagtatgttcaagagaacgagtcacaatatattgatgatcagggcaacgttcaaatatccattgctaaatcagcagaccctgatgccatggatactacggaataagcattttgtactttaaggcagaaattgcatcaaatatatatgtataaataaaaattttatgtttgcgtgattgttggtgataagaagtaaaaaagtacacctaaaataggcagcagttggccagcacgttcagaaccccgtatgatataccttctttcgaataattatcgattatcaaatgtatagatagcagtattataatatatactatattctatacatatatgaagggggttggtgcgtgtatatgagaaaaaatttttttattgtaattattttttttttttaaacttttgactcattcagagcctctagtgttcaaaatcaaagctacaatcataccatataaccctaaaacttcagagaaaattagaatcaaaacgataccgacaaaaagccttggttggtgcatatactttctaacaccaacgtcaccgaccataccaatggcgtagccactactcaaacaggcaaatcccacacagagcccacaactcaagtgcatgaacccattgaagagagtatagtcttcggtaggagataaattacctgcaattaaaacggccacaacaagcccataaatggctaagataccactcataaccacaggaatcaaagacttcatgatcaattccggcttgaaagtacctataccggcgataccaatacctgacttagctgtaccaatggcagctcccaaacaggaaagcaccatggcagctgcacaacctgcgaacccgaaaaagggagcgtacaatggagcatatatgttacttgcgagttgcgttgacatgtttacagagaataatagaatggaccctttcctcctccgactcttgctttgctatatttatttttttttttcttacgagtaaagaagaaaatattaggttatctatgttcctttttctaactaatcactctttcactaaagaatatttcttagcaaaaatatgcgtacctgcgtaccgggtaaaaagtcgcattgtccaagtgctgctgcttttacgcaaaagaacacatctaaccgaagaggaataagcagacctgaacaataccaaataaagaagttacttcttctttatcaccattttgacaggtttctacatttttttttccgtagagggaaaacatataaaagcagtccagtaattgcttgctttttgaaatggctctttaagcctgaaagcacaagacgattagtgatatagataatatatacacagatacacatgtacgtacataagtactgatttaggctgcaaccttttacctggctcaactgacacgaatattttgttatcagccaaaataaacgttcatgatatatagtgagaaaaaaagatcgatgggacgactcgcggccattccttgtgcgtgcaggaatcaagaaaataaacaaaccggtacagtacaataagcaggctgagtaggcggaaaaagttttattcagacgtgtaccggagcctaaatcctttcttacccatagcaaccacactaaatatattattgtaacacgagaagatgtcacaaggtcagtccaaaaaactggacgtaactgttgagcagcttcgaagtatataccaccagtttcatgatatcttggaagaaaaaactgatttgcatctaccgaagaaagaatacgacgatgacgctgttaggagagaggttcagatacagttacaagaatttcttttgagcgctatgacgatggcttcgaagtcactagaagttgtcaacgccgacacggtaggaaagacggtaaagcaattgatcatggaatcacaagagaagtacatggagccctttgaccttgacctgaatgagcaagttagaaagatgtaccaagagtgggaagacgaaaccgttaaggtggcccagttgaggcaaacggggcctgcaaaaatcaacgaagtttacaacaactcaaaggatgagtatttggcacaattggatgggagaatcggcgttcttcaagctagaatgatgcagcaacaatctgctgaccatgatgatagtaccgacgatgccgatgatcacatcaactgggagcacatcaagcaggattacgttgcctcactcaatgaattgtatcaaacacagcaagacctacccaaggtaagatataacgttgaaaaggtcaagcgcttaatggacttcctggaggaggattgaataaataacatataagacagtcaacctcgtggtaaatgataactatattctggggctttattcatttttttacacttttttatctttgtacgaagagctgaaaataaaaaagtatagagccagccttttcccacacactaacgacaaaagacgatatgcaggctgtgcgcatgggggagaatccagtttttgcccgttaaagagaaaaaattagtgtctgtgaaacgcgaatacaaaaaaagaaaagtagcaggatcttacttctcgtaaagacgtcaagaaccaaatcaagtcaaatcgtggaagttacaaggggaaagaccaataacttttagtaaagaacaaagaaaggtctatctcacgcagtgacggtctttgcggtaaatctgtgtatacttgaaagaaaacccttttacaattaaaaaaggcaattaaaaatagaaacaaatcaaatgagttataataatccgtaccagttggaaaccccttttgaagagtcatacgagttggacgaaggttcgagcgctatcggtgctgaaggccacgatttcgtgggcttcatgaataagatcagtcaaatcaatcgcgatctcgataagtacgaccataccatcaaccaggtcgattctttgcataagaggctactgaccgaagttaatgaggagcaagcaagtcacttaaggcactccctggacaacttcgtcgcacaagccacggacttgcagttcaaactgaaaaatgagattaaaagtgcccaaagggatgggatacatgacaccaacaagcaagctcaggcggaaaactccagacaaagatttttgaagcttatccaggactacagaattgtggattccaactacaaggaggagaataaagagcaagccaagaggcagtatatgatcattcaaccagaggccaccgaagatgaagttgaagcagccataagcgatgtagggggccagcagatcttctcacaagcattgttgaatgctaacagacgtggggaagccaagactgctcttgcggaagtccaggcaaggcaccaagagttattgaaactagaaaaatccatggcagaacttactcaattgtttaatgacatggaagaactggtaatagaacaacaagaaaacgtagacgtcatcgacaagaacgttgaagacgctcaactcgacgtagaacagggtgtcggtcataccgataaagccgtcaagagtgccagaaaagcaagaaagaacaagattagatgttggttgattgtattcgccatcattgtagtcgttgttgttgtcgttgttgtcccagccgttgtcaaaacgcgttaattccaactattttctatatttctattctatccgaactccccttttgtatatcaatatatcttaatactttcgcctattctttactatatttcctaaattttctctggtctgcaggccaaaaacaacaacttactactgaatcatggacgtgtatttagtttagccaagcaatatttaaatatcactcttcctaaaaatacattgggcattacccgcaaactaacccatcgcttagcaaaatccaaccattttttttttatctcccgcgttttcacatgctacctcattcgcctcgtaacgttacgaccgaaatctcactaaggcacggtttgttgggcagtttacagatgttggataaccagttgtttctaaacggttatgcctcatatataacttgttaactgaaggttacacaagaccacatcaccactgtcgtgcttttctaataaccgctatattagacgtttaaagggctacagcaacaccaattgaaataccatcattatgaagccggaagttgagcaagaattagctcatattttgctaactgaattgttagcttatcaatttgcctctcctgtgagatggattgaaactcaagatgtttttttgaaggattttaacactgaaagggttgttgaaatcggtccttctccaactttggctgggatggctcaaagaaccttgaagaataaatacgaatcttacgatgctgctctgtctttacatagagaaatcttatgctattcgaaggatgccaaagagatttattataccccagatccatccgaactagctgcaaaggaagagcccgctaaggaagaagctcctgctccaactccagctgctagtgctcctgctcctgcagcagcagccccagctcccgtcgcggcagcagccccagctgcagcagctgctgagattgccgatgaacctgtcaaggcttccctattgttgcacgttttggttgctcacaagttgaagaagtcgttagattccattccaatgtccaagacaatcaaagacttggtcggtggtaaatctacagtccaaaatgaaattttgggtgatttaggtaaagaatttggtactactcctgaaaaaccagaagaaactccattagaagaattggcagaaactttccaagataccttctctggagcattgggtaagcaatcttcctcgttattatcaagattaatctcatctaagatgcctggtgggtttactattactgtcgctagaaaatacttacaaactcgctggggactaccatctggtagacaagatggtgtccttttggtagctttatctaacgagcctgctgctcgtctaggttctgaagctgatgccaaggctttcttggactccatggctcaaaaatacgcttccattgttggtgttgacttatcatcagctgctagcgctagtggtgctgccggtgcaggtgctgctgccggtgcagctatgatcgatgctggcgctctggaagaaataaccaaagaccacaaggttttggcgcgtcaacaactgcaagtattggctcgttatctaaaaatggacttggataacggtgaaagaaagttcttgaaagaaaaggacactgttgctgaacttcaagctcagttggattacttgaatgccgaattaggtgaattctttgttaacggtgttgctacttctttctctagaaaaaaggccagaaccttcgattcttcctggaactgggctaaacaatctttattatcattatactttgagataattcatggtgtcttgaaaaacgttgatagagaggttgttagtgaagctatcaatatcatgaacagatctaacgatgctttgattaaattcatggaataccatatctctaacactgatgaaacaaaaggtgaaaactatcaattggttaaaactcttggtgagcagttgattgaaaactgtaaacaagttttggatgttgatccagtttacaaagatgttgctaagcctaccggtccaaaaactgctattgacaagaacggtaacattacatactcagaagagccaagagaaaaggttaggaaattatctcaatacgtacaagaaatggcccttggtggtccaatcaccaaagaatctcaacctactattgaagaggatttgactcgtgtttacaaggcaatcagtgctcaagctgataaacaagatatttccagctccaccagggttgaatttgaaaaactatatagtgatttgatgaagttcttggaaagctccaaagaaatcgatccttctcaaacaacccaattggccggtatggatgttgaggatgctttggacaaagattccaccaaagaagttgcttctttgccaaacaaatctaccatttctaagacggtatcttcaactattccaagagaaactattccgttcttacatttgagaaagaagactcctgccggagattggaaatatgaccgccaattgtcttctcttttcttagatggtttagaaaaggctgccttcaacggtgtcaccttcaaggacaaatacgtcttgatcactggtgctggtaagggttctattggtgctgaagtcttgcaaggtttgttacaaggtggtgctaaggttgttgttaccacctctcgtttctctaagcaagttacagactactaccaatccatttacgccaaatatggtgctaagggttctactttgattgttgttccattcaaccaaggttctaagcaagacgttgaagctttgattgaatttatctacgacactgaaaagaatggtggtttaggttgggatctagatgctattattccattcgcggccattccagaacaaggtattgaattagaacatattgattctaagtctgaatttgctcatagaatcatgttgaccaatatcttaagaatgatgggttgtgtcaagaagcaaaaatctgcaagaggtattgaaacaagaccagctcaagtcattctaccaatgtctccaaaccatggtactttcggtggtgatggtatgtattcagaatccaagttgtctttggaaactttgttcaacagatggcactctgaatcctgggccaatcaattaaccgtttgcggtgctattattggttggactagaggtactggtttaatgagcgctaataacatcattgctgaaggcattgaaaagatgggtgttcgtactttctctcaaaaggaaatggctttcaacttattgggtctattgactccagaagtcgtagaattgtgccaaaaatcacctgttatggctgacttgaatggtggtttgcaatttgttcctgaattgaaggaattcactgctaaattgcgtaaagagttggttgaaacttctgaagttagaaaggcagtttccatcgaaactgctttggagcataaggttgtcaatggcaatagcgctgatgctgcatatgctcaagtcgaaattcaaccaagagctaacattcaactggacttcccagaattgaaaccatacaaacaggttaaacaaattgctcccgctgagcttgaaggtttgttggatttggaaagagttattgtagttaccggttttgctgaagtcggcccatggggttcggccagaacaagatgggaaatggaagcttttggtgaattttcgttggaaggttgcgttgaaatggcctggattatgggcttcatttcataccataacggtaatttgaagggtcgtccatacactggttgggttgattccaaaacaaaagaaccagttgatgacaaggacgttaaggccaagtatgaaacatcaatcctagaacacagtggtatcagattgatcgaaccagagttattcaatggttacaacccagaaaagaaggaaatgattcaagaagtcattgtcgaagaagacttggaaccatttgaggcttcgaaggaaactgccgaacaatttaaacaccaacatggtgacaaagtggatatcttcgaaatcccagaaacaggagagtactctgttaagttactaaagggtgccactttatacattccaaaggctttgagatttgaccgtttggttgcaggtcaaattccaactggttggaatgctaagacttatggtatctctgatgatatcatttctcaggttgacccaatcacattattcgttttggtctctgttgtggaagcatttattgcatctggtatcaccgacccatacgaaatgtacaaatacgtacatgtttctgaggttggtaactgttctggttctggtatgggtggtgtttctgccttacgtggtatgtttaaggaccgtttcaaggatgagcctgtccaaaatgatattttacaagaatcatttatcaacaccatgtccgcttgggttaatatgttgttgatttcctcatctggtccaatcaagacacctgttggtgcctgtgccacatccgtggaatctgttgacattggtgtagaaaccatcttgtctggtaaggctagaatctgtattgtcggtggttacgatgatttccaagaagaaggctcctttgagttcggtaacatgaaggccacttccaacactttggaagaatttgaacatggtcgtaccccagcggaaatgtccagacctgccaccactacccgtaacggttttatggaagctcaaggtgctggtattcaaatcatcatgcaagctgatttagctttgaagatgggtgtgccaatttacggtattgttgccatggctgctaccgccaccgataagattggtagatctgtgccagctccaggtaagggtattttaaccactgctcgtgaacaccactccagtgttaagtatgcttcaccaaacttgaacatgaagtacagaaagcgccaattggttactcgtgaagctcagattaaagattgggtagaaaacgaattggaagctttgaagttggaggccgaagaaattccaagcgaagaccaaaacgagttcttacttgaacgtaccagagaaatccacaacgaagctgaaagtcaattgagagctgcacaacaacaatggggtaacgacttctacaagagggacccacgtattgctccattgagaggagcactggctacttacggtttaactattgatgacttgggtgtcgcttcattccacggtacatccacaaaggctaatgacaagaacgaatctgccacaattaatgaaatgatgaagcatttgggtagatctgaaggtaatcccgtcattggtgttttccaaaagttcttgactggtcatccaaagggtgctgctggtgcatggatgatgaatggtgctttgcaaattctaaacagtggtattattccaggtaaccgtaacgctgataacgtggataagatcttggagcaatttgaatacgtcttgtacccatccaagactttaaagaccgacggtgtcagagccgtgtccatcacttctttcggttttggtcaaaagggtggtcaagctattgtggttcatccagactacttatacggtgctatcactgaagacagatacaacgagtatgtcgccaaggttagtgccagagagaaaagtgcctacaaattcttccataatggtatgatctacaacaagttgttcgtaagtaaagagcatgctccatacactgatgaattggaagaggatgtttacttggacccattagcccgtgtatctaaggataagaaatcaggctccttgactttcaactctaaaaacatccaaagcaaggacagttacatcaatgctaacaccattgaaactgccaagatgattgaaaacatgaccaaggagaaagtctctaacggtggcgtcggtgtagatgttgaattaatcactagcatcaacgttgaaaatgatacttttatcgagcgcaatttcaccccgcaagaaatagagtactgcagcgcgcagcctagtgtgcaaagctctttcgctgggacatggtccgccaaagaggctgttttcaagtccttaggcgtcaagtccttaggcggtggtgctgcattgaaagacatcgaaatcgtacgcgttaacaaaaacgctccagccgttgaactgcacggtaacgccaaaaaggctgccgaagaagctggtgttaccgatgtgaaggtatctatttctcacgatgacctccaagctgtcgcggtcgccgtttctactaagaaatagagagagcactacgtagtccctcttttaatatgtaacgtgtcgcttctatttatcagacataatagtaattactttgttatttttctatcgtttccttactttagcctctgatttcgatctggcctaatcattgtgtacgtctataatcatatggccctgagcgtacacaccgttcaattcttctatttggtcggcccacacaaattcgcgcgggggcatattgacgcgtggaagaatagaagtccgcgtagcagctctggggtaattaggcttttacgatatcggctggcccagcaccggtttttattcctcccgtggttgttgtctctaccgtgaggaggggaaagggtcagggacggccggtagttatgttgtctcaacgattactgccatctattgtttacaccaatcgcgtggggcaaggggctggaaggctgtggtgtacagaatagggtctaatacccgatgcgcgacgctcctgcgactggttgtgtgagccaccccttgatcgcctctgccaaatactcagggaagagaaaaatcgcgaaggtggacgagtgcccttaaagaaccagcatcctcgatcgccgctgccgttcgccctggcttagcggtgggaagcatcctttggctttcgaattctccgccgttgagtccccctaagggccttatttatcccctctatttttttttagaaaatgttttctttttcaagatttgtttgctccttcacggcttcccccttaaccgttcaacagtcttccgtatataacaatctcaatccactcttattgcctataattttgattaattcttattcatcccggcagataaagtttcgtcttgttttgaaagagacaggagttcttggctgcagtattttgcaacagcttcattaaccatgtatgtaaagaaaaaatctggagcgacttactggcttagctttttttactaacacataaataatactgtgataagataagaaaaaaacacgaaatggaaaataccacgaatcgtaatactgcaggcgttcttacgagcagcaatggtaactttgccaccaatagtgtagcggcatcaactccgaagaggtccaaaagtgctcgaaggaaaacgttcaaatgcaccggatatgacggttgtacgatgtccttcactagagcggaacatcttgcacgtcatataagaaagcacactggtgaaaagccgttccagtgtcctgcatgtttgaaattcttcagtagagttgataatttgaaacagcatcgggaatcggtccatgcacataaaaaccaccattctaccagctcgcaccagcgtaagccttcctcttcatctttatcctcctcttcttctgcatcttcttcgtcttctgcttcatcatctacatcatatagtgatccttacaggaaaactaatattaatagcgggaacatgccgatgatggcagaaaacgaaaaagcgccccaaataatacattcttcgccggagttcattactagcacgagaagcatcccacccatctctccaaggtccatttataatacccaacgacagcaacaacaccaacaacaacagcatcaacaggctccctattattttccttcccatccaatcactgatagttactaccagtatcctcttcccagtaataataacaccatcaattatttaccatcagtagatgtgcagtatcctttgaatgtgagcccctcctcaacgagccatccggcctctgaggtaatcatatcgtcctttcctccgaggtccatgccaagtacttccttcaaatataaagattctgccgactttcaagcacggacaactatgaacaaatacaatattagaccaagcaatatcaatgtcaatactagtaatatcaataaccatcttgattcattctccccgccgttttctccgtcaacgacagttgctgaagcaaaaccaattattttaccacagtatcagcaggcatttagccaaccaccaaatggaaataaaaacaataatatgtcttcctcgaagaatggcggcaaagggggagaaaatttcaagaatactgatgatcgcaatgataataataacaaaaagaggtcggaaactttatcagagtctgatatttcggtcaacaccaataagaaaaggcttagtgttgattacatattgacttgatcgaggcaatctgatctaagtttcaaatattccgtagagtataaatatcttacaactaatataattcttaatatgcgcaaacaaattatggtgcgcatctttttttatttttatgttttgttccatactaaatgcagtttataaaatttttcaaatgagtcaagctatgtataatcagtgctacaaaaatgataagatgcaattgcaagaaaaaatcccttgcataaagggctttctgacctcttgcgttgatcaacgagaaataaccgcaaaacttaattttaaactcccgcgtctgctttacacagcccacagtagcatcaaaaactacgatgtaacactaacggtggattgtgaatacggaacgaacaatcctgcatcttgacttcaaaacttgatcatatacacctataccgccatggttatctcgcccttacgctcacccggacccccgttaattgcaataataagaaaaagaaaagaaagaagctttttatctcatttcactgacaagatgacgctttttccgattttagcagataaactatcacatataaccacttttttatattacatgaaatgatgccctacaacacccctccaaatatccaagaacctatgaacttcgcaagcagcaacccctttggtattattccagatgcgctcagtttccagaatttcaaatatgatcgtcttcagcagcagcaacagcagcagcaacagcagcaacaaaatcgcactgcgtcatcgttacagcagccgcaacagcaacaaccaataagcccgcctttgtttttagtaggggccggtaccagcgaaaactcaaaccttaacaagaatgccaacactagtactatccctcctttactctttagcagatcgtctcagcattatgttgtcccagatatagaccactcctccataatatacaagaacaacatctgcaaatctttcaaagatgacttatttttctgtccaagatctttactttctctcgaagaacaacaagcatgcgagaaaatggataggctgaccgctgaacaaatgtcattgtatcatcagaacacgcaatccagttctaatcctggttctatgtcttcttcacctccaaattctgcttcttctatattcaactctaggccgaagttcaatccttatacatctcaaagttttaatcctttggaaagtgttcaagaatgatcgcgatatggacaaacacgttgttttgatttcttttttgcatattcctcatttgaacaaatcttgtgtccatgttatgttacgttatgttatattatgtcaagccgtttcatttcctacttatttttaattatcggtttcttctattcatgtagttcactattcaattagtatatgtagataaaaggagaagggttttatctgcaaacagacgcaagacgtatgtactaagcactaaatactcatataaccatattctttcaaaaatacatgccatttttctgtttcataataatcctggaggctacaagtatggtgatataataaatcttgaaccttgttttactggaactcctaaagtcaagccatacataatgccagaaacaggacctgcgtagataacatataacatgtaccagtcatgattacccaacgtgccgttacaaatgatatatagacctacattttagttagtttcgtcgtaagttatggtaataaaggaaaagtcctctaatgaatctataatataggttcacacaaataagagtgataattaaaagcgtattcgacactgaaagatctgctgggaatactatactgatatttccaaaatatcccttataaattgaatctggaatagcacttctttttttaaaaaaccttgaattgttggtagcatttctatcctcccactatgagttacactgacaaccctcctcaaacaaaaagagctttatcgttagacgatctggtgaatcacgatgaaaatgaaaaggttaaattacaaaaattaagtgaggcggctaatggcagcagaccttttgccgaaaatttagaatctgatataaatcaaacggaaacgggccaagctgctccgattgacaattacaaggagagtactggtcatggctcgcactcacaaaaacctaaatcacgcaagtcatctaatgatgatgaagaaaccgatacggatgacgaaatgggtgcaagtggagaaattaattttgattcagaaatggactttgactatgataaacaacatagaaatttactatccaacggatcacctcctatgaatgatggtagtgatgccaatgcgaagttagaaaagccttctgatgattcaattcatcagaatagcaagagtgatgaagaacagagaataccgaaacaaggtaatgaagggaacattgccagcaactatataacccaagtacctctgcaaaagcagaagcaaactgagaagaagatagcgggaaatgcagtaggaagcgtggtcaagaaggaagaagaagcgaatgcagctgtagataatatttttgaagagaaagctactttacaatcaaaaaagaataatatcaagagagatttggaggttctgaatgaaatatctgcgtcttccaagcccagtaagtacaggaatgttccaatttgggcacaaaaatggaaacctactatcaaagctcttcaaagtataaatgtgaaagatctcaaaattgacccatcttttttaaacattattcccgatgatgacttaacaaagtcagtacaggactgggtttatgctacaatatactcaattgctcctgaactaagatccttcattgagttagaaatgaaatttggtgttattattgatgcgaaaggcccagatcgtgtaaatccaccagtttcttcacaatgtgttttcactgagcttgatgcccatctaacgcctaatattgatgcatctttgttcaaagagttgagcaaatatattcgtggtattagcgaagtcactgaaaatacaggtaaattcagtattattgaatcccagacaagagattccgtctatagagtcggactatccacgcaaagaccaaggtttttgagaatgagtacagatattaagactgggagggtaggacaatttatagagaaaagacatgtagcccaactactattatattcaccaaaagatagttacgacgttaaaatctccctaaacttggaattacctgtacctgacaacgatccgccagaaaaatataaatctcaaagcccaattagtgaaaggacgaaagaccgtgttagttacattcataatgattcctgtaccagaattgatattacaaaagtcgaaaatcataaccaaaattcaaaaagtagacaatcagagaccactcacgaagtggaactagaaatcaacacgcctgcactgttaaacgcctttgataacataacgaacgatagtaaagaatatgcatctcttattagaacgtttctgaataatggtacaattattagaagaaagttatcgtctttatcatatgaaatttttgaaggttcaaagaaagtcatgtaatatttgaatcatttcaaaaaaaaataagcaaatgcccttgagcgagaaattttttttgtttactcaaatgctgttatgaaagcttatgtaataataataataatgataataataacataaaaataattactctaacatttcttattatctctatatatccctaataaataggccattcttataataaccaagtctttcgccattttgatactatcaatagctaaagccatcttagagccatcaacctcatgccaggaaattggtatctcctcaatttggattctttttctgatggctaagatcaaaatttcaacgtcaaagatccaaccctctgtatgcaaatacggaaaaattttcaatatagcggctctgttgaacaatttgaatccacattgtgtgtctttgatagacctgatgccgaagatgaaaactaaggtatggaaaccgtacatcaagcagtttcttatcattgatctctttatgacggcttcggtatttaccatatgtgctctggaaccaattgctactgctggtttagtcgtttttagatctgtactagacgtttcaattttgctaatagcatctattagtttttctacatcactgaacttactagcaccatcagcatcggcaaaaagaccatacttacctctaatatgtaaaaaaccttgtctcactgcgccacctttgcctctgttttgagaaaacttgatgattctgaattgttcgtagttcaatttgaactgttctttacaaattttcaaacagtattgtgtggtattatctgtggaaccatcatccactatgacaatctcccatctggaaccatatttttcctttaaaaagctgattgcgtctgtcaacattagtaaaattctacctgtctcattatagcttgggataacaacagataaaaatatttcttcgtcatcttggtgttcattcaagttaggtaaggcacgactaacttcatgacctttttcatcaatagctatgtatttgagctcctctggatatggcggccttggtgtatgcgaaaataaatagaccaataaatacagtgaaagcaccaaggctactaagagcgtaaaaaagacagtgtttctgttctcaatcaggaatctcaacgctctcatttttgttgtgctttgtgtaatttttggctgcctctctgtttttgtccctttcttacgttatcaaaagcacctaatctatccttacagcatccaattagataccactacctttccacagtgactatggtcctttgtgccactttaattgcgataaagccttgaaaattggcacgttttcttcttgtttacactttttttcgaatacgccaaatttcgctttctcatgaaaaaaatggcatacactgcttcgaaagatacaacagagccatgtgcattaatatatataaattaaaaggtactgaagtgataacggtgaaaataggataactatgtacacttgactttggacttgttagttgtgactagtatagaagttacaagatcaaatggaataaacccaaacaccacatctaatttttcaatggaaaaagaaaagtttcaaggtggaaaaaaaattttcagcagcatcgcaataaatgttaaaaaataataatatattgcaacctatttaagataatacatatgcgtcgatctatagtgcataatttatatcttgtaaactgtaaatacaacgacaatcagtgctaattcaactcaggatgcctccaaagaagtttaaggatctaaactctttccttgacgaccaaccaaaggacccaaatctagtcgcttctcccttcggtggttattttaaaaaccctgctgctgatgccggtagtaataacgcttccaaaaaaagtagctaccaacaacagcgtaattggaaacaggggggcaactaccaacaaggtggttaccaatcgtataacagtaattacaacaattacaacaactacaacaactacaacaattataacaactacaataactataataaatacaatggccagggctatcaaaaatctacttacaaacaatcggctgtgacgcccaaccaaagtggaactccaactccatctgcttctactacatctttgacctctttgaatgaaaagctgtcgaacttagagttaacacccatctctcaatttttgtcaaagatacctgaatgtcaaagtatcactgattgcaaaaatcaaatcaaactaatcattgaagaatttggcaaagaaggtaacagtacgggtgagaaaattgaagagtggaaaatcgtcgatgttctatctaaattcatcaaacctaagaatccatcattagttagagaatctgccatgctaataatttccaacattgctcaatttttcagtggaaagccaccacaggaagcatacttgctaccattcttcaatgtcgcacttgactgtatttcagataaagagaatacagtcaaacgtgccgcgcaacatgccattgattctttgttgaattgctttccaatggaggctttaacctgttttgtactgcctacgattttggattacttatcatctggtgccaaatggcaagctaaaatggccgctctaagcgttgtagatagaataagagaagattcggcgaacgatttattggaacttactttcaaagatgcagttccagttttaaccgatgtagcaactgatttcaaacctgaattggccaaacaaggttacaaaactttattggactacgtttctattttggataacttagatttgtctcctcgttataaattgatcgtggacaccctgcaagatccatctaaggttcctgaatctgtaaaatcgttatccagtgttacatttgtcgctgaagttacggaaccttcactatctttgttagttcctattctaaacagatctttaaacctatcgtcatcatctcaagagcaattaagacaaaccgttattgtcgtggagaatttgacaagattggtgaataatcgtaatgaaattgaaagcttcatccctctactactacccggtatccaaaaggttgttgatactgcgtccttacctgaagttcgtgaattggctgaaaaggcccttaacgttctaaaagaagatgacgaagctgataaggaaaacaaattctcaggcagactgactttagaagaaggtagggatttcttacttgatcacctcaaggacattaaagctgatgattcctgttttgtcaagccttacatgaatgacgaaactgttatcaagtatatgagcaagattttgaccgtggattctaatgtgaacgactggaaaagacttgaagattttttgaccgccgtttttggtggttcagattcacaaagagaatttgtcaaacaagactttatccataacttgagagctttattctaccaagaaaaggaaagggcagatgaggacgaaggtattgagattgtcaacactgatttctccttagcttatggttcaagaatgcttttgaacaaaacaaatcttcgtctcctaaagggtcatcgttacggtttgtgtggtagaaatggtgctggtaagtctactttaatgagagcaattgctaatggtcaattggatggttttcctgacaaggatacattacgcacctgtttcgtcgaacataaattgcaaggtgaagaaggtgatttagacttggtttccttcattgctttagatgaagaactgcaatctacttctcgtgaggaaattgcagccgctttagaatctgtcggttttgatgaagagagaagagcacaaactgttggatctttatctggtggttggaaaatgaagttggaattggcaagagctatgttacaaaaagctgatattttattgctggatgaacctaccaatcatttagatgtttcgaacgttaaatggttagaagaatacttactggaacatactgatattacttcattgattgtttcgcatgactctggtttcttagatacagtctgtactgacatcatccattatgaaaacaagaaattggcttactacaaaggtaacttggcagcatttgttgagcagaaacctgaagctaaatcttactataccttaacagattctaatgctcaaatgcgtttcccacccccaggtattttaacaggtgttaagtctaacactagagccgtcgctaaaatgactgatgtaactttctcttatccaggtgcccaaaagccttccttaagccatgtctcctgttcattgtctctgtcttctcgtgtggcttgtttaggtcctaacggtgctggtaaatccactttgatcaagctattaactggtgaattggttccaaatgaaggtaaagtggaaaaacatccaaatttacgtattggttatattgctcagcatgcattgcaacacgtcaatgaacataaggaaaagacggcaaaccaatatttgcaatggcgttatcaattcggtgacgaccgtgaagtcttattgaaggaatccagaaaaatatccgaagatgaaaaggaaatgatgacaaaggaaatcgacattgatgacggtagaggtaagagagccattgaagctattgtaggtagacaaaagttgaaaaaatctttccaatatgaggtcaaatggaaatactggaaaccaaaatacaactcctgggttccaaaagatgttttggtcgagcatggctttgaaaaattggttcaaaaattcgacgatcacgaagcctccagagaagggttgggttaccgtgaattaattccttcagttatcaccaaacattttgaagacgttggtcttgattctgaaattgctaaccatactccattaggttctttatctggtggtcaattagttaaagtcgttattgccggtgctatgtggaacaaccctcatttacttgttttggatgaacctaccaactatttggacagagactctcttggtgctttggccgttgctattcgtgactggagtggtggtgtcgttatgatttcgcataataacgaatttgttggtgctttatgtcctgaacaatggattgtggagaacggtaaaatggttcaaaagggctctgcacaagttgaccaatccaaattcgaagatggtggtaatgctgatgccgttggtctaaaggcctccaacttggccaagccatctgtagatgacgatgattctccagctaacatcaaggtcaagcaaagaaagaagagattgacaagaaatgaaaagaagctgcaagccgaacgtcgtcgtctacgttacattgagtggttgtcatcgccaaaaggtacaccaaaaccagttgatactgacgatgaagaagattgaaagcctactggctagtgttttatcttcgctaacttcgtttgtttcactccatcttttttctttaattcactcctcaaatggagtttactacgttgatagaatttaggacaagcatatgacgctctccttccttttttgttttctaggttaattcatttttcatacagagtagttaatattggttcttttcatatatgtacggtacgcagattaattatgtaaacttaaacttaagggatcctttttgatgctaacaattgtcgatgttgaactacaaatttatgtaagaggtcgttgttaaggattattattttaaaaatacacgaagattgattattatttcttacatgaggttatgaatcgtgctccaaaagtataccaaaaataactcctgaactgctaggcacagtttgcgataatttaaaggggttaaatacacttttactactggctttcaccttataaatccctcattaaactaaagatgaatgaacattgttgaagaaattgtccgggtaagaggttgtactagggagtgatgaacatccataaattcttcgactagcagaagtaatgataattttcacccgttaaagctacatctggttagatggactagaagaaccacgacgaaacaatcatataacaatgtctacttttaatgcagaaaccgctgataacttggaagatatcgagaaacaattcgctgttgttgctgttgaacaagcggaaacatattggaaactattaacaagtgttcccggttccaagttacgtttgactaagtttgatgacgaaatatacgagaattttatggagagattcccagaatacaaagatgttgaaagggtcaaaaagtttacggaggaagaattaaaaacaaaagaagccaaggaaagatggagaaagttcttcacaatttttgagaaaaaaatcgaagactataactttggtactttgttgaggacagacgcttcagccgagtatggtcaatttactacttgttttgtcgtgagactacaattttacgcttttgaaattgctagaaataaacacggcttgaacgattggattgtcggtcagaaatgaacatgcatatatatttgtgattgattatatagaatacattactttatacaaaggaacaacacaaggcattcttccttgttcaacatatatatatatacatatatatattaagctcagtaaattgttgaaatgtgaaaggctgtacttttgctcttaacttttgaaaaaattcatcattgagaattccctaatgtttatgggtgtgagtatcggcagaatcagaatgagtatgagtatgatttgttgatttagtgtcatgagagtgctccaaatcacctttagagtcagaggttacatcaacaaactcgacgtccaccttcccacgtttggcaccttcatacgtaaatcctctcttatagtcgaaatagcgttttccaaaaatcttatcccaacttcctgacctgaatgtaatactggcacttccaaagttgtggtggcacgaagattaggaccggaagctaatatagtaaggtctctaacatgtaacgactgtttgagatctaagtctgttttcaaactgccaatgctgtcttttatgacagattcgatttctagataacgcggatcagtaggtggtatagattggtcaactaactccttcagtgaggataagataccttgtccacctgtttttatgatcaaacctgacactacaagcccacctaaattatctaaggattgaatgttgaaaaaataactagatgtgatagcgaccaacgctaccaacgatgtcaaggagtcaacacgatgatgccaggcgtttgccattagtacattagaatttgtttggattgcaactttctttgttgcctgaaaaacccattctttaaccaagatagaacccgctgctatccatacagcatttacattagttgcctgttgtgttagcgactgagaatgggaatgcgtttcaccaattaaaccggccatcgattctagaatggcatgaggaatgacaggccccacaatagcgcataacgacgaccaaccgatagatataccagccattgctaagattgtggatactgccaaagatcccacagtttccactttaccatagccatatgggtactccgaagttggtttacgagacgcatattggacagaaaacagtgttaaaaaatcagataccaaatcgctaagagcatgtacggaatcagcaagtaatgcttgagaatgaaaagtgattcctcctacaaattttcctactgccatccccacatttgatgcaagtcctatccatgttattcttacgccaggattcttcttgatctgctgtacgttcagtgacaataaaggattgtcatgcatatgtgtgtggctgtgactatgagtatgttgcaacaacgacttcacagaggaagccttgccttccttctttccttcactttcattctgtctggaattcgatccattctgtgaagacatttttgaaatgagctgttcattatagccctcttcttgaccttctttatttagcagtttcgaagaatgcaggcaccttctcgggttggctgagatcattgtactgtacaggcttgatgttcttatggccctcccggcagcatggtaactagtgttgttataacctgtcacaaaggaaccgaattgcttgatagagtcaatacttatccgtagcatatctttattgcgtttgcttttttgagaaagtaattgcttacacgttctagaataaaaaagtatggttgtaagaacgcacttgaaaaggcaccaatctgctcgggtttttacaactaacactaacctagatgagaggtaaaaagaaatcgtaaaaaaaagttgttgcccagcacaataacgacactttacccgctaattccaggaggtttgagttagacaacgaccttcccaccccgttttcccataattctattgttatacacctggatctggaggtccgtgaaacggcatacctcgacgaaaaaggtcactactaatcaaatcaaactgacattaataaaaacgtataaactgacagctgtagatctaaataaactagattaaacatatgaaatagtttgtaaaaagtggcatcatgaccaataataggtccagatgaagaaaaaagaaaaaagaagacgaaattagggtaaaatttctcacttgctgctcaagggtgagacccgcacctcaggcatgtaatagaagcttcgaccaccgcatctaccagacgccttggttcccactatcatcatcatattcatcgtttcctgacccagacagatcgcgtctaccgctgccgatattagaggattggtagcggttactttgagcacctcttgtacgaccttgtttttgctgttggcccgaagtcaagaagtcatcgtcttcatcgtcgtccaactgaccttgagtgttagtttcgcggtaagtttgggtataagtgccaccaccagtgccggcagtgtagtcagtagtttgttgctggaagtcgttaccgccaaactgcgtgttaccgcctagattagactgtggctgctggcgttgagggaaattcccttggttttcttcgccgtagggatcggccttggatccttgattcctgaattccctctgttgatgtttttcatgacgctgttgtctagtctggtcgtcattgtcgtcttcgtaacgttcatcatgatcgttgccgtgcaacttatcagcaaacttgtttaatagattggacatttcttaattgttattcgtacttagcttttatgcggtagtgtttggctctgctgctagtagatattaagagttgagggtaggtatgtatcctttttttgatgaaatagtaatgtgcttttatagtccaagaaatattgactgcttcaagggagcctgattaacaagcacgtaacggagaccaaaaaaaggatttcggtcttttctaaccatttccctttactcccttgtgcgttatttgttttgattactaggcatgatgtatggaggaacttgcgatcaaatgtcataaaagtggaggagtgaaaagaaatgacgaagcccaaaacgtggtcctagaattaccacatttcctttttctaaaggaagccagactatgctttacgcaagaactgtggttaaagagggatattctgatgaacataaattcatacacattcatgagaagcacgacaaggattggttaattacttacaactaaggcaaaactgccattgacctcatctgtaccaccacatgctgtgtagttattttccctttgtgatccctaaaaaagatgggatctacacaccttacaagaacatcctcaaacccatacctggaaccactgaacatattcttcccgtgaaaggctctacggcgaaactactgtaatgtcacaggaaattaaggatgcttcgactatggaacggaccatacatggggacccgatgtatagaaagcctcaatgaggcaaagagtctagctcctttaagatacgtaattctccttctgttttcccttaattattcgggtgaaataccacatggtcgcacggctgacggggaactccggaattggacgatgaagaacttaacggtgatatgaggtgatcgtggaacaaaacgttgtgccaaagaagccacaaatacgtcactgtaattattctgcctgcataaaaagagccatcaaggataagctagagactatactccggaagtagaagaaggaaggtgtgagaaagaagatagagcgtgtaacacaatcatgggggaaaaaaggacaataatcaaagcgctgaaaaactctgcagcgtcccacttcatcaagaagttgaccgcagatacttccctgtcgtccatacaagaggcaataaacgtcgtgcagcagtacaatgcaacggatcccgtgagattaaagcttttccatacgcctcggatggtttcgcagggggctcattttgcattttgtttgcccactaagaaaccacattacaagccattactgctttcgcaaaacgcacttgatgagtttaatttggtgcaggatcaggacttggagaaaatactatccggtgagaaagtatattattccgatagtatctttccctatagtacagtgtactccggatttcaattcggctcatttgctgcacagctgggagacggacgtgtggtaaacttgtttgatcttaaggacaagtgtagcggacaatggcaaacgtttcagttgaaaggtgccggtatgacgccattttctcggtttgcagatgggaaagctgtgttaagatcaagcatacgtgaattcataatgagcgaggcgttgcacagtattggaattccatccacaagagctatgcaattaactctgttaccggggacgaaggcgcaaaggcgcaatcaagaaccgtgcgctgttgtatgccgttttgcgcccagctggatccgcttgggtaacttcaacctattcagatggcggcacgacttgaaagggttgatccaactatcagattattgcattgaggaattgtttgctggggggacccaatttgaggggaaacccgactttaatatattcaaaagggatttttttcctgacactgagacgaagattgatgagcaggtggaaaaggatgaaactgaggtgagtaccatgaccggagataacatttccacattgagcaaatatgatgagtttttcagacatgtagttagcttgaatgcaaacacagtggcccattggcaagcgtatgggtttgctaacggtgttttgaatacggataacacctccattatgggcctgacaattgattatggcccctttgccttcctggacaagtttgaaccaagctttaccccgaaccatgatgacacagcgaagagatattcgtttgccaaccagccaagcattatatggtggaacttgcaacagtttgccaaggatctcgcatgtctgctgggtcctgaggcccgtgaccttgaattgttacttaagggcgaactgaattctgttgatgacgccctagagaaaaccatgattgaaagggtccagaagttggtagagctcagtgctaatgagtacaagtatgtgtttacgacaaggtacgcgcagataatgtctcaaagactcggtgtagatctggatctggaaaagtgcatgtcttctacaaacctcaaagatatcgaacatgcagccgagaaggctaaagagttctgcgatgttatcgtcgaaccattgctagatattctgcaggccacaaaagtcgactataacaatttttttatccatctacaaaattacaaggggcccttcttcatcaaagataaaagtgacaccgcaacactttttggagcattcgatgaagagtacttgggtatgttcttcaactccaagcaactgcagcaaatggcagaaactgaagaggccttcgcggctggtgagaaggtctttgacgctaacggcgaattgcgtttgctcaacgaaaaattgcaagaaatacgcaattggacccaagactatttgaccttggtcccacccacggaaactgctgcaagagcgtcgcttgccaagaaagccaacccgttgtttgtccccagaagttgggtactggaggaagtagtcgacgatttaatgtacagtcaaagggatggcctacaagatcccagttcggagctagatacatctgcgttgaagaagctatacctaatgagcgtaaacccatacgaccgcacgaaatgggatgtcactctgcggccagaactggagacaaaatgggctgacctttcccaccaagatgacgctaagtttatgatgcaagcttcctgcagtagctaaatgaccacagatgtatttatacattcatagctatatatatacatatatatatatacatgtaatatggcgcaagtaggcacggtagtcaccaattgctcaggtatctcctcggtgtaaaagcacgtacaccgcgttcggagagtcgtttataaactcaaaaggggaaagagacaagggtagccgaacgactggcaccggacacgaacacgaaaacttatttagattattaaaaaaaaaaaaaaaagagaggaaacgaggcggaggcggagaggaggagagagacaagagacgggcagaacaagaagggtaaaaacagtgagaaacagtctccgccgttttgactgcgtatccatcgttattgtccactacgagacgctaatgacgaaacgagctaccacatgcgtttcctacgcacctgctaaagacctgacactttaaaggacccatcttctggccttctgtcccgggtgctgaccaagctctcttccttttccttgcattttttatatattaatactcactttctttccgatttttatttttgagtcttcttaagcaaaatcctgctatgcgaatctgaaccgatcgctcgagaactaacttaaccatacttgctcacattgccgttttgggaaactgcggaatttttttgggaaagaacaagaaataagcggaggcacacatagaaaaaagaaacgcagaaagatcaagcacggatatttctggctagaggtttataaaagaaagaatacctggcagcaaagagattattttcattattgacacacatacccgaccaaaaacggcgttaagaatgcaagtactagtgacgctctggtgtctaatatgcacatgcctggtactaccagtggccgccaagaaaaggacactgacagcgagttcactggtcacgtgcatggagaactcacagctttcagccaatagtttcgatgtgtcgttttctccagacgatcgatcgctacattacgatctggatatgaccacgcagatcgactcttacatctacgcttatgtggacgtgtatgcctacgggttcaagattattacggagaacttcgacgtgtgttcaatgggttggaagcagttttgccctgtgcacccaggtaacatacaaatcgactccattgaatacattgcccagaagtacgtgaaaatgattccgggaattgcctaccaagtgcccgatattgatgcgtacgtaagattgaacatttataacaacgtaagtgaaaatttggcttgtatccaggttttcttttccaatgggaaaactgtatcacaaattggggttaaatgggtgacagctgttatcgccggtattggtttattaacttccgctgtcttgtccaccttcgggaactccacagcagcatctcacatttctgcaaacaccatgtcactgttcttatatttccaatctgtcgctgtggtcgcaatgcaacatgtagacagtgttccacccattgctgctgcctggtctgaaaaccttgcctggtcgatgggcttgatccgtattacatttatgcagaaaatcttccgttggtatgtagaggcgactggaggctccgcatctctatatttgaccgcgacaacaatgtcagtgctcactcaacgaggtctggattaccttaaaaatacttcggtttacaagagggcggaaaatgtcttgtacggtaactcaaacactttaatctttcgaggaattaaaagaatgggataccgtatgaagattgaaaatacggccatcgtttgtactgggttcacattctttgtgctgtgcggttattttttggccgggtttatcatggcctgcaaatacagtatcgagttatgtataagatgtggttggatgcggagtgataggttttaccaatttaggaaaaactggaggtcagttctgaaaggatcgttgttaagatacatctatattgggttcacgcaactgacaattttaagtttttgggagttcactgaacgggattccgccggtgttattgttattgcatgcctattcattgtattgtcatgcgggttgatggcgtgggctgcgtacagaaccatttttttcgcaagtaaatctgtggaaatgtacaataacccagctgctttattgtatggtgatgagtacgtcttaaacaagtacgggtttttctacaccatgttcaacgcaaaacattattggtggaatgctcttttaacgacgtatattcttgtaaaagctttatttgtcggattcgcacaggcatcaggtaaaacgcaagcattggctattttcattattgacttggcgtattttgttgccatcatccgttataaaccatatttggaccgtccaacgaatattgtcaacatttttatttgcactgtcaccttggtcaactctttccttttcatgtttttctcaaacttgtttaaccaaaagtatgctgtctctgccatcatgggctgggtgtttttcattatgaatgctgcgttttctttgcttctactgttgatgattctggcctttaccacaatcattctgttttctaagaatcctgactccaggttcaagccagcaaaggatgacagagcatctttccaaaagcatgctattcctcatgaaggtgccttgaataagtcagtggccaacgaattaatggccctaggtaatgtggcaaaggatcataccgaaaattgggaatacgaactgaagagtcaagaaggtaaaagtgaagataatcttttcggagttgaatacgatgacgagaaaacaggaactaattcagagaatgctgaaagtagcagtaaggaaaccacccgtccaaccttttctgaaaaggttttacgttcattatcaatcaaaaggaataagagtaaactgggcagtttcaagcgcagcgctccggataagataacacaacaagaggtttctcctgaccgcgccagctcttcgcctaacagcaagtcataccccggtgtctcgcacaccaggcaagaatctgaagcgaataatgggctaatcaatgcatatgaagatgagcaattcagtctgatggaaccaagcatactggaagacgctgctagttccacccaaatgcatgctatgccagcccgagatttgagcttgagcagtgttgcaaacgcccaagatgttactaaaaaagcaaacatcctggatcctgattatttgtaagctttgtcgatgggataaaggtaaaaagaacaacgtaattaaatcattacgaaaactctactgcattattttttagtctttttatagagacatgaacattcaattactttcaaggataaatattctaatattcatattattcacttatgtatttttaacgaaactctactccattctactgggatcgggcatactttacggggtgcacggattttagcagtctttttctttcttggcttttgcgagatgccttgagaggaagatttttttttcactcaaaacctctgtcttgtacatatctagaacatgtttcattgatattggacgttactatttcaatttaacagtcaaccagtcgtccaaaaatgtccaagatcacttcttctcaagtcagagaacacgtcaaggaattgttgaagtattccaacgaaaccaagaagagaaacttcttggaaaccgtcgaactacaagtcggtttgaagaactatgaccctcaaagagacaagcgtttctctggttctttgaagttgccaaattgtccaagaccaaacatgtccatctgtatcttcggtgatgctttcgatgttgacagagctaagtcttgcggtgttgacgctatgtccgtcgatgacttgaagaagttgaacaagaacaagaagttaatcaagaagttgtctaagaagtacaacgctttcattgcttctgaagttttgatcaagcaagttccaagactattgggtcctcaattgtccaaggctggtaagttcccaaccccagtttctcacaacgatgacttgtacggtaaggtcactgatgtcagatctaccatcaagttccaattgaagaaggtcttgtgtttggctgttgccgttggtaacgttgaaatggaagaagacgttttggttaaccaaatcttgatgtctgttaacttctttgtttctttgttgaagaagaactggcaaaatgttggttccttggttgttaagtcctccatgggtccagctttcagattgtactaagcataattacgtgttttcatagtttaacgctttcagaactacttatttaattttgtaagaagtaatttgagtcacatttgtatttagtaaaagattaagagtatttctatttcaccgccttgataggaaagagcggcgcggaagggcagctgtagggaattttgctctgtattcccctgtttaatatcaaaaacaacagagaaggatccccgatgagaaagacgctcgggaggtctctgtgtttgctaggcaattgacatatttaaaagattttgtttgaggttttgcagataaacaagaagcagtatggctaatgatcaagatcccaacaagtctctcattaatgacgctttgactcggagtatgtccgaattttatgatgatgatgatgataacgacagtgacatgtgtagggcaaatgatgagggagaagacgtttttgaccttccacttaaggtaggcgtttctcaaagcaggaacttttcagaagtaaatgacgtgttagacccgctttctagtttgcatggtccgtccaagaaggtgagatttgaacagcaaaagcagcaacagcaacatcagcaacttcacaatgacttcaatacagatttcaacctgaaaagcccgtccagtaaaaaaatgggggtagaacagctgatccagtcagccaatgaaatcaacgattacctcgctaacaacattgacaaggtaaatagctttaactcagagctattgagcggcagtggcaagttacctgggagagtaaagagtgacacagcaactcaaggtaccggacgcttagattccatgtccaactttgctcttagcgatacggagttggacaatgatgacgataattatctcctggatccccttgcaaatgctagctctactacacccactgtggaacaccacggttacagcttattagacaaggctttatccacgtctgataaggaaaaaatatatacgaataaagtgaattcgaatagtcagatagatactgataatcactctcacgaaagtggaaacactaccaataacgaaacagatgaaaatgagagttcggagatcctggactacacaaaatttgattctttcccctatcccccgtcttctgcccccaatggggaaccaccagatttgaaagtgctaagcattgaatgtgagcaggaaaatgaaaaagagctacgacgaatatctttattattggatcattacgaatcaataccgaaaataccagaattgtcagacgatgaagcactatctaagttccgtgagaatatcgaattaattttacaactatctaagaaaattaacgataatgcgaacactttagcgatttcctccgaagatcctcaaaaatttgttaattttgtgatgaagaacccaccttccttatcattcagagattttatcgacagaatccagaataaatgcatgtttggtgccgtagtctatcttggagccacctatctacttcaacttgtgtttcttacgagagacgaaatggacggtcccataaagttgaaggctaaattacaggaggaccaagcccataggatcatcatatctacaataagaattgccaccaagctattagaagactttgtccactcacaaaactacatttgcaaagtcttcggtatttcaaaaagactgctgaccaaactggaaatttctttcatggcgagtgttaatttcgatggattaatgattacttgtgaaaaattagaaaaaacattgcatatccttgatgatacaagacaggcattaggaaacacatgagttttgcatatgtattatgcaggttcatttgttccttcccttatttcttttcatagtatttatttttatttatttatttatttttttttggattttattttatttcttttttaatgctaagaaagtaattccgcataattaaacgtgtgctggcctcgataggtacctatagtatacagaagcttacgaaaagctcctgcaggatggcacttctaaaattcgcgctcaacatggccgtattgtacattatatcgttctatcattatatcgtatacgcccgcattacccgacaactccgtctgcaacgcgttgaccagaaaactcgaacaagagatcgcataaaaaaccaaaaggaaacgaattacttgtcaaatagttattgtaatggatcctctagaaaggcaaacagtagatttatttccttcttttctagaaacatcattataactaacaatatataattggaataatggctggttgggatatttttggttggtgtatgttatcaccctgttcacgtttttcggatacttagttttattcaatgtggtaaacattgaatgttttcagcttaagatctatttttttttttctagaagaaattgcgtcctttactaactttattttactgtacagtcagagatgtgttggcttcccttggtctgtggaacaaacatggtaaactacttttcttgggtttggataatgccggtaagaccacattgctacatatgttaaagaacgatagattggcaaccttacaaccaacatggcatccaacttctgaagaactggctattggtaacattaagtttacaactttcgatttgggtggtcatattcaagctcgtcgtttatggaaggattatttcccagaagttaatggtatcgtctttttagtcgatgctgctgaccctgaaagatttgatgaagcacgtgtcgaattagatgctttattcaacattgccgaattgaaggacgttccttttgtaattcttggtaacaagatcgatgctccaaacgccgtttctgaagcggagctacgttctgctttaggattattgaataccactggctctcaaagaattgaaggtcaaagaccagttgaagttttcatgtgttccgttgttatgagaaatggttatttagaggcgttccaatggttatctcaatatatttaattgacgtatacatctataccctttatatgacattcacatgaattcaacagctttgtaataatcaacaaaattgcataggatgccacctcataacttttgagcacagcatttccgcgatcatagtatattttagactctaagattgaataaaagtatgatacatcttaagtatacatatatatatgtatatatatatatatacatgaaagtttacctcctcatcttacgtggacgagattcatcgtcaccgcccatagttgttcttttaccattctgggcgaagtattctttctttttctccttatccctttgtgatttttcttcctccatcttagctaattttttcaatctttccttacgttgactagccttctgttccttcctcttgctgtctttggctttcgaaatcgtcaatactttttgaatgaatgatcttgccttcttttcatcaccacctagcaccacggctcttttagccatatatgttttcttcttttgtggtttcatttgatggatctgagatttgaatggcaattccttttgaacagcttttgggacctttagaccattgaagtgtctttctacacgttctattttatgatatgcactgtccggattcgacggtgtttccaggttcatagccgctcttatttggcctgtcaatcttaaacctttccactcggttttttccttcaacaatagtgaggtaacaggattatagaatttcttgacgcggacaggataccatgatcttagaattacaatatcactcattaggattttatcctcaaaggctgccctatagtgaccctcaggctttgaaagtgcccttttgatttcaccacggatacccgagacagttttgatctgcgcaccctcaaaccttgcaacttccatagcacttgaaaacatgtcctttataaaggcagtatttttgaaaattttatatggaaacccaactaattttaactttttaacaatttcaatattaacgtctatctcttcaacgatacctgttgctgcaattctaaaaccgttcccggtatcactattagcaacaatttgaacaccacaaaaaggtgtgtttggagaacataagggaccgtagaaagccgcattacaatatgtgtgttctggtgtatactttagcattctggttcttgttctagagtcagttgttgtataaattggtaaagtttggaaccttctccaacccaaagacaagaccagtgggtcatttgtcttcaaaatcttcttatgccaacgatgtcttctcaacctggctttgacaataccgaactttatttcggtcggcaataaaccacccataacaattggaaattttggattgaaattcttgacaaattccattgggactttttcgaaaacgatacgtacataagaaccagctttgaaaccttcgattctttgacgttgttctggagtcatttcttgatattctatattgttaatttctaactgtttagatatcttggccttctgtagttcataccatgtatcatattcattgttttcatcatcttctttaaagttttcaccttcttctatctcgaattgtgcacgtagtttttccttctttgcagcattcatttctctttcttgctccatggttaagtcctttttttcctccgcatcaaaattagtgaatgaattatcatcatctccattagtgtcttcgttttcatcctcatcctcactttctttgtcactattgtcttctgcttgttcagaagggtttccatcttctagatcttcaaaatcgccgtatagttcttccccaccttcattagagtcacttttcgttttattatcattacctaaaatgcctgcgccgaggaatcgctctttgattgcatcaacgcttttccattttttagccaatttttcgaaagtgtcgaaatatggaacaaacttttccaaatcaactgcatggtctttattgccctcttttgtaacagtaccatcttttttcctgaagaagtcatcatcaacatcttcttcaatgtcactttcgtctttactatcgtcgtcctcgcccctccaccttcttatacattcttcaggtgaaatgttgtccatgtatatcagcttaccgatattccaggtccttttcttactttcagttttcttcagcttgtttgccgctgttctttcccaggaaaactcatcttcactctcttcaaattcagaatctgtttccaaagctaatttttcggcaccctgctcaccggtattattgaaatcgatttcaaccatccttggttcggagtcctgcacgtcgtcatcatttgtataaggttcttcatcactcggtaaattatcaatatctgcgtcttcttcttgaactggcttaccataaattcttggttttcttaaactggttcttcccttgctctttccttcatcgtcctcaatactttcttctccactttcaacatccatgccttcatgatcggcaacttcatgaagctcagtgccgttgctaaacaattgcaaacccacaccatcaaatttctctgcaatactttgttcaacactttgtaaacccgtcatgagtttttctccttcacctctttcttggccgggaacaaaacttggctcttcatttttctttccaatatcaatataaacagcatccttatccatcaacacacctccgacatcggacattggagcatatatcaatttatctttatcatctaaccttttacgtcttcttgtcgtagaggcagttgtaatttctccgttagcctttgcctcttctttcattttttcacgttcaaaatcatccagtttctgttggtaaaaaggtgtgggacatggatctggtaatttttcaatttgtgctactgagaaatcaccaacaccagcaatatgcaccctagtgcccggagcagaaggcaaaggagtaccgtgcaaataaccatagatagcgactttgcggtcgatttgcagtccttgagtctctattaattccggatgagttaaatctgtgaatctgtcagccaacatatagggatgttcgttcctccattttaatggtctgaatttcataacagatataaatcgtgaaaggtttaaaatctctctatcaggataccttccattaatcacaccagataggtaaaataattttgcaccttgataaacttccgtccagaatctgtgctttaatcttttcttagaagctctcaaagttgactgagatttaaacagatcaagatgtgtagctacaccaagtactcttggcataccgtgatgttgagcaatatttaagaattccattgtttccatttcaaaaccgaaattaccgtcaattagtaaaagaaccaagtcggcaatcttagcaatatcaatcatcgcattcagatcgtccgcagggcactccaaaaaagttagtcttctatgtttaccagagacaacagtaataggaccttgaatatcattcaaagtgctttttgtcattctcctgacgagggaccgaatcaaagtagtctttcctgttccaggtggacccacgacagcgacgataaatggaggcggatcatcttcaggggtacgatcaaccataggaacatgcagttttctttcgttcacatcacttgacctttgcatagttctcgccatcttacctggggctgccacggcaaaggcctttgcattatgaccctgcgtatggagcttcttttttgctgtattcttctccttcgccttacggtgctgtttattagactgctccatcgtttcagataactcagatggctgattaaaggctactattatgtgatatttttaccttaacagcgcaaatactttccttaattttgaagcttcacttcagctcatcgccttgaaaatttttcatttgtacggacattaaacttaggcgataacaaaaaaaaaacttcatctagataatctcaactttgaaattacagaaatatttacaacagtagtacgagtatctgcactatggctcacatgtccttaaaataatctaagcttacctatctgatatttgttttgatattgtttaggaccagcagtttctgagagtttagcaaatgcacctttacagctatcctcaacttttggaagagaaagtgacaagatatgtaacaatacttgcatgaatcgacatttgtttactttggtccattttgtatatgatagtgtgatttagcgatatggaattatgtgtatttttctatttgttgtcatttcaatatgggatgacttgttttcttgtaacgcgccacttcaatagtaaacattatgaacctgataaatgttagcagacttagtaagagagacaatcattttcattcagtaaaaatcgcaatccctagtttggctcttcttctagccgtactttaaattcaaagcaaaaatggttctgcttaacagaaggaaaatacaacctaaggaaataggacagtctgctgattccttctctgaaactccatgggtgattaaagaaagtagcgagcgtataaatgattatgacagtgatttaaaaaagctagatttttacaaaagggatatattcacctgtgagattagtggaaaagatggcctttcgtatttcaaggcgttaaaaagcgaagaacagcaccgtgaaaaggtcagatatcttttaccaaaagaactaaggaaggctatagcaaatttcgcaaacttcagtccgataaggaaggtaggacaccttgtagaaagcgcatttcagcgttttagtaaccgtttctttataggcgatacggtgtgcttgaaaactatccaaaaaaatgcattgattacctataaagaaggagagcctaacttggtagaatcaccaactattgaaaacaatgtcacgttgttccttgtcaaggatgtgtttcaatctaacgggatgatggaaagtgaaaagggagaaatttctgccccaaaattgtcactgtatttaatcacagaatgcctgaatcgagaatctaaaggtgcggccctaattgtaggccagaatgaaattaaaaggccagaatcacacttttctaaattcataattgcgtgttttcttaatgaaatactcataaaagtatcgaataaggagcacgcaccatggagggtgaaacaagaatatatagaaagatatgatgtaaaccctaaatgctctcctaatatgattgattatttgccggatagaatgaactcatcttcttccgagctttacactcctcttactataccaccagagagcgatgttgaacctgctgactggaaggaaacgtcggaaacgtcggaaacgtcggaaacgtcactatctaaaataaaagcaattgacgacgagatttcagtctcatttgaccacatttacgataatgtgaactcccttgcctacaatgatttgaagggaaccgtcgacgacaaggagcttccattcactgggccttcgataccatttgaaaatatcagctacttagatagctccttagaatataagaatatcgatcaaaaatggttcaaagagtgcagtcaatttccaacggaacgactattggttgtttatcaattcctgagcttttttggacgttttattggtctatcacattttaattttgatcagttccttactactatcaagtgtactagtccggaggctttagtagatgaatatgtcaaaataaactttcttaaaacttacaacagcaaagggagtttcacaaatgagaagccaagaaacgaaatatataatcaagtgaccagtagtaacgtatcccagcgtgagaaggctaacgtctttaatgcagatgagagtcaacgaatacctagcaatttcaccagaaaccagaaaatgaggaaatttataacggataaaagtactgaatttgtaatgtattccatttttaaagggaagcctctaaaaaatgacgatatggagtttcaatcgtacgaaaaagtgaatatactttacattgatatagtttgctcgttaatgtgtctgatgacggataatgaacctgattggaattgtaatctgatggacaattggactgaagaaaagcgaaaggaggaaggaaataaaacagaaattgatatagctatagaaaagtgtttgaactatggagatactagctgggttaaacttttgcacaataaaaactttagcaacggcaattggttgatctgtctccttggaatcttgcaacagaatacacatatgatagcatatagtgatgtcgcaaaatgtatcacaaaaaaaatactacctttatccatgaattttgtaaatttaggtgatgagctctgggataactttcgcaagagattatctataaaagataaaattgatgttttatgggttctcgtagattttgcgtccaatttctcgagttatattaaggagttggtagataaagtaccaaaactgtgcaatggaatccgcttaaagttggatagtgcaaaaaaagagtatatcaaattgaaacggcaactaaaaacgttaaccaaaaatcgcgtgaagcttcacagcaacgtttcaatgaaccgatatggatcagatgaatgtaaaggtaaggtcaatgcccttaaagtgaaaattgcatacttaatggaagatatcgccttcctagaggcaaaattgattcagagcgatatcaagagactagagattttgggtaaagatagaaatggaaatcgatattattggatggactcaaatggatcgtcatcagccatcagtgaaaaaaatgaggaactttacaactgctgttttttgtgggttcaaggaccctctgaagcggatataaacttttgcttagatgtcgacgtcgaatctttgaaaaaatgggagttgttagctaaagcaaaaggtactgcctacgcgacaaaagaagtcttttcaatatttaggtcgacagacgggtcttactatcaaattgctcaaggtgagaatttcatgataattaattcaaacggtatcttaatgaggccaactattccggcattcatagacaaaaaaattatatcagaaactccagaaaagctcctactctctcatcatcaatgggctttcttcaacgatatagaagatatacatatgttagtagataggttggatgatttaagagaaaatgagggacaattgaagaaagctttgacatccaaaatggaccgtattgaagtatcatacaagcaacagttcaaaattaaaaggcgtattgaatgtgatgaaaccttcaaaaaaaatcacaaacttttgaaaaataacgagttcacgtttcctgaactgaaaagaattgagacaacttgtacatccaacggccaacatttttccaacatggagaaaatttccaaaaaactatcaaggacaaagaatgatctcgttttggaagcgattttaaaagacgtagctcaccttggagaatgtgaaagagcacttctcaaaaagcaacaaaatttgatttatcctttgaattttcatttcgaacaattgaggacgatagacctcgaatttatagttgaaacgaaaagaaaaaggcaagaggatattcttacgaagcttttaaatcatcagaggtataagcatattagtcatgtttcaggctatgggataagttctcaacgagtagataaagctgcacatcttgatgtgcagggtatattagaggagattgaatgtcaacttatttcaagacgacgagaggatgaagaacgcaactagaaacaactctgcagttcaaatcactcttcctgtatacgccttagaaagatattagaaatatcttttactatttaatcttcaccattcattattcctcgtatataaattggcccatttcagggcgtctgactggagttgtatttaggctttacccggcgttcttctgaatttatagccagcaaggaaaacaacgtcaaaattggtcctcgactgacgcattagtaagattaatatttagcaaacactatgatctccgtaacaatctcttcagctattccaacacttgatgatgtcagtcaatagatttacttcaggtcgactccctgttttccttagaaagtcccctttttactactcgagagcttatttgcatcaaacatgtgttttcaagcaaaataaagaaactgcacaagattcgccagagcttttagcaaaaagctcacatctgaattcgaaaccactagatgtaagcaataaagcaccagtgaaaactgctcagaataaaattcctctagctcatagtaaatatgaatcgtcaaagtacgaacttcccaaatggaaagaagccttgggtgaactagtaattcgagcatttcatttagatatggatagagtgagggcagggcccgttgcaggatcttactattataaaatttgtaaagagcaaggtttacaatacgaggacgagccattatcagaaactgctaaatacttttacgaggatttgaagctaccacgtactttttcacaatggtttcaaatcactgtattgcacgagtggatactttttgtacgtatgagagccatgcctttcaaatacggcagaaactatcagcagaaattggtagatagaacattttctgacattgagctgagattattcgaggaaatgaaagttaattctggtagaatcgcagatcaatatttgaaagatttcaatacgcaattaagaggagcgatatttgcatatgatgaaggatttgctacagatgatggtacacttgcgacagctgtctggagaaatctttttggtggaagaaagaacattgatatggttcatttagagtctgttgtgagatacatttattctcaactatatgttctaagcaggttatcagacagagagtttgccacaggtaaattcaagtttgttcctcctggggtgaaggtcgaaaaactgacaccaaagcaagaggaagagttgaaggccaagaccattgcaaaatatgaagctctagacaaggatcctaaaaccttaccaagcgagagaagtaggctgtcatatacaaactaaacgagctagtttgtaacttcaaaacttatgaaaacacttatttattcttcagatactatccgcacaaattccttaagttttttccaattttttgggctttcttccttatttaatcagtttataaaatcattacgttgtaaatagtttatttgaatttcttcaaagaagcggaccacttttctggtttattttcatggaataattgatataatgcgtcaatcaattcgacatggaatgaaccacttccttgacaacgggtggaagccaacttaccagctgatttgtataataggacagcaccaaccacagcatcaaacagttttccagtggaatctaacccaccgataaaggaagcaattgtagaaccaagtgaacatccacttgcagtgatgtcacccatgataggaattgggccatcttcaattattacacatggaagatcttcagcggttattccttctgttcctgatgaaagtttgtattcgcctccaaaagtaccatcagcaacgcaatcaaactcacccgtgcaaacagcaacagtcctgtattggaatgccacaatttgtgtagcgcgcacaagtgtgtcgatgttcgttttgccgctgctagagtcgacgcccttcattttatggttatttaacttggctagagacagtatttcactgcaattgccctttatacaagcaaattggccgtaagtgagcaaagtgttgtttagacagagccttgtttcagtggcgctgtacccgaccgggtcaaaggtgatgggtctatttacttcattataagcattaattgcggcttttagcatttcaataggtgccactgatccggtatttaacagtaaagaagcatttgggattcttgctagttcagatacttcactttcaatttcagacatgataggagatgagcctaaagctagagtgacattggcaccaaaattttgatgaaccttattggtgatatgttgcactaatggacgattgtttgatacttgagatataacgttttgaattgaagttgtggtcggaaatgtattatttaactcgcactcaacaaattggtatctggtagcatctaacaagcctctcaacctcttggttgctgcacatgcatctggagcggccataatatcgctgactagagagataccatccaacgatctctttccatttgaagcaacacattgacaaagcacacgttgaatattgtcaggatgaagaccaccaataccaacggttctacaccatgtagctttaaattcctccaaagcatccaaaatggcaatggcgccttgaggacccatgggtgatttcttaggatttttctttgttgatgtagggaaaagagtaccaacaccaatataatctaccatatctggcccccatttagccaatgtctctacctccgaaggtttaccaacactccatccaagaattttagaagggcccaaaagttttcttaccattgggattggcatatcgtcctggcccacatgaaccccatcggcgtcaattgccatagcgacgtctatacggtcattgataataagtggaacattgtacttcttacatattttttgaacttctaaagcctctgcaacgaaattttttgtttcaatatccttttcacggatttgaactagcgttacaccatttttcaacccagcttcaacctgagaacataaagtagttcccggtggaagcatggtagaatctgtaaccagatataatgagtaatcaacttcttccttagtaaataccatttccgctgtttgatttaaataatttagcttcagagtgatttggtcttgagaaccatggttagatcgaaaactaggcgcttccacaagtaaatggatgcgttgccgctataaatatatgtagtattgattttgttacacctgctaaataggttcttacgattgcctttttcctataatatgcataaattatgttgccctaaaagagtgaaataaaccttatctatcttttttttgttcctggttttcaaagttgattttcgacagaccctagttaattataggaaaaagccctattagtctttttcttatcatagatgacatttacttatattaggccaatcgcatactctgcatccaacaagccttcaacaggtcgaagtgaaactacaggacttggaaaatatcagtttttataagcaataatgaagttcacccctagcatagttattgatgctccgcaatattatgttgatcattttaatggcaagtataacgtggataaatgtgttattttaagagacctgcagctagaaacggattcagaatccatgccatccagcttaaagcatttgaccaaacctacgcacatcttggatttgacaaacaatgaccttatcatgattccagatctatcaagaagagacgatatacatacattactgttgggccgaaacaatatcgttgaagtagacggtcgcctattgcctatgaatgtacagaaccttacattatcgaataacagcataagaaggtttgaagatcttcaaaggttgcgtagagcgcccaggacgttgaagaatctaactttaatagggaatcaagtatgtcatttagccaattatagagaacatgtacttcgattagtaccgcatttagagactttagactttcaaaacgtaacagctgaggaaagaaagagcgcaatgagctttccaaggcaggcggacggcgatacgttgggcccagtaaatactgcaataagagataatggatccagagataaaacgatggagatcatgaatttggtggtgagtaagatgacagtagagagaagaaatgaattgaaaaagcagttagcagaagctacttctttagaagagattgccaggctggaaaaactactctctggtggtgtttaatcttttggttagtgcgactgttcaatgacttaaaaaaaaagaattataaattattctgtgccattatataataatatataaaacgaaaacaaataatggtgctctataaacattagaggacaatgtcaatttcaatgtcaatgccttagaaattaaagttggtaagaaagaaggaaagggcaacctaattagctgccgcttccggttgtacttcaggttcgttgctctgagtggtgctggatatttcagcctttttactagcagcttcctcctcttccattctttttctttgcttaatcttcttattgctctcgggcgcatcagtaagacctgggatacccttagctgtcaagaattcgaagatactcttttgcacagcaggtcccgatttatcggcagtttcttctccctgtgctccagtaaccttgttgaaactatcaatataactaaagaacgcattaaaaacattttcgtccacctcttccttgtagatcttatcgtagatatgcttcattttgaacttatccacttcgtcttgatatttggaaaaatcgatcgccttgtaaccaaactgttctagtcttttattataaccttcaaatactggagcttctaacaataatcctaatgcaggtgccttcggaatattaatcttctgctgtccgtaagcctgactaatgcgttcgacggggcaaccacaacgggtaattaaggttgccattgataccatcttacgaatttgatgtagcatgaaagactggccgtgaatcttgatggaaatccattctgtttgggcatcgccaataacaaatggatcagatacttttatatctttcataaatcgaatggcacttggttctttgaagtccttgcctaatgtaaaattatggaagttatgagcgccaaggtattgacttgtagaagcacggaatttggccagttttgccgcggatatacgatatcttctacggtgagcattttctaattgcttgtacttttttaccttctggtatagttcttcatttatatcaaattcatctcttgcgggcggaacatatgctaatatagcttcgatttcttctgttgaaaatttttcattcgcatcttttttaaactcttcccaaaattctttggattccaaatcttcatctaatacaccaggtaattctgttttactttcttcgatgtctctataaagtatagaaccaggtttggggccaatgagtgaataagttggtaataagtattcgtaccaacgtgaactgcacatttttctacaatcaaacgccttgttcacacgctcgatatcccatacccttatcccttccggtaacttttcgttgatcttctgcttgatatcaggatcttcaataatcattttcaatgatattaaattacctccagcatggacacccttatcagttcttgcagctctcatgaatccattctttttcaaatcgttggagttgtccttggaaatagcacctgcttcaacaaatgctttgaatagggcagactcgatggttggatttggtggattatattgcataccatggtagccagtaccacagtaaccaaccataacagccacctttctctttgggagacgaggctccttgggaagtggattgccattttcatccaaacgaggaccgctttttggtcttttatctatgtgtttgtcattatccttttttttgtccttttcatcgtcgaagtctgccttacgagctttggtcaatttgctctgagcgcctctcttgtagacatcctcattaacttgatcgtcataggcaggcctcaaattctcttcagacatccttgatatcacttataattgttatttactagcactttattgtcctttattatttttttagtacttcttgtatttcaaatttctcgaactatagcgatgactaaaagtgaaaaatttcaaagccaaaagaaaaaaaaaaaaagaaaatattatttcagcggctaatagttacccgcatcaaaataatatatctctgtacggtaatgaaaatttttgaaatatgcgatgagcttagaactaaagtaagcaatgtattattgaggtaattgacggtttagtgattggatcgtattctagatttccgagtagtagaaccattgagggaaactatagttaggtgcaataatgagacagctaacagaagaagagaccaaggttgttttcgaaaaactcgccggctatattggtagaaatatttcttttttagtggataataaagaacttcctcatgtcttcagattacaaaaggatagagtatattacgtacccgatcatgttgcaaaattggctactagtgtagcaagacctaacttgatgtctctgggtatttgtttaggtaaattcacgaaaactggaaaattcaggttacatattacttctttgacagtattggctaagcatgccaaatataagatatggattaaacctaatggggagatgccattcttatacggtaatcatgtgttaaaggcacatgtgggtaaaatgtctgatgatataccagaacacgccggtgttattgtgtttgcaatgaatgatgtgccattagggttcggtgtcagtgcgaaaagtacttctgagtcaagaaacatgcaacccactggtatagttgctttcagacaagcagatattggtgagtatttgagagatgaagacaccttgtttacttagtgggaaggactgatgatgaattcccgtgtacatttcacttacagcttgcgttatctctcacaatgtatttttttctgtataataaagaatcatataattagcgcttaaaaggaaagagttgttcgataaaatggggagcctaacccctcgatgacctttcttttgaattagtcgagttccatttcatatacaatattacataacttgacaacatttgaggattactaatgacaaaaatctttatacgctctatttacggcccttcttcttgttcttaggctttttattaacagtgggcttccctttctttgatatgtcaagggcctgttctgattttttgttcatagcaccaccttgagtttgttttgcaccttgttgttttttctttggcctataagtagacctgtctcttaatggcagccacctttcaggatcaggtaatttggaggtgtcgcgaccttgtaaaaatttttcgaggcgtttaatctttcttttcttctttagctctaaaacttttctcttttgaactttgctaactgcggtgtttttacttctctttgctgacgattctaagggtttcacaccaagttgaattaatttatcaatatcaatatctctcactagatctataccttgtgctatatccaaagaatctgacgaaacaactctgtcaacaaggacatctgcatcgcctttactaaagtttgaaatctctctgagtaaagccttcgattctttagcattacccatggacaataattcaaacccgacgtgtttccaaaatggtatgttttcttggatttttccgctcaattggactctcacggagcctaattttttaagcagaacacttttggagttgtttcttcccttaatcttgtataattcaaataaaatgtaacacacgatggcttgtgaatcgttgaatttttcaaaggacgatttccagctttcatttaaaaataattctcctattctgatagcattttcccattccttctctattattagcaattggatagtcagtagtaatattccaatcgtacttccatctgttccacttaaaatggtttttgtagtgtggtggtaaagtttcttggcctgcgtcttgtagctttccaaagtaacattgtcaactaacttagagtatttatcgaacgttcttgataaaagggactcttgagagtgaattttgacattgttgaacaaacgcaggaaaagtacattgcgttgaatgtttgaccattgttcatgggtgaaggtttgtaaattaaaagtgtttagtttttctacgtttaattcccttaacagtaaattgaagtttgtattgtatttagagaaatcaacaaacgcatttaggttattttgacaaattaaagagaatggagaatcggctttcagttcctgcaataagccctttaagatttctttactttgtgcagttttccccaccatttgcaaaacaaatgataattgcaatttaatagtattaatatcgttttgatagccttcattcgtggctccttgaagcgctttttctaatagttcgatagccttgtcatatttacctacggatgccatgatgaatgattcattgaataataaatcgtaggaagattcatccataggagtaactaagggtgatctgttcattaactctgtcgcaacggatagcggaaccctttcgttacaagagagttcaatttgactatcctgatccttctcattgtgacttgctaaatgttgatatattttaaaagcttcttggtacagcccatttttataacaatattgagctctcacatgtaggatacctctaagtgactcgatatccttttttagtaccgtatcgagatcatctgtgataattgctgtgtacaatgtgttgaattcatctggcatattcaatttatagaaaatgtacaatttttctagcgcaaatttgcgaccgtacttgtcatctatatgtttgaatttttttaaataatgtaaagccttttgatacttgtcctgttggataacagctactaagcaacgtctaaatacatccgctggattctcacatccagaatccaatagtttcacgcaagtctgttcgacctgcgaatgctcgtcttgagacaattgaatgttcaattgagagagcaaattagttaaattatctttagccatttttttgctttctttcattactcttattattgatcagaaccaactcaacaaagtaaatctgctactttaatgcatagcaattttcagcttgttttcctcttttctttcgacaaaggcgaaagaaaagaggaaaaaatgaacaagaaaatttaatcaaatatcgcaatatacgatgccgaaaagagtaatgaaatattagaaatggatacttagtattatgtgatatgtgcgggagtgattaatagtgcccttcaaacgattctgtcatactttaattctataaccgcttattttcccaaaagggcttgtttcttagtatccaaggatgcatttttacgtctccaaggcgcattctatctttggggtcgtattttagtagtttaagtattaaatcttgcgcatcctgagaaatgttactgggcattttgatatccagtgctgctatccttttatatgtagtatctttcatttcttcttcgaacggaggggcaccggtcagtagttcaaacgccaggacgccaagagcccatgcatctatagtgtgatcatattcccttgactccaccatttctggagaaaggtagtcaattgtcccacagacagttttccttctattttctggcggatttattatactccatccgaagtccgttaacttaatgacattattgaaccctattagtatattttcaggtttaatatctctatgaataatattctttttatgcatataatctagggcattggcaatttgataaatataatctgatgctaaaatatcgttgaagggtccgtgtaacctcaatagtttatacatttccccattgactaagtattccattagcaggtacactcttttttcatcatgaaaatagccgtatgatttagttagattcggatgatttagcgatgtttgtatttctacctcccttctgaattgtttctgtaaattatactttattatttcttccttctccattactttcagtgcgcaaatatatcctgtactcctgtgccgaacgcaataaactttaccgaatttaccctttcctaatttcttccccagttcaaagtcatcgagtgatagggatttaaatttaggtagcttcttattttcgtgtatcattttggaagaagtcgctttccttataggtgatggaattttggagctttccatatccaaaaacttcttattgtttacaggtaatctgttcaatttttctcttacaggtgaaggtatttttgaattcgggtttctttgctgcggcgaatgggatattctccatggtttattgatcctggacgtatttggtcttgttgtggtctttttcgatggcgaattagcgtttagtttgatatttactaaactattgcgttgcattccctttttacttctttcttttgttgtatttcaaaatcccagttttttttgcgctaagaatgatcttgctttgtttatgcattcacttgagcaattgcatcagttggccttagctcaaggtttttatagaatggtaaacaaattaagcgctttacaggaaaaacgcgtgaagttaaacttactgttcaataagcaatgctgtatcggaaaatggagcacaaaggttatagatacaagagaagactatcatgtcatcagatgcgttaaaagcactacttcagtggggtgcgtcatttggtgtaatagtgccagaggaactcaagtttttatataccgatcttaagggcattatttgcgtatgtgaaaaagatatagacaatcccagcatcaagattcctcccgagattgtcatttcaaggaatctgcccatgaagttttttgggctaagtgaatccactaagaatatcaacggatggctgaagttgttcttcgcaaaaataaaatttgatagggataatgatactatcgtggacaatgttcgtgtgaatgataaatttaaaccttacttggatgcattgccttcccgcctaaattcgcccttggtctggaacccaagcgagttgaagcgtttatcatctacaaacatagggaattcgattcatgaaaagttcgaaggtatatttaaagagtggtttgaactggtcagttcttcagatatgtttgacttggaaagagtggcagatgatgtgcagaccttccataatctcgatgagttgacatatgaggctttgtatgagaagattttgaagataacagaacttcaaagaccaactatctggtattcttttcctgcatttttatggtcgcaccttatattcatttcaagagcattccctgaatatgtgctaaacagaaactgtcctgacaactctattgtactgcttcccatcgtcgatcttctaaatcatgactaccgttccaaagtcaaatggtatcctgaaaatgggtggttctgttatgaaaaaatcggtaccgcctcccaatcacgagaactatcaaataattatggcggtaagggaaatgaggagttactctctggatatggatttgttttagaagacaacatatttgactcagtggctttgaaagttaaattgccattagatgtggtatctacaattcttgaaacagaacctagtttgaagctgcccttactttcggattacaccacttatgcttttgaaaacaaagactgtgtccagcaagaaaagaaggctactcgtagtgctacagactacatcaatggggtgacttacttcattaacatacaaaatgaacaatgtttagaaccattactggatctttttacctacctttctaaggccgaagaggaggatctacacgatttgagagcccgtttgcagggtatacaaatgctacgaaatgcattgcagagcaaactcaacagcattactggaccacctgcaactgatgactcttatgcaattgatccttacagagtctattgtgctgacgtttatactaaaggtcaaaaacaaattttaaaagaggctttaacgaggttgaaaaaactagaaaaaacaatgctgtcagagaacaagcaccaattgctaaccatgagcaaaattcttaagaatgaccctgcttttgcagaaactgaattaccttcgctgttcagcaacgaagatggtgaagaggtcatctttgaatctacttatgatttattgatactttggattctactgaaaacgaaaaagaattcttaccccaccaaatatgaatgggttggacagcagtatactaatttcaagcaaactgcatatatttcagatgatgccaaggctttccatactgcatacttcgagaagcaagacgatgtggatttggccgaagtagatcatgcgattcagtttgtagtagacaattcctttaccagaacttcatctacaaccgaagagactattttagtacgtaagtagcttttccttatagaatgttagagtagagtacgtaattacatctgcacttatttaataaatgcacttactaacaaactgggttctcattggtcagaagtgtcccgggtatccgaatatggcttcgatgaaatttttcgccatggagctgcgatgcccgatatttgtgtataaaacatggaaatgagcttatatagtgactactctgcattttcgttatttctagagcagagcttaagttacccatagttatttctatagcttgccctatcatccatttgatcaacaatagggaataactgtaacagtaagtaaattatggatggttttcgtgtagctggtgcgttagtagttggtgcgttaaccgctgcatatttatattttggcggaaggttttcgatagcgctggtcattatagtaggttatggtatttattgcaatgaagccagcggtggtagtcaagatagtcaagagaagctcgatttgaacaaacaacagaaaaagccatgttgcagtgataagaagattgcggatggaggaaaaaaaactggcggatgttgttctgataagaagaacggtggtggtaaaggtggaggatgctgttcctcaaaaggtggaaagaaaggggggtgttgttcatctaaaggtggaaagaaaggaggatgttgttcctctaaaaagaatattggtgacaatgaaaatactgccactgaagttgagaaagccgtaaattaccctgttactgtggattttacagaagtttttaggaagcccactaagaaaaggtcgagtacccccaaggttttttcgaaaaatagctcgtctaactctagagtaggtaaaaaattaagtgtttcaaagaagataggtccagatggattgatcaagagcgcgttgactatttcgaatgaaacgcttttgagttcacagatctatgtgttatatagttccctgcaaggtgcagcttcgaaagctgcaaagagcgtttacgacaaactaaaggaattggatgaattgactaatgagccaaaacttttgaaccttgacgatctatccgatttcgatgactattttataaatgttcccgttgaaaatgcattgtatgtgcttgttttaccgtcttatgatatcgattgccctctagattatttcttacaaactcttgaagagaatgcgaatgattttagagtagatagtttcccattacgaaaattggttggctacacagttttggggcttggtgattcagaatcatggcctgaaaagttttgttatcaagccaaaagggccgatcactggatttctcgtttaggtggcaggagaattttccccttaggcaaagtttgtatgaaaacaggaggtagtgccaaaatcgatgagtggacatcattgttagcagagactttgaaagatgatgaaccaattatttatgagtatgatgaaaacgcagactctgaggaagatgaagaagaaggtaatggtagtgatgaattaggcgatgtagaagatattggtggtaagggtagtaatggaaagttttcaggcgcagatgaaatcaaacaaatggtggcgaaagacagtccaacgtacaagaacttgacaaagcaaggttacaaagttattggttcccattcaggcgttaagatctgccgatggactaagaatgaactacgtggtaaagggtcttgttataaaaaatcgctcttcaatatcgcgtccagtagatgcatggaattgactccttctttggcatgttcatccaaatgcgttttctgttggaggcatggtacaaatcccgtgtcaaaaaactggagatgggaagtagatgaaccagaatacattctagaaaatgctctgaagggacactattccatgatcaaacagatgagaggtgtgcccggtgttattgcagaaagatttgcgaaagcgtttgaagttcgtcattgtgccttgtctcttgtcggcgagcctattctttatcctcatatcaataaatttatccaattattacaccaaaagggcataactagtttccttgtgtgcaatgcccaacatccagaggccttgagaaatattgttaaagtaacacaattatatgtttctattgacgcacccaccaagacagagctgaaaaaagtggatagacctttgtacaaagatttctgggagagaatggtagaatgcttagagattttgaaaactgtacaaaaccatcaaaggacagttttcaggttaactttagtgaaaggtttcaatatgggtgatgtcagtgcatatgcagatctggtccaacgtggtttaccaggtttcattgaagttaaaggcgccacgtttagtggctcatctgatgggaatggtaatcctttgacaatgcagaatattccattttacgaggaatgtgtaaaatttgtgaaggcgtttaccacggaattacaaagacgtggattacattacgacttggctgccgaacatgcgcattccaactgtttattaattgcagacacgaaattcaaaattaatggagaatggcatacacatatcgattttgataaatttttcgtattgctaaactcgggcaaagacttcacgtacatggactatttagaaaagacacccgaatgggcattgtttggcaatggtgggtttgcaccagggaatacaagagtgtacagaaaagataagaaaaagcagaataaggaaaatcaagaaactacaacgagagagacgcctctccctcctattcctgcttaaaagatactggtatatattaagagtaatatcacgtatatatatatatatatatatatttattcgaaataaagagcagaacaattcaagtgttcaattagtatgaatggctattaacattatcgtttctttctttttttatgatttagtccaaaatatcactattcaaatctcgcggagagaaagggttcgaaaattttgttttataatatcatgattttgatacgaacataaatatatatagaagtaaaagagaaagtgttcagaataatattcacgtcaatgaatggatatcaaagaaaatgaatggttcgaaggaacaaaaaaatcacataagcaatagaccaaccgcacaacttaatatggacccatttggaatatagaagcgtgcaaaggatgttataaactttgataaaagcatggaatcttagcccatctacagatgccagactgggcgcaacaaactttttttcagcagtaggcttcttcgccacggtatgaccatcgcataactttcttgccttgatcggatcatccgtgatagcaccatggataggcaattcgcacagatatttgaaatctataggtttgttgacagtccataaatagaccttgatatcattcttcataagcacaggtagtaatctcaatctaaattggcttgtccacgaggagacaaaatggacgctgataccaaaaagtttatagtgaggatcattcagtgtcaaagagcgcttcacaaattgcgaggcgatatctaaagacagacttatcacaataactttgaaatccttcagaacaccagtttcaataccgaaatcgtaccaatccagcaaccaaagcccccacgtgatcctctcctgccaaaatttaagatcattcttaacctctaacatgataacaaaggtcttgatcatgatgattttctcgttggtaaatttgatgtccaacatcaatttagctcctggatggcacactgcccatgttagaatttccttcaatgtcatcattgctaaggaaccatcctctttgcagcgcaatcgcttaacctcctcccaagtcgactcgccaatcaccaagttcttatcccacatccgaccagtgtctgagtcatggtttaccaccaccataccatcgctggtcatttgtaaatccgtttctattacatcagcacctgctgcataagccttctcaaatgctagtagcgtattttcaggatatcttgctttaaaagctctgtggcccacaatttcaaccatcctcgtgtccttgttgttatcttacacttcttatttatcaataacactagtaacatcaacaacaccaattttatatctcccttaattgtatactaaaagatctaaaccaattcggtattgtcctcgatacggcatgcgtataaagagatataattaaaagaggttatagtcacgtgatgcagattacccgcaacagtaccacaaaatggataccatctaattgctataaaaggctcctatatacgaataactaccactggatcgacgattatttcgtggcaatcatataccactgtgaagagttactgcaactctcgctttgtttcaacgcttcttcccgtctgtgtatttactactaataggcagcccacgtttgaatttctttttttctggagaatttttggtgcaacgaggaaaaggagacgaagaaaaaaagttgaaacacgaccacatatatggaacgtggttgaaatacaaagagaagaaaggttcgacactcgaggaaagcatttggtggtgaaaacacatcttagtagcatctttaaacctctgttgggtacttagaaaaatatttccagacttcaaggataaaaaaagtcgaaaagttacgacatattcgaccaaaaaaaaaaaccaaaaagaaaagatatatttatagaaaggatacattaaaaagagatggacttaagagtaggaaggaaatttcgtattggcaggaagattgggagtggttcctttggtgacatttaccacggcacgaacttaattagtggtgaagaagtagccatcaagctggaatcgatcaggtccagacatcctcaattggactatgagtcccgcgtctacagatacttaagcggtggtgtgggaatcccgttcatcagatggtttggcagagagggtgaatataatgctatggtcatcgatcttctaggcccatctttggaagatttattcaactactgtcacagaaggttctcctttaagacggttatcatgctggctttgcaaatgttttgccgtattcagtatatacatggaaggtcgttcattcatagagatatcaaaccagacaactttttaatgggggtaggacgccgtggtagcaccgttcatgttattgatttcggtctatcaaagaaataccgagatttcaacacacatcgtcatattccttacagggagaacaagtccttgacaggtacagctcgttatgcaagtgtcaatacgcatcttggaatagagcaaagtagaagagatgacttagaatcactaggttatgtcttgatctatttttgtaagggttctttgccatggcagggtttgaaagcaaccaccaagaaacaaaagtatgatcgtatcatggaaaagaaattaaacgttagcgtggaaactctatgttcaggtttaccattagagtttcaagaatatatggcttactgtaagaatttgaaattcgatgagaagccagattatttgttcttggcaaggctgtttaaagatctgagtattaaactagagtatcacaacgaccacttgttcgattggacaatgttgcgttacacaaaggcgatggtggagaagcaaagggacctcctcatcgaaaaaggtgatttgaacgcaaatagcaatgcagcaagtgcaagtaacagcacagacaacaagtctgaaactttcaacaagattaaactgttagccatgaagaaattccccacccatttccactattacaagaatgaagacaaacataatccttcaccagaagagatcaaacaacaaactatcttgaataataatgcagcctcttctttaccagaggaattattgaacgcactagataaaggtatggaaaacttgagacaacagcagccgcagcagcaggtccaaagttcgcagccacaaccacagccccaacagctacagcagcaaccaaatggccaaagaccaaattattatcctgaaccgttactacagcagcaacaaagagattctcaggagcaacagcagcaagttccgatggctacaaccagggctactcagtatcccccacaaataaacagcaataattttaatactaatcaagcatctgtacctccacaaatgagatctaatccacaacagccgcctcaagataaaccagctggccagtcaatttggttgtaagcaacatatattgctcaaaacgcacaaaaataaacatatgtatatatagacatacacacacacatatatatatatatattattattattatttacatatacgtacacacaattccatatcgagttaatatatacaattctggccttcttacctaaaaagatgatagctaaaagaaccactttttttatgcatttttttcttcgggaaggaaattaagggggagcggagcacctcttggccaatttgttttttttttatgtaataaagggctaacgatcgaagatcaatcacgaatattggacggttttaaaggagggcctctgagaagacagcatcaattcgtattttcgataattaacttgccttatagtgtctgattaggaaacaatcacgagacgataacgacggaataccaaggaagtttgtgcaaatatacagccggcacaaacagcagcttcactcaggttaactcacatactgttgaaaattgtcggtatggaattcgttgcagaaagggctcagccagttggtcaaacaatccagcagcaaaatgttaatacttacgggcaaggcgtcctacaaccgcatcatgatttacagcagcgacaacaacaacaacagcagcgtcagcatcaacaactgctgacgtctcagttgccccagaaatctctcgtatccaaaggcaaatatacactacatgacttccagattatgagaacgcttggtactggatcttttggtagggttcatttggtgcgctctgttcacaatggtcggtattatgctataaaagttttaaagaaacaacaagttgtcaagatgaaacaggttgaacataccaatgacgaacgacgtatgctaaagcttgtggagcatccgtttctgattagaatgtggggtacgtttcaagatgctaggaatatctttatggtgatggattatatcgaaggtggtgaacttttctcgttactgagaaagtcacaaagatttcctaatcctgtagcaaaattttacgctgcggaagtcatactggcattagagtacttgcatgctcataatatcatctacagggatttaaagccagaaaatatcttgctggatagaaatggccacattaaaataaccgattttgggttcgccaaagaggtacaaactgtcacatggacgctttgtgggactcctgattacattgctcctgaagttattaccacaaagccatataataagtcggtggattggtggtctctaggtgttctaatctacgaaatgttagctggttatacacccttttacgatactactccaatgaagacgtatgaaaagattttacaaggtaaagtagtatatccaccatattttcatcccgacgtcgtggatctactaagcaaactgatcactgcagatttgacaagaagaatcggtaatttacaaagcggttccagggacatcaaagctcacccatggtttagtgaagttgtatgggaaagattgttagcaaaggatattgaaactccatacgagcctcctatcacatcaggtatcggtgacacgtctttattcgatcaatatcccgaggagcagctagattatggtattcaaggcgatgatccatatgctgaatactttcaagatttctaagttccatgaaccaaaaaacacaaaaacaattttcaagtactttctctcactccttttcctttctcttttttcctccaccaaaatctggcgcactttctttatattttacctaacggatgccttatttgtggtctgttttaagctagttcatattgtaaaaaaagaaaaagagatgagaagaacaagcgttgccctaaatatcttctatactacaattcattttaattcaatatcatatttaagttgagggcatttagatcttagagattcatctaaaaataggaggggtgatgtatagaaaatgttcgaatatcattcctctgcttttttctatatgattatttcctatatgagcttttacttactgatctcatgatctcagtgcaaaaattaggggaccggcacgcctgaaagttttttagataattgaatgttgcggtgcattacctatgaaaagatgaagcgcacgtgaaccatattataatcaacaaacttgaagaataaaacttttgagcgcatgaagccatgatatatcttatttgtatcgacatgctttaagtcctccgtagctttaaaaagtctaaggtccaaaatccctcgatggtgctgatatcaccattattcatgtccatcagatcttgtcacatatttaaacgtgataccgttttaatgagttgaaaactaaataattaatattttgatattaaggctgggtcaatagaatttaattcattaaaatgctcatcgttgaaatgaagcaacgcttcgtagttgtagtttaacatgccaaaattttcgtttctctctttgcctaagttcgtagcaatatctgtatcagcagttggtgcgttgcttttggtatctttggaaactttaatgatctcatctccataaggagcgtctgtttccataaaatttggtgaagatgttgttgattctgacagggctatatccattttgctttgtgacaagggcctcgttggtgttgaaggaagtatacaagaagaggacgaaggacctggtgtaggttctgtcaaaagttccatcaggccttggttgtaattttggatgaaattgtcgttgcaaaacatgttcgtaaaatcaatttcgtttaagttcgttaaagaatcttctttctctatctttacacaggaattccgcgttttgaaattgtctaaaaatccggtatcatgtagatccgcatccaacttcgttttcaaccttggcctaggtttcgaattatccatctgtctggattttattttagaaacggagtttttatttgttttgagcaaattttttttagacgtcaaaggggggtttgatagtgggagaaaaatgttattgaaagcttcaatttccttggttaacccacagtcacaagaaataattggtgtgacgagtggtaagtttagacttgctttatattctaattcatcaaatgttttgatggctttttcgtcgttcttctgacgaagattttccttaaactttttatagtcatccgttttagtaatcaaatcaaatctcagctcatgtgaatgtatgttattcataacaaccacgttccacttctgtaaccgcacagagtaggctgctctaattctaaatggacatgcatgggatcttgaagaggaacctttggatttagggttcaaccctactttcgatcgtactgacctacacttaaaagtaactttgctactatctgatctttcgatgactatatctattccttgaggatagaatattttctgtagccacggtttaatctcgtgcctgtcctcaaaagacggaactgggtctaaatgaataagtttattttggtctttagacatcatagatgctagattatcgggagatgctgttaacttcattttccctgttttagacactgatattggcacagatattatgctcttcatcgactttgctttcatttcttgggggtcgctttctcttgattaatttgcgccagagtttctggtcactacaacaaattttttgaatgagtcgtgttcactattatgtataggtccatcagtttaatttgcacagtttttgccttaatcaaaagaaaatcaattctgactaaaagaaagccactttaccgatctcggcccacgaaacgatttttttttttacggtgcttttttctttcttttttttgttctttctattttttccctttgcttttcgcacaataccgcttaccgtcaatcgaataatgaatggctctggtatcgttcaataaaatgagaaacgtgcttccagttcaaaaccaaacagctcagacaggttaaagtgaagaagttgagatatatacaaattaatgtcactgttattttttttatttacatttccttaacctttatttaagaagaattgtttgaatgttattgtcatcagtaagaattgtcagcactgggctatttacagagggacagttaccaacaaagagatctttgacactccttataccgtatttggccctaatgtctgagtagcccacgaacagccaccgtttgaaagatatagagtacttgtataccgataacgctgttccgtagagatgttgctcggttataaaaatatacttcccattgtttgctatctgacgtcctgttcctgaagcatggacatgaagttcttgtgtcttgtaaaatattggataaacctcgctgtctgagacgggtggagaagaatttgaattctctatggggtctcttgttggaatggacagatatctcatgttggtttcgagtaaaatgtgattcgttttaagaagatagtcgatcttttgaacgtcttcgtctattttaagcataaagtttatttccttgtttagcgtggaagcatccgatcctaatagattcttgcagtggaaaatcatatcatttcctttgtataaagtaaactgagggaaatttaaaacggacttgacatttgtggtcgtgcgtagatctacaggcaaatcaatgttggtatggaaactttgaaaacttccattgctttgttggtgatctaaagaagttattagcagcccatctttcaaactaaaagaaacaacgaaatgtggcaacaaacctgcccagacatttaatatagataggtggctttgatgagaggaagttgaaggatccttcaaaagcaagtgattgtttacgtttccgttcaagtcgcagtttagctttaacaactttccattctgaaatccaactaaaatttgaatggtgtttgaattataaccaaaattgcagtccatacatattattgcgtccgatagcagtaaattcaactgcccgtaaaattgctgcttaataaaaatcaaatgttggccgttaaagtcatacagcagtaattttttgtcctctgcttgattagaataaaaaatccagtacttgctattgaaatttctaaaacttttgaaactttgtaaatcgtgggtagtaaaatagttattaatccgtacaaattccaacccacggttacttcgaaaaacatcttcaagttccttttcttcgtcaccatcatcgtcttcttcagaatagtttccaacatctccaccatcctctccgacattgctaaaggtaagctggtcgatatgttcctttatcgtatctggaagctgtgggtaatcattattcaccgtgtagttgccatacttgctcgcccgttcgtcaaatacgttctgatatctcgtgtggtaaaattgcacccccttcccatcctggtatatttgcataggtatacccatgatttcgttatgattattttctttcttgagggtgtttagcaatacattattatccttgtgatttcgcttatacacatgtaggatttcctccttatatattacaagtgtgtcaccatttccggcccaccaatagccgccgacctccaaattaccccaaataaaaaaaaagaaaactccggaaatgcggggttgagctgcaatataataataatatggcaactttagccgcgcaatcgaagatacagtaaatatagtaaaaacgtgtctgcaaatggctactttcgatccttcttcccaaaaggcaatattgcagaagaagaactagaaaatgatggatggttccataacaaggaaggtaacatcaacgttgtccaaccaattggcgacctggaaatggaaactgcagttatcgttattggaaagaaaattagcgacaataaacaatgattattttctcctgcaatgggaactcctttttataactaatgaagtgatgaaatggaaagaaatgattgcctttttggaaagccagttattttgcacaacgcaaaatttcgtggcacaagagacacatgacagggaaacctttcaaagcctggtagatgattataacaaacagttgagcgaaaataacctgattatttctgtattgaaaagtagaccacagctatcatcatttcctatatatttgagcgatgaggtgtgttcacaccttaaattcgtcatcgcggaactaaattcattgataatagttttttttatttctttagtatttttgtgggtatcgatagaagtttaaactttcaataagtggctaatgatttcgcatttattactataaaaaaaatacagtcttaggattattctctatttatcctcacgccaaactttgtatacaattacaaaagattttgaatatactagtcaaagtactatctttgttgtcattgccactgttattataattctgagcttgaccttgaggctgtcctccattgttgttatattgaggatgtggttgtgcattgtactgattagtgggggcattcactgcggggccatccatctgcatttgcacaccttgcaactcaagcaccaagactcctgaatttcctttttccaaatggtttctgataccatgcttagcacagaactcctcaattgacggtttgagtttcgctataccgttttgagaatgcaacccttttccaacaataacgttcagttgtggttcattatgatcaatagcgaatttgattcttttttggagaataaatagggcctcttttacgtataatccatgtaagtcaatttcattactggaagaatcagcattgttctctacaaacacatattctgccgcttgcatgttaaaatcttcagcggttttcagttgtgccttacttttctcgcttagttcatgagctagcttcttgtcaccttgttgataagcggtttgcgattcatggctgagttggtctcttttcttatacgcttcatctgctaatcttctcaatctttgatactcttcatcagtgctatgattgtagtcccttacaggattctgagttccgactactactccacctgttcctttcatagttttaagtgcggcgctttagcttcaaactgactcatggttgcgtaaaaacatggttgctttttgtcgttttcctcgaaaggctttaccttttcattaagccgctccattttaaaatgttttaataaatccacttttttccggcgcataatggatccagaaaggaactggcaactaaatccgtacatttctgaaattatttcagttcgcagattattttctcagttttaccgtatattcttatgtattacagttgaggtacccacacgcgcacttgaaaagtatataaaagtgaaatatttcagagctcttcctattgctttttcaatagaggcttaaatcttcctcgtttgtagagtaagtagacccatattacaaatctccatcaacgtcataatgtccactgagtatgtcaaaaactacaaatacgaccttatttggtaactagtttgttgtcggttacatctgaatttgaagtacccaaattgataatacttcaggaaaagttaacgcacattcaaaacgtgtttttttacaataacctatggtgatcgaacctaattataaaaagaagcacttgaagtagtttatcttcttcaagtacctttcgtaggggattttcatttttaatgaacaaaggcattgtttgttagtatctattacttgtaatacaccgataatttcattgatagatatttccagcatgtctctgcatctcccttccatcgaatgaaaagtggtgttttcaattcgatgtaactgaatctttgttcttaatatgacttctttgctaacatttttttcatttttgaatagaaaaatcttgactcctgaatctcaattgaagaagactaaagctcaacaaaagactgcagaacaaattgctgcagagagagctgcccgtaaagccgtatgttcatttaccatgtttgaaagatattatatcattccttttacagtgagttcacaaaaatataatactttgttaaagagatcttttctcggttttacatttccttggcatttgttagtcgcgaacaattttcactttttgcaacgttttttttctttcttaatgatgaaaactattccttattctcgactagtctttgacaatgctgtcgtttaatcaccatctttcggctgactagtaaagaaaatgcaagagtgagaatatgccaagaatctgcaagattgagttaagttttcttagaaagttttatcgtgcatatttttcactaaattggaatgacgttaaaaccaaaagtactgatcttactaacattaatcaaaaattcttgatgaatattattttaggctaacaaggaaaaaagagctattattttggaaagaaacgccgcttaccaaaaggaatacgaaactgctgaaagaaacatcattcaagctaagcgtgatgccaaggctgctggttcctactacgtcgaagctcaacacaagttggtcttcgttgtcagaatcaagggtattaacaagattccacctaagccaagaaaggttctacaattgctaagattgacaagaatcaactctggtacattcgtcaaagttaccaaggctactttggaactattgaagttgattgaaccatacgttgcttacggttacccatcctactctactattagacaattggtctacaagagaggtttcggtaagatcaacaagcaaagagttccattgtccgacaatgctatcatcgaagccaacttgggtaagtatggtatcttgtccattgacgatttgattcacgaaatcatcactgttggtccacacttcaagcaagctaacaactttttgtggccattcaagttgtccaacccatctggtggttggggtgtcccaagaaagttcaagcatttcatccaaggtggttctttcggtaaccgtgaagaattcatcaataaattggttaaggctatgaactaacattattccgtgtggcaataatctcaatgtataataaataatatttctcttcatatatatgaccggactcgtaatagaataattgactggaacaatagcgcatattgctttgcttctatacgtagttgagttttcactcacgtacagctagagaatctcacataggagtatccctgtagttagttccgcgcggttcgatcacggatatactttcaacaatggcagtatgaaagcctgttataaaaaagaaggaaacaataaacgaagtgcttttttgcctcctaaattattcaatttgacaactgatttccagccattcattattcagtgaggagcgacaatgtttggagtcaaggatgctatattcaagattaaacgttccattgcaggcacagattcttctgattccactgcttacacaacggcaagtgaatcttcacctcaattaaaagattcccataacccctttcgaaataaaacgacatccgagagaactatagttgaggagggctctctaccaccggtgagattgaatggctacttgccctcaactaaaaataaacttcttactcctgaaatgtgcgatgaaataagaacattaatgcccacgaggatacagttgtacaccgaatggaaccttctatatagccttgagcaacatgggtcttcattacactccctgtatagtaacgttgctccagatagcaaggaatttagaagagtggggtatgtattagtaataaaggatcgtaaaaacggaatctttggagcttacagcaacgaagcttttcatcctaacgaacataggcaatacacaggaaacggggaatgttttctatggaagctggataaagtacctgatgttaatatatccgaaaaagaagaatctgagcaagaaggtaaagaaggtaaggaggaaggggataaagaggagagatggaggttttcaggttatccttacactggagttaacgaatttgctatatactgtacatctgaatttctttcaatgggtgcaggtgatggtcattatggtcttttatgcgatgacggcctactccatggtgtttcaaacccttgtcaaacatatggcaatgaagttttgagtaaggagggcaaaaaattttctatagtagctttggaagtatggcgtgtaggatagtgtcatctatttaaatatcatactatgtatttatgaatgagaacctcatgattgtaaacgagaaacactcctttaaatagcctaaaccgtatcctcagtaagaaaaactagaaaatacggtcctaatacttgcatgtgttttatgagtgacgaaataaataggaaaagaaaaatattttaatacaaactatcatttattgaaatgctctttttcattttcttcattaaatcattgtatgcaggctgggaaaaacaaccttgcaatctcccaatgtgaaaaaaaaaagaaaatgaagatacgaacatacctgaagtgggaaaggcagttgccacaaccagaagagcataacatattgtcatgacctctttatatgcacctggggcggaggatattcggcaaaggttacgtccttttgggtttttctttgagaaatcactaaaggatttgattaagggtattaggtctcacaacgaaacaccagaaaaactggatcaattctttaaacaagtattaagtgaatgccgggaagaagtgaactctccagatctaaattctaagaccaatgccgttcttaaattgacctatttagagatgtacggttttgacatggcttggtgcaactttcatatcttagaggttatgagcagtaataaacttcaacaaaaacgtgtggggtatttggctgcatcacaatctttttacaaagattctgacattttgatgcttgcaactaacttgttgaaaaaagacttaaagtatgacggaaacaatgatgttgttaaagttggcattgctttaagtggtctttccactataattacaccctcattagcaagagatatagctgatgatttgttcactatgctaaacagcacaagaccgtacataagaaagaaggccattaccgcactatttaaagtttttctgcaatatccagaggctttgagagataattttgataagtttgtttcaaagctagacgatgatgatatatctgtggtttctgccgctgtcagtgttatttgcgagctatcaaaaaaaaacccccaaccattcatccagctttcacctttattatacgagatattagttaccattgacaataactggataatcattagattattgaagttattcaccaacttatcacaagtggaaccgaaattgagagccaagttattgccgaaaattttagaactgatggagagtactgttgcaacttctgtgatctatgaatctgtcaactgtattgtcaaggggaatatgctagaagaagatgattttgaaacagcaatggcatgcctggaaagattgcacacattttgtgattctcaggatccaaatttgagatatattagctgcatattgttttacaagatcggcaaaatcaatactgattttatttctcggttcgaccaactgattatacgcttactctccgatgtcgacgtttctataagatcaaaagcaattgaattggttgaaggtattgttgatgaggataacttaaaggcaattgtccaaacattgatgaagcaatttgtagatgaagatgtggttatcctacaaactggaagcatcgtatacgaaaaatcaaagagaattcccataataattccagaaaattacaagataaaaatggtgaacgtcattatatcgatttgttcagctgacaactattccagtgttaacgactttgaatggtacaatgcagtaataatggacttggcgatgctctgtcaagacatatctgataaaagccttggatcaaaaattggtgaacagtttaggaatttgatgataaaagttccttcaatgagagaagtaaccattgctaatattataaagcttatttcaaatgacaatattaacaaacagttgcctaccgtattgagagaatgcatttggtgtctcggagaattttctaccctagttgaaaatggtaacgacttaataaaaatcatgactgagaatatcagttattattctcatagtgtacaagaagttttaattttagcacttgttaaagtatttagtaattggtgtaataactttcaggaggataaacgctttgaaattaaaatggtgttaaaagagctaattgaattttttgaaaatttatcttattcgagtacattcgaagtccaggaaagaagcgtagaagttttagaatttttaagactaagtttggaggctttagaggaggatacggaaggtctaccaatgctactgagcgaagtcctgcctagtttttttaacgcctatgaactcgcaccaattgcgcgtgggactcaattgaagttagcagtagatgagaatcttgatctagaaactccatttttgacaaaggaggcagctgatgaactcttagatgaacaaaaaagtgacgccatcagtgatttaatgtctgatatctcaatggacgagcaagttgaactaaaattcgttgatgattctgatacttcgtatgaagaaaaggaaaaattggatgattttgaaaatccatttgagattgagagagaaaaggaacggatgtcaaatccttattatctaggtgaagaagacgaagaaagaactaagaactctaaagatttgttggacttgaatgaggaggaaagtagtgataaaaagccagaaactattagattaaatagaaccgataattcgttgaattctctaagtttatctacaactgaaatcagcagaaagaagaagaagggaaagaagaaaaatagggttcaagtcttatccgatgaacctgttatcgaagccgctcccaaaaggaaagatgcattccagaaaccccatgataatcattcaactcaaaatcctttgaaaaaggacaagattaatctgagaatgcactctcaacttgaaaattttgatttttccaattttgggcaatcgagtaacgcaggaagaggatcgcaggaagagggcaaccttagaaaggaagacgagttagaattaagtcgtttagaggccaatcttattgtaaaagatgaaaaggataatttaagtgatactgaagaagttatagttataaaaaagaagaagaaagggaaaaagtcaaagtcaaaaaacaaactaaaaacgaaagcaaaaaattctccagaaccaaatgaatttcttcgagaccaaagcactgacatttaacgataaaaaaatcgaagtcgtgaattctcaatgacagcgattacgtacgtaaactataattaatttaagtattttattctgcatagtatattattgcggtgcactcaatttgccgaaagagacggcatatttaataatgacgcgaatgaatcaaaggccgccaaaggtaatcatagaccagagatgatttgcaaaattatttgacatactattgctagtgtaacaataacacagcataactttgcttagacatatatgtcatttaaggcaactatcaccgagtcggggaagcagaatatctggtttcgtgcgatatatgtgttatctacaattcaggatgatatcaagattacagtgacaacaaatgagttaattgcttggtcaatgaacgagacagatactactctttgtcaggttaggtttcagaaaagcttttttgaggagtatgagtttaaaccacatgagattgtatttggagaaaatggggttcaagttatagaagatacgtacggcaatagtcataagttatactccttccgtgttaatggaagacacctaacaactatatcaagaaagccggatggtgatggcatcaaatcattcacaattgcggtaaacaacacttctacctgtcctgaatcacttgcaaatagattgattgtggtgattgaaatggattcgttaatagtcaaagaatactgtccccaattccagccaataaaatacgatcccataataatcaaccttaagtacaaaaggaggtttttggatgtttttggaactgctgcctccgatcggaatccacaggagcccttggaccctaagctattggacgtttttacaaatacagagcgtgagctaacatcagccttatttaacgaagaagtggaatcagacatacgtaaaaggaatcagttaacggctgctgatgagattaattacatttgttgtaattcaactttattgaagaattttttagacaactgcaatgttaatgtaaccgatgaagtaaaattggaaattaacgtacataggctaagcataactgcattcaccaaggccgtctacggcaaaaataacgaccttttaagaaatgcgttaagcatgagtaacactatcagtacgctcgatcttgagcattattgcttatttacaacaatcgaagatgaaaaacaagataagcgatcacatagtaagcgtagagagcatatgaaaagtataatattcaaattgaaggacttcaaaaacttcataacgataggtccatcctggaagactacccaggacggaaatgataatataagtttatggttttgccacccaggggaccctattcttatgcaaatgcaaaaaccgggcgtaaaattagaattggttgaagttactgacagtaacattaacgatgatattttagaaggaaaattcataaaaacagcaatctctggctccaaagaagaggccggactgaaagacaacaaagaaagctgcgaaagtccattaaaaagcaaaactgctttaaagagagaaaacctgccacactctgtggctggaactcgaaacagtcctttgaaagtgtcgtatctgacccctgataatggaagcacagttgctaagacctatagaaataacacggcaagaaaattattcgtggaagaacaaagccaaagtacgaattacgaacaagataagcggttccggcaggctagttcagttcatatgaacatgaatcgggaacaaagttttgacattggtacgactcatgaagtggcctgtccacgtaatgagagcaattctttaaaaagatccatagcagatatttgtaatgaaactgaagaccccacccaacaatctacatttgcaaaaagggcagacaccactgtgacatggggaaaagcgttaccagctgcagatgatgaggtttcatgcagcaatatcgatagaaaaggaatgctcaagaaagaaaaattgaagcatatgcaaggtctgttgaattcccagaatgacacaagtaatcacaagaaacaggacaataaagagatggaagatgggctgggtctaacacaagtagaaaagccaaggggtatatttgactaaaaccataatgcaaaatcagtataaaggcgtgtaaatattagatgaagtagcaattatcatgataatatcgatcgctgtttttttttttttttctgtctcaatttggtgagcgtgcggctgatggtccatcacggtcggggaacaaactaaaattttcaatagcataatatctctatattgcatagctttttacttaataggaacttaaaaatttcattgatgctattatatttaactcataagtcaatctctttttccattttgattagcttattgcgacatggactatgaattataataactttgaaaattcgaagggtgatggacattctaggcttcccaaacctacatactccggaacgctatcagatggctatgatgaatcgaaaattaaaaggcaaaaaacagactctgcttttaatgcagcttactcacctcatatgtatccgaactctccgtattatgaaggttcatggaataccggttatactcctcaacttcatcatgtagcccctcataatcaatatttccatccaatacaaccgtccactcagtacaattatacgagtcctcccaattatacagaaaattacataccgccagttcatcagaatatatcttatgcaccagcgcttaatttacagaagtggccatcatcatattgtgaaaacactcaagccttaaagaatgataaagattaccaaacatcaattagttatgaagatgttgcaataccgaccgtaaaggaaatacaattgattgagaaaaacagagggaaagatacgtttatgaatgaaataagtccagtaccatcaagcaaggatcaagcatctgcggagcctacagaaatcccaagaaaggatcccgagctggcaaattctaatgccgaagatgatcataataacttagggctagaagatgatgatcgtgatgagcagttagaatcagaggggttgggtaaggtggttttggttcctggaacctccatagcattgattactgatgaagatgttaaaaagtggagagaagaaagaaaaaaaatgtggctactgaaaatatccaataacaaacagaaacatatgcaagaaatgggcataaaggaagatgaactgaagagccaacctagcattttcaaagagtcaaggaaagaaaagcaatttatacagagtattcaaaatcaagtgcagagaggaaatccgaagattgacttgaacttgaaattgatacagcgagaattcgcaaacgaaaactcccaacttttggactttataagagaattgggagatgtaggattacttgaatatgagctatctcaacaagaaaaagatgtactttttgggagctctgaagataataataaaaatcattacaaaccaaattacaaaaacaggaaacctaatctgagtagagccaactttactagaaataagtaatagaatagcaaatattgatatacatggaagagtacatgcaaaggtgcgtaaaaaaaaataagtcagataaaactaattactgtttagaaatcatgagtatatgaaactaattttgaagagctttaactgctaggttacttaaaacagtagttacagcagcaccaaggaacgaaccgaaaatggcaccttggtaaaatgaacccttattctctctctgtactttactttcagaagcgtcttttttcttacttttcgttcgtgattttgtggaagatgttgtcgttttgtgcttcctgactctaccaggcgacacagccttcttaatgtgttgttcattattaactaatgactttttattaagcggtccaccgtttttggctttatttataacgaacccatcagcagagtttgaacttgcatctgtcagtttatgcactctaagtttttcttggtcgttgtttttcttcagtgtaatcaatgcagcgttgtcttctttcattgctgtcattttttggagaagtatttatatatttattagttatttaatgtgtttataaatttatcttgaggctggtgaaatctattccaagtattttaaatatgtttgcaaatgcgagtctactactttggttccatatgatgtcagttttacaacaatttatactagagatagccaatatacttgtttcagttctgttttgccgtaatggaattatagctccgacaaatgtaatcttatgcactgaaattcaatccattgtgacaagaattatgtattttagttcttatttgatttatttcgacgcctcgcgcgcgctcttagaatccggcccgacaaaggatctgaaacaagtataaatcaaatggccaatataatgtcaagcctgttttatgtggcaatgtttagacagaaaatcacgcctgtaggggtccacatatctccagaataattagagagtcggtgtccttatgagatcttccttaaagcgaacagattgattaatcatgttttacgcgaggatatacgataaaaacaagtgaacagctcttacataacaacgcactcacttttctctttttcagaagcttttgcattgagaaggctgcttcttcgcttaaacttgtcttttttgactggtgcgtgtatttctgagttttttttgtgagaatggattttcctttttgcttcaaatttcgtaacacgttcttgttcttgttcctgtaactgtttggctagttctttatcgttttcaatttgctgaatttcttcaagtagcaaatttccagttccaaaatcacgttcaatgtcagttgacaattgctgtccatttacctctgctgcactaaagttaccggcaaaaaaagcatcgcaggagccgtccaccgaatctagggattgccatacaatatctttacaatttttataaccaaagtccgtaaccaatgtgtataatcgatcttcgtatttgaacaatgtagaaaaatggtcatttctgaataaaatggagaatttgttgtgtagcagcttttctctcaatcgtaggagtccaaaggcggtcaactgagtcggtgattcgttcaaaaacagacccaaatgcatggcatcacgtaaaacttcgtccgagttttcatcttgggaaattccacaatttatatcagctgcttgtgttaagattctctgcgcagattcataagaataatgagatagtttctcatcaatgttttcatttatgaaactgttgataacccagccatggacaacatcaacgttaaacaatcgaaatattgacatctctttagtattttcaaaagacccattaaactcagggttaatatttaaaccttcatgtaatctaggtaacaaacttagtaactcacttatatcagtactaggtttatctgtaacttgtaaagcgatatctgctaagacttcaataagttcttttaaagatatttgacttcccttatttaccaaccttattaactcattggaaaaacgtgtatgatctggtgaaagtattagaatatttgcaagtgctaacaaggcacaaggtccgttttcgttttgcagtaatattcgatggttttgaccattaattttgacacttttagtcgtgaaacttaaatccatgaaaagatattgcaataaacaagaattgcagtgatgtgaatctactttgagctgttctttaaagcgccttgtagaatgggcattttgtccaacgttttcaagacccttttttcgtactgctcgctgttaatactgcgaaactaaaataaacgacaggcagatgactaaaacaaatcaaacaagaacctctagggaaaggtgtcctaagcgcggaacttcttttcgttatggggtaaatagagcggtacttaataatctgtttacaaagcaattttacaaagttttgatataagaacatttaactaaagagaagaaaaagaaatgaaaagccattctcttggcagaggaaacaaatgaagaggtgcgtgtaagtgaaataaatagaccaaatagcatttgataaggaagaaataaaagaaatttataacagggtaaagagtttttcgttctgaaagagatgcagcaatagtaagaattaagtcctagtccaatttgggaagggaaaacgattaaagcataaaccgctatgtcgaatttatgcaaaccatatcaatctactttccttaaaaatttttcgtccaattaaaagaattcaagtataatgtacaagaaatggaaaagattgaaaaaagggagtctatttttgtagttttgctaaactatctaatagactttgaacattattgccagcaggttgctgttgctgttgctgttgctgttgttgttgttgttgttgttgttgaggtggcggaggttggtgtgacattggtggggcagagggttttgcagatatattttgaccattgtaattggtactcataggagggggagaggatgagttcatagaggaatatccacccaactgttgttgctgttgttgaggagcctggccttgcattgattgtattaaaccaaccaattgctgctgagcatgaggttgttgttgctgttgttgggccattgaaagcaaattcgatacaacgttaggtggaaggttttgaatggcagataatagttgttgctggtccattggagtttgagaaggtggttgaggaggcggaccagcctgataacgaccatacccttgaggaatttgttgttgtggaggtggtggtggaatagaagtctggtagcgaccgtagctctgattcattggaattggaggttgagaaccatatccttggtcatgggatggtggtggcatcccataattaccatatggctgttgctgttgttgttgtggaggaggcatactgtaaccctggtaatagtttgtttgaggaggaggtccgacagctgggccgtttggaacaggaagaggaggagcgccatatatgttttgctgatggctcatagcacggtaatcagtaggacgagaattatttctgttgtttttgatgttattaaaaatggcaactgcgtcatcagcggatatgctaatatattcatcaaatttcgtttcaccttgtgagcctttgtagaaagtttgaacatctacattgtgtgttttattaactaaaacaacgccccacaccccattatatgcggcatcattgataagctttcccagttccattcttggtttcaagaaaatcatatcagtttccaaaccagtcccgtccctaaacctgttgaaaacctcaatggcatacgtacgatctgcggttcttttaacgaaaatgttgcaagaaacggtgtgtcttctggatttcttgtagccagcaccattgtcgtcattgtacatgtcaccagattcagtttgaaatggtcgttttgcggaagaaataaaagtagaactactgtttgtaccgtgatcaccatgatcaaattgaggacgagcattcgagctagaaacttccaggatcaactttttgccaaagttcatttcttgagactcgcattcaattgcatctctaacgctttgagggttgtcaaactgaatgaatccaaaggcatttttgatattgatttgcatgatatgaccgtatggagagaaaatcctaaataaatcctccttagaaacgttctttagcggcaaattaccaatgaataatcttgacttcggaggaatattgtgcatctcggtgattttattttcaccgtgcaaataggctgcataacggtcgtgttcttcttcggtaatcggcttagataaatccgccctaggaaatctcatacgtctttgggcatctgacaatggaggttttctttgatcattgcttcttgcgccgcttgtggctgaggcgctagctgttgttgagatagtactatcatgaggaggtacggaaagagctgtgtcagaatttgaatttaacattgctaaaatcgcagacatcttttcttcttgaggtaaatgttgaaactgaggcaaatttagcatgttactgtccataatgtacttgacttgcttttgtaaaagatcgtaattaacattttccatattagttggaaagtgagtattatcattttcttcacgagttattttttttatagcttcatctacgtccttttgttctttttccaatgtttcacggcgaagttcgacctctttatctttggttttatcctttttgtcttcctcatcctcaccgtcttcagcggcactatctgagcctaccgaactgttgtcgttgccttcttcttcttcttcttcttcttcttcttcatcatcatcgtcgtcatcatcatcatcgtcatcatcctcttcttcctcttcttcctcttcattatcatcatcgtcatcatcatttccgcctttttgttgatgttcttcttcttcttcttcttctgtgtttattacttccccgttttcctctcctttttcctccttatcttcctcctcttcatcgttcacatcttccagttcgtgttgttcttcattttcctcctccctttcggcttctctttcttcctctggggcgtcaaattcgattccatcgtctgcgcttgagttattcatcaattcattctcgttagagttactatcgacggatagttcaggtgaaggaatatcttgaacatcactgttatggttttcatctgacatggcttgcagatggttattatattatgaaaggacagtccgggaaaaacgtaagtcaattattatattttgaccaaagaaaatcgcttgttgctgtgcagaatctaataaagatgctcaagatagcttttattagaccttcatttagaagtggcaaaatcaaatgaattgttttttgtcctttgcttcttccgcttcattttctcttcaacaattcagggttacactcaatcacgtgggataccataatttatcgttctacaaaaaaatgcaagcacgaactagggcggtagttaggaagcgaataagaatagcgctttttcgtttcaatttggaatattaaagagtgatattattaatggttttcttttttggaatgtgatctatatacatatttaaatagtctcttttgtatttgtggtgtcataatgaaactgcatcacaccagatgcttacccatacagaaagtcgattgattatgaaacttgaagtagcgaagattacggcactcgaaaataaataaaaagaggaaataaaagagatagaatacaacttatcaaaagttccagatagcccgtacctgtttaaatctttttacttaaagcatccttcctctttaactcctgctcatgagcaagctgaagcttgtgttgctgtacagctggtgaatcagaatccactgaatgtgctggacatggcagcacagaaccgatggccactgatgcgaatgcaatgagaaatgtagaaaagtataggttattgactattttgtttctagtgactgctctcatgatatgtgtctgaattaaactaattggccttccgtgcctgtaaattcaataaataaataggatgttaaattttcctaatgtgtctcgaggtgcttatgttatcgtgcaagcgctgagttcgaaacgctgttttgatgaatatcctatatatatcaaaagtacaaacacggggaaagagagccatcccatcaaaaaaaataaaaaaagaaaacccttgcagaaggagaactggtgtagaggtttccggtcttaatggacttaagcacgtgacttttaaaacccatgcatcggttactatggttaccattacttacgattttttttttttcgttatgaaccctgtgcccgaggggttttcaggcacatagatcaaagttctactcgtttacctgtaatcttggcgcgtttaggtctctttttttttcttttttttttcttcttttttcatttgtactgcgttatagttgtttatggaaggtaccaatggtgaatatggaaaaaatgaagtcaaatagaagaagaaagagaagctagctttgaggtaggtactgttttgagggtttttgggtgcttcaaatttgtcttctcaactaccttattatagggctcaaaaataattgacgtcatcgctacaagtcagatgtcgatgttaagaatctggagttgcatcgtacatttcttttccgtgcaggcacttgattcacgaataaagccagacattgaattcaaaaggcgacaaaggatatttatcaattcatctaaagaagagaatggttcatcttctagtgccgttactgttacccgtaaccctgtgctcagctctaatagcccatctcctccgctatggaatacatgggaatttagactatattatttggcgttcaccgtagtagttcctttcatgataaaggcggcattggctacgagctccgagtctaatccaaactactataaattcagcggactgctagcccatggttggattctgggccgcaaagtggataacagcgatcctcagtataggttttttagatccaatttttttttgttggccatcttaatattactacaaattatattaaaaaaggtttttgttaaatttagtaaaattccgaaaacaaaattcgattttgcgtgtggattagtttttgtctgtttcatgtacgggatcaattctgttaagctctttacgcatgcttttattttcttcactttggcacattcgctaaagagaaagcgtttgatagccgcttttgcgatttggtcctatggtatctttacactattcatcaatcaaaaaatgaaaaatctcccctttaataatattgctatcatcctaagtcccatggatcaatggtataagggtatcgttcctcgatgggatttttttttcaattttacattattgcgtttgttaagttactccatggattttttggaaagatggcatgaacaattgagccgccaaccttcgatagattacgatgatagacgacctgaattcagaaaaagtttatctggttctactctacaaaccatttatgagtcaggtaagaatgttctggaggaaaaggaacgactggtagcagaacatcacatccaggattacaactttatcaattttatcgcttatattacttacgcgccattgtttttagtgggcccaattatcacttttaatgactacctttatcaatcagaaaataagcttccttcgctaacgaaaaaaaacataggcttctatgccctcaaagtattttcgagtttgcttttgatggaaattatcctacattatatctatgtgggtgcaatagcaaggaccaaggcatggaacaatgatacacccttgcaacaggctatgatcgcgctgttcaacttgaacattatgtatttaaaacttttgatcccatggaggctctttcggctgtgggccatggtcgatggtattgatgcacctgaaaatatgctacgatgtgtggataataattatagtacagtgggattctggagagcctggcatacaagttttaacaagtgggtaatccgttacatctatgttccatttggcgggtccaataacaaaatattaacgagctttgccgtattctcatttgtagcaatatggcatgacatccaattacgagtgttgttttgggggtggttaacagtccttttattattaggcgaaacctacattactaactgttttagtagatatagattcagaagctggtacaggtttgtttgcggtatcggtgctgcaataaatatttgcatgatgatgattattaatgtctatggattttgcttgggtgcagagggaacgaagcttctattgaagggcatatttaacaattcacatagtccggagtttttgactgcggtaatggtaagcctatttattgctgttcaggtaatgtttgagattagagaagaagaaaaaagacatggcatcaacttgaaatgttgatctagttattagataagctatgaaagtcaatccttttaatcgagaatgtaaatatgtggaatacacaattttaaccaaagtactatatatgcgttacaagtaatttaaatttaagttcaccgaagtaaaactaactgcaagattgttacaaagaacaatgcactatttaaatcacacaatggctattgaaaactgtaactgtcagaaatgctgcatgtatctatatgcatcactaagttgcgacttttaagaaacttccacagttctcaactcttctttgtgcttttcacacattttcacaattttccgaaatctccaaattgaaaaaaaaataaaaataaaaaaaggcaggagaagactaagtattcattattcgctgtttcataaataaaaggataaaaaggttaaggatactgattaaaatgtttgtcagggttaaattgaataaaccagtaaaatggtataggttctatagtacgttggattcacattccctaaagttacagagcggctcgaagtttgtaaaaataaagccagtaaataacttgaggagtagttcatcagcagatttcgtgtccccaccaaattccaaattacaatctttaatctggcagaaccctttacaaaatgtttatataactaaaaaaccatggactccatccacaagagaagcgatggttgaattcataactcatttacatgagtcataccccgaggtgaacgtcattgttcaacccgatgtggcagaagaaatttcccaggatttcaaatctcctttggagaatgatcccaaccgacctcatatactttatactggtcctgaacaagatatcgtaaacagaacagacttattggtgacattgggaggtgatgggactattttacacggcgtatcaatgttcggaaatacgcaagttcctccggttttagcatttgctctgggcactctgggctttctatcaccgtttgattttaaggagcataaaaaggtctttcaggaagtaatcagctctagagccaaatgtttgcatagaacacggctagaatgtcatttgaaaaaaaaggatagcaactcatctattgtgacccatgctatgaatgacatattcttacataggggtaattcccctcatctcactaacctggacattttcattgatggggaatttttgacaagaacgacagcagatggtgttgcattggccactccaacgggttccacagcatattcattatcagcaggtggatctattgtttccccattagtccctgctattttaatgacaccaatttgtcctcgctctttgtcattccgaccactgattttgcctcattcatcccacattaggataaagataggttccaaattgaaccaaaaaccagtcaacagtgtggtaaaactttctgttgatggtattcctcaacaggatttagatgttggtgatgaaatttatgttataaatgaggtcggcactatatacatagatggtactcagcttccgacgacaagaaaaactgaaaatgactttaataattcaaaaaagcctaaaaggtcagggatttattgtgtcgccaagaccgagaatgactggattagaggaatcaatgaacttttaggattcaattctagctttaggctgaccaagagacagactgataatgattaaacgctctgaatgcaaagattcaatgagattctctaagaattctattgataagatttaaaggtatttgacaagtagagatctttattttttcttgcattttgtctagagaaatctcaactgacatactcgacatgaaatttttggtattgtgtcttttattctattgctttaagaaaactgtgacatatagggaagacatgcttaacaagaagatataattatataatatatatattattaataataacatccttactgcagtcctgttgtgggagaaaatggagagagactatgtttcgtatcaattcctaaaatcaaaaaaaaaaaaaaaaaaaagttaaacaagcactcgctgttcatttgttttacaagtattcatactctaataggtcattgagcttcttttcttgaggagagatccaatttgaagtcggaataagatttgctttcattagcgtaggcaataattatgagataaatggtgcagcactattaagtagtgtggatttcaataatttccgaattaggaataaatgcgctaaatagacatcccgttctctttggtaatctgcataattctgatgcaatatccaacaactatttgtgcaattatttaacaaaatccaattaactttcctaattagtccttcaatagaacatctgtattccttttttttatgaacaccttcctaattaggccatcaacgacagtaaattttgccgaatttaatagcttctactgaaaaacagtggaccatgtgaaaagatgcatctcatttatcaaacacataatattcaagtgagccttacttcaattgtattgaagtgcaagaaaaccaaaaagcaacaacaggttttggataagtacatatataagagggccttttgttcccatcaaaaatgttactgttcttacgattcatttacgattcaagaatagttcaaacaagaagattacaaactatcaatttcatacacaatataaacgattaaaagaatgagatttccttcaatttttactgcagttttattcgcagcatcctccgcattagctgctccagtcaacactacaacagaagatgaaacggcacaaattccggctgaagctgtcatcggttacttagatttagaaggggatttcgatgttgctgttttgccattttccaacagcacaaataacgggttattgtttataaatactactattgccagcattgctgctaaagaagaaggggtatctttggataaaagagaggctgaagcttggcattggttgcaactaaaacctggccaaccaatgtacaagagagaagccgaagctgaagcttggcattggctgcaactaaagcctggccaaccaatgtacaaaagagaagccgacgctgaagcttggcattggctgcaactaaagcctggccaaccaatgtacaaaagagaagccgacgctgaagcttggcattggttgcagttaaaacccggccaaccaatgtactaagcccgactgataacaacagtgtagatgtaacaaagtcgactttgttcccactgtacttttagctcgtacaaaatacaatatacttttcatttctccgtaaacaacatgttttcccatgtaatatccttttctatttttcgttccgttaccaactttacacatactttatatagctattcacttctatacactaaaaaactaagacaattttaattttgctgcctgccatatttcaatttgttataaattcctataatttatcctattagtagctaaaaaaagatgaatgtgaatcgaatcctaagagaattcaacagcgtaaaatacaaagaggataacgacaacgaaaaaaaatacactccctgattatgatgcctctgagcttgacattttcgttgtcaaccaagaaaaccatgagccaaaaaagcgtcctaacgctcccagtagctttttcaaaacactttcataatcttcagtattggcatcgccttcttttacaattgacttagcgttttgatcggcgggtttatctattttctgtatttcttcttgttcggacatatccgtattttcagtatcagaaccgttgatctcatgttctgattcttgcgtgtcggtgacgtctgtatcttcattaactcttgtgttatcattatcattaccttcagatagattgtctaaacctttgtcctgtttattctctgtctgttcctgagaaaagtttggagagagctccttattctcttcttttggatctctttctactggaacttcgttcaatggagcatgttcatactttctttctttcctggtagtctcttttgcaaaagcagaaccatcttgcgaaatagctgttttaggggaaggaaacgttacattaccttttaaagaaggagttggcgtctcagggccctcatagtacaactctgacccattttcatttgtattgtgtgcagttttgtcgccctcgtccttttcttcaccagcgcttccgccgtcctcttcgttatttaaagtagcaacattgttttcattgctgtgctcgtccacctcctttggatactcatcatcggcaaaccagttaccgttctgatctataaatttgaaatgtaccttatctttatcattatgtttggttaccgaagattcatcaaatttgtattcccatttcccgctactggtatttattttcatgggtacaccttcccaattggtaaactccccagcgatcttcaactctggaaagtcttccgccggatgatcaaatacaatggtgaccattatttagttgctttgcctatcttaatgttacaaccaagtatgtatgtatgtacgtacgtatgcaaagaagtggatatagagaaggaaagtaggggagagagggaaagaacaaaaaaattgaagttatttgagatagtcttgtattatttatctgtatgtacaccgtattggtggaacatcactgccaaattttttatcccattttcacatagttccccttaaaagaaactttgttagtatctttaaccctttacactgtgggggtaaaatattaccgcttcggagatttctttgacaggggagcagggaaaaagcgatgagtgaaagaaagggaatgcgatgataaagatgataatgttgcaaacggtgagaaacttgcagatcgcagtggctaattcttaatctttatattttaacaagacttctaaacgtaaaccgcagattgctgcatacatacaaggatacacacacacagacggacactaaacatctacgtacatacatatacatatatacataatgtttaacgtgattggtgggggacgttaccacatctatccttgccaaagtttattttgagatctttgaaataggggttagacttaatcttgtctaaggctaaaatagcattactgatgttagtataattgatgaaacaacagttcttctcaggcaagaaattgatttgttccacttccccatattgctgaaagatatgtcttaagttgctttcggtgaagacacgttcatctcttagggaatcgccgacaaaatcaatattacccacataaacatttcttgaggcaccattactgactgccaaggcgagcgcatttggtaatgggccggagtgtttaccccagccgactttgcaacgttttttctggactgtgaatccatacaaagaactcattgcataaaactgcgcagcagcagtaggatcaatgaatgttacaaaacagacgtatcgatcgttcaatagttttatactttgtaataaacctccacgaactgcattacatatttcttcaattttaacatccttaggcaagctgcccaggtaaacagtcctgttacccaagttattggggccgcccgcagatgtagcaattgcagcagcagcagcagactgttgtaacaaagcgttagatataaattcacgatcagaaaactctatcatatgttccataccaggttgtacacctagaaattgagccgcattatgttgttgagttttggtaataaatgcacatctgtcctttccataaaatattctcttattttgatagtatggatttctaattggcagattcgtaaccacttttatagcatttaaaatagacgcaaaatgaataaaggcgattcccttttccttgataatttttatacagtcaatttcaccatattcttctaaatcaaccctcaattgctcctcagataaatgtgattcttcgccttcaatcgtcatacggccaatgtatacatttcttgtggcaccgtccgtagagattctagccgctacaataggatcaattcgagttggtttcccccacccgattttgatatccctgtcaccgatgttcaagcgctttaaaattgcgtctgaatggaacaatagtgcagcactttcatctataaacgaaacgaatgcacacatcttttcaggtatgattttgacgtcttcaacgacaccacttctgacatgatccaataactctttaacgcttaggtttggtggcacattacccaaataaacagttctacttggggccgatgtaaaattcaaaggattattggcttgtgcattaactggtaaaggcgcatttgcgttggttactgcagttgcagttgccataatagtgggtgacatgccatcagataacacatttggattctcatcatcaaaaggagagacttcatttgatgacctttcatattcataataacgattgttattgtggacaacttcgttatcaatttcgaaattttgttcctgtgaaaaccgttgctgttgtgaatcatttcgctgctttgtctggaattgagttggttgctgttgaatacgctgataatcaaaaattccgtcattctcgtaaaagaacgaatcattaggctctcgtgtaaagtcggatggtaaaagagtaaaattaccattcataggatacacagcatcgccaaagttttgagggccactcgcataagtttcttggtaagggccggaagaactggactgttgatacattgcaaagtcatcggaagaaggaaaaggagggaacatgttattattgttattattattactgatattattattgttattgttattgttattgttattattattgttataagaaaccaccatgttttaatgcaattgaagtagtatgtgatggtgaagaaaaaaaaaaatacaacgatagttctttgtttttctttaggaaatatctgaatagaaaaggcttcaacgaccagaattgaaaaaataaaatagtattagcaaagaaaaatatgatattttttttcaaaaaaaaaaagagtgtccttgagaattgaagttggaaacggatattaattagacaaaaaaaatgatgaagaaagataaagtgaaaaatatgaggctggaatggacagttgaaccaattaaggagcctaattggtaaagcagaacaggtgagtcagaagacttaaaaaggggcaaatatcaaataacggaagaacgaagaaaatagaagaatacaatgttcaaaagaaatgaagcgtatgtgtatctaaaggaaaggtacagagactatcagttctagaaattgtaaattggtaaaataaacagagaaaggaagcttaaggagagaattcagtggggaatgtgactctgtgaaaataatgtataagagtgggcaacggtgttctcgtagatatagcgctgtgctgaaccaagtttagttttttttactttccaccaaaggcaaagaaactgattaatttattgctgtgacgaagggatggagtatgattgcggttgtgactgaatctctttgtagactttcggacaaccacaagatccactttctggtaaagttaatttcaagatcgtgtttttttctgtcttttctttctcttctcatagccaaaatcgtaccacaaggaaaaaaagcaccgggttaccatgatggtggaatcccactgtaagaacataagaatgataagtacgcaactgccacggcagttggaagaaagacatagtctgccctcattcggcgtgtattattggacgtcaagttaccttttccaagtgtttcccttttttgtcttttgaatttgtcaatagggagtgaaaggtccatagttcaagggcattccaaaagtgaggataaaaaaagcgtagtcataaacacttcaacggtgttgccgagaatgacgacggtccggtagaaggtggtgcttttatctatgtattagttatttactatctgcgtaacgaaactatgattttttttttctctcacccaagccgaaattaaaaattctgtcttcgcacttattccaaatagaaagggaatgaatcgtggaactattggcattgggatatagcctcgatctactcgcatataacggctacggttcatagtacaaatctcagaatttttcagcaagcgaaaggatttcaaagaatgtttttacagactctccgcctaactatgccaaggatgtttttgcacatgaaaccgtcccccataacgataacaagggcctgcacagtgcccagcctcctatctgttgcagctccgcaaccagctcttgttgcagctaacagacctttggtttttaacagaggtttcaaggtcagaacatctgtcaaaaagttctgcagtgattgctacttggtaagaagaaagggaagagtatacatttattgcaagtcgaataaaaaacacaaacagcgtcaaggctgaaagatgtaaatctcttcgctgttctccgttcgggtgtttacaaaatattctcattttctaaaatctgtaaataatacatatctataatattcttttatgtatatgttaattttttgtatcattttttccaaattgataaaccaacacctccgatcagtaacgttttctcagaatcagcatcttcatcattggaaatgatttctaatgatcctgtatccgccacagtggtacgctttttatctaccagtgaaagcttgcctgcggtaatttcccaagcgcgtattacttgatcaaccgatgtggtaatgacttctttgccaccattaatcaacataccggacgttattgtcgaagaagctgctgcagcgataaagtcacttgtttttaacgttactttattcgagtcatctaatttcaggttgcttaaccctaaaccattatcatcaccccctgtcaaaattgtggcggaagttcttgtagcattagcaacatagtctagggacttgacaccagattgatgtaccggcaactgcgctacaggtgcgggaagatttgagatagtagcgtccagtttgtggtcaaccaaatcgccagaaatcggatcaacggaaaatggtacgtactcggttatattataaaccactaaatgtccatcagttggtgaaatgacaacaaggagctcttctttcagtgcaataaatacgacgttgaataaacagcacgtcttataacgaccttgcatgatcaggtcaaacttattctgattttccctatagtgccaaatctttattgttgaatctgaataaacagtaactaataagaagtcacctgactgtgatataaatttgacatcaaaatccatgatccttagatcagaattatttgtggatacaggtaaagcttgtcgtatggtcatatatggtcgtttattatacttatcgttcaattcccataagaataactcctctctagctgaagatgatatcattagtttgtgatttataaactgacaacgttgtaatccagacacatgctttctttgtgtccaaaaattctgcaccttccctgttctattgttaaaatatcccagcttaattgtagtatcttcagatgcagtacagaatatatgcccatccttaaaattgtcattcgtgttggtatttgaaacaggacagattgaaatatctctgatttcccttccgtgtacaccattttctaaagtttcaggcacaatggagttgtaaattttccttaaatgaaatcgggatgccttaatatacattaatacgtggccatcagtaatttttgcgagattccacagacgatgggaaccaccacaaacttcactagctagttcataacagttggtttcattgtagagataaaacaagctggacttgaacccataagtaatgtattcaccttttgaattaaagaaagcgccctccaagaaacctttcatcatcttattagaatgcaagaccttataacttagtcggtagggaccctcttccaaactgtttttcgtcaactcaataaatacataatagccatccctatttgttactgagaagaccgcagagttgtctttatcttctacaaattcgattgaggttgtagtgtctccgggacttaatctcctaattatgaagggctcctcgctctcatcaagtaagttgtagattactaatgtactaaaacgtgagccgactaaaatatgatttcggaaggaggtcaaacatgaggaagaaaaattttccggcttattgaaacagtgcttgcttttaatttttaagttctgaaggcttatttccaaacatacaaacttctctcgaggatttggggattgtaaagtcaataggaaggagtcatcatcgtattctgtaacgagacagttatttgtcttagaaagctcatctaaatggaattcttcggtctcaattatgtcagcgctatctttgctaaatttgataagaaggatgtcacttttattattggaaaagacagcgatattttgcgtttgaatcccatttgtaattggatacgagttgaatttttcatttgttagtaacaacttccattgtttcgtgacatcactgtatttaagtattttacccaatgaagtgatagcaattacaccgaatgaaaaccattgaaatcccttgatactttcattcttttcgaaaatatcgccacattgctttgcgatatcatctagactgaacgatgtttcttcatcgccgtgtctcttcagttgaagaagatcaatcagctttaacctaccatcattcccggaggttacagctatcatttcgtcgtctttcacatcaacgccccatatactcttgattaaatgtacttcgtaaacgttagatatggataattcggcaacgttttctcgtgattcgataatgttccatacacggcatgtgcaatcttcagaaacacttattagttttgaatcattatcaaaaaacattaaattccatattcttgccgtatggctccagccaacagacagctgcttgccagtttctaaatcccacagtctaattgatctgtcgtcagagcaactggcaacatatcttccgttgttgcttaaattaacataaaagatagaaccttcatgacccagtaagttatgaatttttgtctccgagaacaggtcccaaatgataacaccgcccattacagtaccagcgttaacatatactttatccggaccgaaaactttaattataccggaatatagaatagatctttctcccccaagagacttcctaaaaagaacttcacaatttaaatcacaaattagcactttattataacatgttaacaaatatatttgcaagttgtcaaagctgaatgtagcaccggtaatccaatctgagttaatcctttcgaaatccaccaatgactctttctttaaaacgtcttcaagttccactattgttactgatcttgcaccataggccaaaattttcccttcactagaaaggctaagtccatgaactttattgtagtgaaatagcctacatttgttaatcaacgtagccgaatgatagtcatagacatggatgaaaggcccataaccagctagaacataatcattgtaaaatttaacacatagcgcaggaccataatgagacaagtccttcattttaatcacttattcttcttcaatgagcaacttcaattggcgggaatgagaagctaaataacgatgaggtccgctagcagaagttttttcatgctcatatttttccactttttttttcttacattttttttttcagcagcgtcgttttttgtgagacgccgatgtgtatgctaggcttaaatctatcattcagaccccagtgtaaaacataagcggtgaaaagtacgtagggtagtatacaactcaccaaagcacgactacgtgaaaatgaccctgagagtatcatcaatgttatcggctgtataaataatacaccagaacaaattcctcttaaagatgtaggcaagaccagactcagtttctctgagcagtaccttcaattttcaatttttgatagatgttcgtcactaatatttttttattgagttaagttcacccacttctggcacttcttataaccttgataattaaaaagacctcggcggttattttttattttgagcagttataaagggcattaccctcatcatcttgcggaaataggacggagcacgtcgcagacaggctttaacgtaatcaattagttttgaaaaatttctccgctatgggtaaactaggtaaaccgcacagcacaatcagctgcattttctattttcaattttctattggtggcttttcactgcatgatcaaaaaataacgttttgttgattagttttttcttttttgttcttgttggttttcgtatatgaattttatgtaactgggtatttacaggggtacaaagttcacaacagagaccatcaatagtttgtttccttcgaagtttactttgcgtaaccttactaaaagatagcataaacatataggagtatagagaagagtaatggaatcgacagcaatagtgcctaaaggccctgttgtgggtagtgaagatatggagaaagcggaagtcattgctagtgggtccacagacattatatcaacaacatcaacagcgacaacaacggcggcgattggaagtgtacaggaagaaagtgtaaaacaagaagatgttcctatggaaggtggagagggggaagtcgaggaagaggaaggcgaaactcgctgtatctgtggagagctcgatactccagatgactccggatttttcattcaatgtgagcagtgcagttcctggcagcacggttattgtgtgagtattactcaagacaacgcacctgataaatattggtgcgagcaatgcagaccggagttacatcagctctttaccacagatactggcgaagcaaggtcaatctataaacctgtgcaagagaaaaggaggcaatcaagaaggaaggcacgaagtgcagctgcaagtaaatctcatgccgccaatgaagcagagaaaagtcccagaaataccagcaataccgatgataacgtcgacgatatcggcgacgaagaagatgaagtagaagatgaagcttcggctgtagcattagccaaggacggcaacacgaggtcaagtagaaggaggaggaggaattcaatggatgatgcttctaccgatcagtattcactggatcctggagatagtgataagaagctactggatagaaaaagggcaactttcatggcaagagaagaaaagcaatatcaaagaatgcttgaaaaagccttgaaagaaagcaggaggacatcacatcaagaagatcctgaaagttatgaaaatgatgctgatatataccaaggtgataccgacaatcacaacggcaccactcgattacaaacggatgttatgctaacggaaggcaaaccggactcggtaacaaatgatgatatgaaagaaagcctacgaccatcgaaagagcaatcaatggaaaaaacaaatgatgtggaaaaagaagctagtcaagaaaaggaatcttctacgggttcggcgcaagacactgagaaaactgatgaacccatcctacccctaacctcaatatcttcttctgaggatgattcaaggaaagctagttcgaggggttctaaaagagtttccaaaccagcaagaaagggcaacagaactcgtcgaagcaatacaagttcagacaccaaccaaaatagaaggagtgctgatataggtaccgacaaaccagtaaagcccagattaccccctcaaaggacctcattaaacgaaatgagaagaagggtatccgctattttggagttcatttctagaactcaatgggaattgagtgaagatcagtctgatcgagaggaatttgtacgattcgtggaaaaccagcatttcgtagaaaaagttgatacgatttacaacggttataatgaaagtctatcaatgatggacgacctgactagagagttactactatgggagaaaaaatattcaaataacactaatgccattcaataaacgcaaaacactgcaatattattctcaaccaaagtataactgtaatgaggcgaacaaacacatctatacatatatatacatctatatggatataaaaacgactaattcaacgttgtttttatcaaccgagcttactcttgtacgggtaaccgcaaggatagctagttgcggatggtatagcgatttggctggcacgatgattaaggaatccaaacatctaatggactagcacattctatcgatttacgggtcaggtaaacatagatattgggatatatcatatatccttactgagtaactataattatggttcatcgaggaaggactttgaagtcagacactgatgtaacatctcttaatgcgtcaacagtatcacaccagtcaaagccatttagacagttttcgactaggtcgagagcaaagagtaacgcaagcttcaaaggtttgcgtagagttttaacacatgatggcaccctggataatgattattttaataagcacaacgtttctcagaaatgcaagagttctgatgcacttttcagaaagcgaacgattagtgggttgaatatgacagctttaacaagagtaaagtccaatcaaggaaaaagatcagcatcctttcatagtccggtgcataatacgctgctcagtccaaagaacagcagtcattctaatactggaactgctggtttcggcctgaaaccacgaagaagtaaaagtacccaatctgttctgagtcttcgagatgcgcaagaatctaaaaagagtgaatctactactgacgaggaggtggaatgtttttcggaagacaacattgaagatggaaaggtgaataatgataaagtaatagccgagcatgttatgcctgaagaaaaaaagaatgtgcagcaattaaatcagaatgaattacaatccccggattcaatagatgaacaagaagaagataaatcaggtactgatggaaaggaaaatcatagagctgtatccttaccattacctcatttatcttccaataactatttcggagaatcaagccattctatagaacatcagaaagatggagaaacatctccaagctcaattgaaacaaaactgaatgcaacaagtgtaatcaatgaagaggggcaatcaaaggtgacgaaggaagctgatattgatgacttgtccagccattctcaaaatttgagggcctcattggttaaagcgggcgataatatatcagaagcaccatatgataaagaaaaaaaaattcttgatgttggtaataccttagctgcacataaaagtaatcaaaaaccaagtcattcagatgaacagtttgatcaggaagatcacattgatgcccctaggagtaattcatcaagaaaaagcgactcgagctttatgtctcttaggagacaaagttctaaacaacacaaattattaaacgaagaagaagatctaatcaagcctgatgatatttcttccgctggtaccaaggatattgaagggcatagcttactggaaaattatgcgcctaatatgattctctcccagtcgactggagttgaacgtagatttgaaaattcatcatccatccaaaattcgcttgggaatgaaattcatgactcgggtgagcatatggcttcaggtgatacttttaatgaactggatgatggcaaattgcgcaagagcaagaaaaatggtggaagatctcaacttggccaaaatataccgaactctcagtctactttccccaccattgctaacatcggtagtaaagataataatgtaccacagcacaacttttcgacctccatatcgagtttaaccaataatttgaggagagctgctcctgaaagcttccatggttcaagaatgaataatatttttcacaagaaaggtaatcagaatctacttctgagatccaacgatctcaacaaaaattctgcagccccggcctctccattgtccaacgaacatattacatctagtacgaactccggtagcgatgcaaacagacaatccaactcaggtgccaaatttaatagcttcgcccagttccttaaatcagatgggattgatgcagaatcaagaacacaaagaaaattatggttgcagagggagaattctattatggacttaagttcacaaaatgacggtagtgactctatctttatggcaggaaacattgatgcgaaaagggagtttgagagaatatcccatgaatactctaatgtaaaaagattttacaacccattagatgaagcattgttgagagtacaacctataataacgggaaatgcaaataatatcaggaaaaaaagccataacgatgctcagtcaatcgcacattctagcagtgatacagatcataaggatgaggacgatttgctctttactaactatgacaaaaaatttgatgatctttatccacatcttgcaagtgcaaagattcaggcagtgttgtccggtatatggaaaagcgaaagttacttatttaacaaggatgttaatccaatcaacaagaataggacaacgagtacaaaccacagcgttggccacactgcttcacagaatgcacgtaacttgctgaggggcccgatgggttccagcacgactttgcaccaccaacgcgtcattaactctctgcagccgactacgagggcagtgaatcgcaggatggaaaatgtgggctacatgcatacacagccacaacaaaggtgaaaacaaccaacacgaagcacacagtttaaaagagtagctaatgctttcgaggtaaaacgcgaagttcgtagagagcgaatatgtttggacacttaaggaacatactatgtttatgcactataaaaggacatgtacttctatacgagctaacgaggcgtatttgtataacccggttaacgtaataaatgataaattatcgaacaaaaagaaagaaaaacgttgaatgcaaccaccgcaaatttagcgatttcgctggattccgtatctcttaaaaaatggcattagtaaatataccttaaacgtgtctattcttttagcaattttttggtaagtattcctcacggactataaatactatcggtcagaatcactacattcaaattaatcttgttttaccgagtctctgacgtttcatttacaagcttgtccttacaaaaaacctattttattactttagtccattttcctttcaagttagatattgttttcccttcacttatattctatttatgagaagaagcccgtccagatcaaataataactttgcagtaccgaattgctcaactaattcaaactctagtcagcaacaattaactacaccttcagatgatctcaacagtaacgaacctaatgacccagatgatagtaggtctctacctactatcaagaaattcaataataaacattctataaacaattacaacactttagcatcggccgggaaaaacaacaacaataaacgagctagcaatgataatttgctcattcctggtgagaatgcccataaacagaaaatatacactaaggatgaaaacttgaagagcttgtacctagatatcgatgtttctgtcgctaaagccctatcctcatcagcaactgctccgaagctgatcaataccgcaagaacttcctctactaccactgccactacctcaaataatatcctgacatcaccctcttatcgtgaatcaaattattcttctccatcctcatattctttttcctcctactactcatccgctacgtctgcttcctcatcaacctcatcatttttaaaatcttcagggttatcgtccagagttaagtctccttcatcttcggttaaggcaggttcttttggtgcgccttcgtccccaacatctgggatacctaatcctaaaagtagcaagaagcctatatttttgagacggtattctcatgatacctcttcaaatgaaggtcttgatatcgatgttgcgatcgaaaaattactacaagtgggtgagtcaagagaaattacaaaaacgtccaaaaaaaagaactttccattccattcttgggaaattcaactcatttgctatcatgcaagagaaatttttttgaatcaacctactcttttgagattacaagcgcctatcaaagttgtcggtgatgttcatggacaatttaatgatttattgagaattttgaagttgtctggtgtgccatctgatactaattatctgttcttgggtgattatgtggaccgtggtaagaactcattggaaacaatactattgttattatgttacaaaataaagtacaaagacaacttttttatgttaaggggtaatcacgaatctgctaatgtcacaaagatgtacggtttctatgatgaatgcaaaaggcgattgagctcgaaagtatggaaaatgttcgttgacgtatttaatactttgccattagcagcaattattcaagataagatcttttgcgttcatggaggtatatcgcccgatttacatgacatgaagcaaatcgaaaaagtcgcaagaccaacggatattcctgaaagcgggctggttacagacttactgtggagtgacccagaccctcaagtaactgattggtcagaaaatgatcgtggtgtttcatacacattttctaagaggaacgttcttgatttttgtgctaagtttaaattcgatttaatacttaggggacatatggtcgtagaagatggttatgaattctttgccaggaaaaagtttgtcacaatcttttcagcaccaaattattgtggagaatttcataattggggggcagtaatgagcgttacaacgggtatgatgtgtagctttgaactgttaaagccgcgtgcattgaaaaataaaaagaagttatacaaaaccaaagtgtagctgttgctaagattggttttgcctggaaagcacattggtttttaggcctcttatccttcatttggaaactttttgtcctatgatttgtttttttcattttatttttcattttatttttcattttattttcatttagttaacattattatgcagttatttttttttttcccaccttcatggcctcgtttatgtcttttatcaatatattttttacgtttataagtcatttactcgactttttttacctttgatatgcaatcatattattcttccctccattatggctaaataaatgataattataatctatagttttcaagcgttcatattttgacagataagattatgcaacaacttggaagggcggaaggaagcaaaaagaaaactccgatacggggagtcgaaccccggtctccacggtgaaagcgtgatgtgatagccgttacactatatcggacaataattggacagaaaattttgttaaagtgtcagcctaatcggcgtaatacgtatatatgtatattatctgcatattattacgataatatacaacaaaacggattaaaacaatcggtatatttcaatttgatatttgggataaggtaaaataaaaaccgaagatcagtaagctcttgttacttttttgttggaatagaggatcaagaagcatttattgctagtatccaaattattagtatatcatcatgttttcaaaaaaaaatgatgtaaaaattgagaaacagtcaccagtcatcatgaaaagtgcactgcaaggattaataacgtaataaaacaagaacgacagtacataaacgaaagaagagataactatattattgtatagaattatcgattctcttttagaattcttttattctccaggaaaactacttgtacattctgtttagctaatattgtagcctttaaccacaataaaatgcactccaagtataacccaaaattcattgttttcaaatttatattaatgagatattggtaacctaaacatcaaaaatatttttactcaaattctcttttctgaaaacgctgaaggaaatgtgcaggaaaaatgtttggccatcaacttttattcctagtaccacaactaacgtcacattctatcgaggcaaatgctaattggcaactaacactatcttaacggtttgataatgtcaacacaaaattcacctattattacaaacgaatctaccggaagttgaaatgcctgacaataatcatacaattgcatgaataattgcgaacagatggcagcaaaggatgaactaatcataattatacattgccgctgtaggtttcctcccataaaaatccaaatttccaagaaaaagttcttgtgtcttcatacacttaatattgttatccttcttcaagaccggactatataaagaaaaaattttgtaatgctattatatttcaacttcaaattattttctactagtagacataatggaacttcgctctcagataatctatggcgatagatggacaattgacaatcttctgaaagaatttatataataagatgtgaccatgacctaaacctgctcacgctcatgaaaggatacaggtaatttggcgaaacattcccaagcttcgctgatagacctatcccagaaagtgtctgtttaaaactacaagtatttgcagttttcgttatccagtttcgttcaagagcattaatgcacaagccacttatattatataaatttaaactttgggaaaatatcatacacctattgtaccagtaaatgttggaataaaaatcaactatcatctactaactagtatttacgttactagtatattatcatatacggtgttagaagatgacacaaatgatgagaaatagtcatctaaattagtggaagctgaaacgcaaggattgataatgtaataggatcaatgaatattaacatataaaatgatgataataatatttatagaattgtgtagaattgcagattccctttcatggattcctaaatccttgaggagaacttctagtatatctatatacctaatattatagccttaatcacaatggaatcccaacaattacatcaaaatccacattgtctacagtaaaagtataccactaatagatttgtaattggtgtatgaagtagtgtatggtataaacgttaataagtgcttatcaaagtattacccgctttaacagtttttgtgtttttttcaagaaaaatattatatgtatgaatatagaacatgagtttatatggagaaagtgtctcgacagcttttaaagtcccgaaaggactaatatcgaataaaagttgcatccattaatataccaataaataaagggaaagatgtccctggaagaatttgacgaagttaaatatgatcattcaactaaacgcctagatacaccatcaaggtacctgctgcgcaaggctagaagaaaccctaacgggctacaagaactgcgtgagtcgatgaagtcatccacaatttatgtaggaaatctttccttttatacatcagaagaacaaatttacgaattattcagtaaatgtggcacaataaaaagaataattatgggtttggaccgttttaagttcacgccatgtggcttctgttttattatatatagttgtccagatgaagcattgaatgccttaaaatatttgtccgatacaaagttagacgaaaagacaattaccattgatctagatcctggttttgaagatggaagacagtttggtcgtggtaagagcggtggtcaagtcagcgatgaattgaggttcgattttgatgcatccagaggtggcttcgccattccatttgcagagcgtgtcggcgtaccacattccagatttgataacagtagctcacaatctaatacgaataattatatccctcctcctgatgcaatgggtactttcagaccaggtttcgatgaagaaagagaagatgataactacgtacctcagtagaatcaatcaatttatatctgagaaagattctacacacagatatatatatatatatatatattattgtatatatacatacctacattatttttaaaggcttgcatgatgctgttatgtaaaaaaaaaaaaaaaaaatcagtgtaacataatagacgtaacacgttcaatgacatgataatactatatatagtaacgataaaatgtaaatggtaatagatataattatatgaatatttaagtaatgcattgataagtgatcaattcatatcagggttggatagctttttcaattcttccagcctatcaattagttttttacggcgtgtaacgggggcatgagcaaatctcttggataattcataatccgtggagcaggttgacgtagcatcgtacatagtattatttgtggcagataatgtgttatgatatgctgagacgttttgaactcgttccactggggtattattcgcgttgtcattaggaattgagtttaccagggtatagtaatcactaaatattttgcgtcttctcacatttatgaaccaattagaaagttgaatcttggttagcccagttttgattaacaactccctcttttcttgttgagttgggtaggggttattcaggtggttcagcaaccaagtattcagtatctgcactgtttcctttggcaggttagacctcctgcccgaattttgcttcctccttgatttagattctacaaaatccgaaaatggcctgttgtattgtgcccccgcatccttttccttattgattatttcatatattggggcggatttgtagcagggctttgcatcatcggacgccgattttgacttctttgaactgccatattgagattgtgtatccatagcactgctactcgtcttggacgtttcaactgtagaagcagtaggagtagcagtagtactagtaccgccagaattaattgcgggatacgcaatcgaatgatgctgtggaagtaacacaggcgcaggatagttttgttcctcggtactagaccgaaggttcccatgcgagtattctatgttcgaaaatgccaactcgggcatactccgtttttctatggagttaaatagaacttggatagggggtagactgacttgattgtcaacattcttactgttcctgttttgtatttcgcagttataattcatcttcgaatgtaactattctcgaaggttgttagcataaaagtaggggctcggcaagtagcgatcagtagcactggataggcgtggtatcgcttgaaaacaagggtgggaagatcaactaaaaaattgtattagtatatatcttgaccaatttaacataatcttaccaattaacagaaacaggaggcattaagagacaagaaaacgccgggcgcgacgaaatcagtcatagaaaattaatcattaatatatacacgctgtaagaaaacaaaaggacaaaaattaattaccaaaagaaaaaaacaaactacagcttgatgtacatgaataaattaaggttcaacaaaagagaaaagctgagagacgtaagatggcagaaatgacccgttcccacagaaagaaatctgaatccgaagaaggaagtaatacgcgcgtgagcggataaggtttcttatctagccaatcacaaaaatcaacagtagtaattctcgtgggattcttttgtgtctcttaaaattgccctttacgtacagtcttcgtccattatcaggacgatttgacagaaaatgagcgagatcagaaatataccgctaccgatcatgagtgctcagaaaaccccgtggataacccaacggtccgaaagtgacagttttttcttttgccgctttactttttttgcgtcttaaagggctgtggctcctctgcgcctgcgccagagtagcggtagggttcttacttcgggcaacgccgactctgggtgcattcgccagtgtgaggaagcacgctgcttgtgcttgttggaagtgtggactaggtcaagcccgccggacactaggaaacacgcacaaaattctcaggcactaaataggccagaagcaaaaagccgtcggtagtgctccttttctctgttgccgttaacggtcaggtctgttaagacacataacgaaaagcatatgtataataggcaccgacatttgtgcggcatattctgtgcttagtttgcagtacaagacgagcttcggaggcatactactttaatcatatttgctcacttttaagttgctcactttctaatacgtgcattcctttacaagcttactaacacattggcttggcacttaaaacactaatgaaacgtgtttaaggggcccgacaatattgctattatgtcgctctcaacagcttgtttgcgaattttaaatttgatagctccctctttctcctcctctaccgttcgacatgactaaaaggcgttggcacgattttctttgatgctaatgtaatcaagtcaagtatgggttgctttgacgatccagatgcagaagtcaaagttacgagtcaaaacctacgagactagacatatctctgcagatgaaaaggcctgttctataaaaaaaaaatcactgttaaagttcagacagaagcttatttcaaggaaagcactgtgattgatttattcactatcgagtttctacaggtgttgaagttcatatatttgcacgtgctcgtagctcttttcttcctttttgagacataaaaatatggaatatcttggcacccgttacaagccgtctctaaaaatatacatggcgtacataataatctccagctgattcaaatatcccgcgcttttcccgtggtaaatactgtgtgtcctattaggctttctcttggcatttcacttcttaacctctaaggtattcaaggggcggaggtgtaataaaaacaagaaaaaaaaaaaaaagaggaaatttgtggcaatcttcctaatataactatgttgaaatgtgtgtactaacaccttatactatctatatcctttgtctaaacagctctgccgataaaaaaattccccgcggagatgtccatactgactaataaaattgtcccgcacaggcaaaaagcaactttaaatgcatgggctcctaatcttagaattaaacgtatttagtcttcctaggcaagaaatctacaagtcataggagtatatgttgtgtatactatagttgattgcctgcataaatcgatgtgtaattttctttcaaccgataactaaaattcgttcgtgtttattccatgaaggtttttattctcaagaaaatagcgtgctgtattttgtaaaattgtgccgagtgtgttagcttgaacctgcacagagctccagtccttgattgcaatagtgtccctgatttcagggaacgtccatgaacgaagtgggtcacctttgtcgacccagagttttggcccgaagataacgttcttgtaaaaggttctatccattaacccttcctccaaacattgggtaacgcctattagggaaagtaggtagttccatgaccaacgattaatggcaatgatagtgggttctatatatgtaccggctccatacataagctctgtccattcgcttttccatttttcgaactgcagtttagtgttttcccacaatgttgtgcccaaaaagacttcgtcaaagtttaccgtatcaggacattctttttggaggtcttttaacgtagttgaaaggaaatctacgtagttcgatatgctgaatgggatgaatggatcgtcaatgagctcgagtgatttttcgacaagatatagcattatctcagaaagtacctctcccttctttttgtctcttagtttatctttgatgaaatcgaatttgtcttctactgtgtagatcggatgttctctattcatgactcctggagatgaaatgatcgcaactggaatcccttgcgctagatacggcgtccagtcgccgaactggtgaacattatccactttaacgttaaatttacggcttgtcatgtttttttgaaaaagatctactagtagcggatgacattgtatctctaaattgttactatcatcccatataccgatttggccgacgtcgataatggtgtatatttcactcttcaatgcctctgttctcttttccatcagctccgtggctcccgcttcattaaattcagagcccccaaaggaaatgaaatatatatttcttagaggcttccagtcaaatttgtaaaccatttcttgatataattggatcagagacagcaaaacgacggttccaaaagaaggatacatagtgccataactagcagagttcctcggtgcagcaataacaattgccctgcccgcttgttccgatccttcaattttaccaactatatcgtgaaccgggtggcgttccctaattgctgtttgcactagtaggtcaagtcgacaatcgttaagcgacccactgaataaattattagaaaactttacgccagtgtctgataatatagctagtattttatctccttgattggcagatatcggtatggatggaattttgggtaggcacttggcttccgtagcatcgataggatctcttattgatccttcccattcaggcgtaagtgcatcaccagtaccatactgcggcaacgcaactgacttcatttgtatcacgtctttgttgtcttgataaggctcagaaataaagataattgctttcgcaccatattcttgagcagtcaacatttgttggaaaacataatctccgtaatgcactagtaaaataaagtcaccgtttaaaagcccttgatcttgcatagaagccatatcgtccaacgatgctttattagcataaatcaccggtatgttgttcaattgaccattatggctcattgggttaaagttctcctcatttaagggaatatcaaacccttctgtatcatcctttgaatatacacgaagtgagacatttcctgggtaattcgaatacgccatgaactcctcttccccagctagccttataccatttttgtcgaacgactctttaatataatgtctaatagcggcatcaccacttgttcctgacatgtggggcatactactaatatactctaaatctctttctatctttgaaaggtctatcgatttccgagcatactgtaaaaggagatcatggtccgagaatgatccatttgaacctcgagcttttccattcggtaacctatcactcgcaataatcaacgctgcaatgatagacatcatcatgatgtaaaatattctcctcattaccataacattacctattttacttaagaacaaatcgaatttctcagaggccagggaaatcatttgtgctagcggatccactacatttttctttactggaatcaccacgttattttcaaaacacatacgaaatcgctggactttctcactaaaggcttccggagcctgcggttcttccatccccatctcttccacatataccgggggttctgatggcattcctatagcttgctcaaagtcctgcgagtttagctcatcttgtgagttatttgctggttcttcaacattcggaagagtagtgtagcccctagtattcaccatatcctttgtatactcatatgcgaacttgtctaatacaatgtataccaaaaataacagcttgaaaaaaatctcagggtcttttcattgaataatctcattctgctattttaagtttttcgtttgcaacccgagactgtcgagctagaaaatttcattgatacgatttaaaaataatcgatgccagtaatagcctcaaaaaacttatgcaaaaatacgagatactataaactacagcttagctaactctaacattattatataaaacaatgggcttcaatatagcgtatgtctagctcacagcatgtgttccaaatacattaaagaagatctcttttgttgttgatactaaccagtaaagttgagagttataacaatgaaaataggatgctgtgcgactttttttatccacagttaggtggagtcgaattccatatatatcatttatcgcagaaactaatcgatttgggccattctgtcgtcattataactcacgcttacaaagatcgagtcggcgtacgacatcttaccaacggtctaaaggtctatcacgtaccattttttgtgattttcagagaaaccactttccccactgttttttcaacatttccaataataaggaatattcttctcagagagcagatccaaattgttcattctcatggtagcgcttccacgttcgctcacgagggaattcttcatgctaatactatgggattgagaactgtgttcacggaccattcactctacggttttaataacttaacgtcgatttgggtgaataagttgctaacatttaccttgacaaacatagatcgggttatatgtgtttctaatacatgcaaagaaaatatgattgttagaacagaattaagtcctgatataatctcagtaattcccaacgcagtggtgagcgaagatttcaaaccaagggatcctactggtggcaccaagagaaaacaaagtagggataagatagtgatcgtggtcatcggaaggctctttccaaacaaagggtccgatttacttactcgcataattccgaaagtttgttcctcacatgaagatgtcgaatttatagtagcgggcgatggtccaaagttcatagattttcaacaaatgattgaaagtcatagactacaaaaacgtgtgcaactcttaggctctgttccacatgagaaagtcagggatgtattatgtcaaggtgacatatatttacacgctagtttaacagaagcatttggtacaattctagttgaggccgcatcttgtaatttgctaattgtaacgacacaagtcggaggaattcccgaagtgttaccaaatgagatgactgtttatgcagaacagacatccgtttctgaccttgttcaagcaacaaataaagctatcaatatcataagaagtaaagctttggacacttcctcttttcatgatagcgtgtctaaaatgtacgactggatggacgtagccaaaaggacagtagagatatatactaatatatcttctacttcttccgctgatgataaagattggatgaaaatggtagcaaatctttacaaaagagatggaatctgggctaaacatctttatctgttatgtggaattgtagagtacatgctttttttcctcttagagtggctataccccagggatgaaatcgatctagctccaaaatggcccaagaaaacagtgtctaacgagacgaaggaagcaagagaaacttaaactttacacaaaacaaaggaatgttgtatccatttatttactgtatttgaatgttatagacctgctagaatcactcagtcatttgtaatatgtaacaacattttgagatttgagtcgtatatttttcctcttgcgctttaaatacgaaatgtaagaatgatctctttcatgccagagttcatcttctgccaaaggttgatcaagctttaaatctaaaatccgtgaggtactcacgaagttgaacatttctatccccaaggtgtccaaactgtggttgatatgttctttgaatggttgcttattttccacagctggaagctcgtctaaccagctgaaatcgatgctcactcgtttctgctcttttatttgtcgtcttatggtttctctcaattccatgatttccgaaactaaatttactctatctactttctctctgtctaaataaattttgttcaacgtattattatcctttatttgatatagtttgagctccatattcttcaaacggtttactaggttgaaattttcttctttcagcttgttaagaatttctgttttgccacaattttcctcatttttgttatttaactctactttgagtgttttgatattctcttcaagggttttcctctctaaatccctcccaataataattttaatttttgtttccaattcagttagcatattttccttttggaccagtacttctttgagtcgaatgttctcttcattcaagcgatcgcttaataacgagtttgaaaaattgccctccttaatattacattgactttctgaatcacttgtttgttgactgggttgctcaggaaatatagttatgttttctaagagactttctattccttgaaaaaatacctctagttttttcaaagaagaaatacgtttgtaatcttgtcgcaaaaacagtgcatctgaaaaaagtatcgttaagatagaggacagggttatatcacaggaaggatataaaaataacctattgtcttgtttcgaaatttcttcctttccgataagtttatctattctggcaataagtgaaagtgatctctcgtaaagggaaccaataagacatagggtatcattgtcattgaaattgctgttcgttctaagaaaagccaacagcttcggaacagttgtttccaatatcggatgaagtatttttagtatcaaggtcacatccttatctagaaacttattatcttctaaaaactgacaaatggaaaaggcggtttcctgtttagaagaaaacttcctttgcaaaaactcgcttagccacatcgaaatcggagcaatatttactttgaaacattgtaatgtcgtttccaggtgatcgggagtattctttatggtgtaaatatgaagcgcataactgatagagctcaacacttttagaattatatggatttcaatattctccaactttccaaaattttcactttcgattacttcggctaaatattgcaattgagaggaaagagccgccaaatgtggttgtgcaaatggctcatatatttggtaaaatttctttagcaatttattttgatataattcctcctgtaaagtgttcacttttagttcaagactttgaaatttgtgagatgttttggcttcaatagattccaatgttgcttttaatcttgaattttcttcgatatatgtgcctgctatctccttttcattttccaatgcagattgcaaattacttaattgcagtctcagttcttgctcgagttgctcataggtaattcttaaattttcatccaatttttcttttgcctgtagttcctccaactcattgtttaaagcctttatattacttgtgagtaggatattatcattagtcaatttatcaacaatattagatgatttactttgagcttcaatctgcaaggcaaggtcgccgattgtattattagtctgttgcaattgcagacctaaatccgatatttttttagataatactgcattttcttctaataactgagtattctcctcgagcaggtcctcttgcaccttcatagctttatcatatgacaactttgtttggtcgagtagtccctgaagaagatggctcctttctaacagtgtgcctttgtcgagatccggtgccattacactatctgaagcatctaataggtgattgaaattatccaaatgagttttcatattaccattttccactttcagttctttgactagtttatccaatcttgagattttagacaatagaacagtttcattagtactcagcttttcaacggaagttttcagctcatgattttctattttaattttatttaatttggacgccaatgattcacattttacttgtagattcttaattgtttcttgcgctgcattaccatttagcaaactatgctcatcgtcatctggtttataaaactgcaacgtatctttcttgcagaaaagaccataataaccaccatttgaattagctttcttcaggtcgatatcaaagtaacgaataccgttagcgcttccatcattctttcctaacggtttatctagttcaatgccgtaccatatgccttttgcaaattgagtttccccaatgaatttcacccgccccttcatctcgttgactagaactgtgtcctgtaagcttatcttctgcatatttgtgtcaacttgaacacctgcattgcgcatttgtccaaggctgtactgcgaggttgatggagatcgaatctagaatagtattatgtactttgcaaaagtaaagtacaacataaagtctagcagcatatgagtaactctctacagttacgccaacaatctcagtgtggaggttagagtaaaaagaaagcaccttacaactgtacgtttacataagtgacttttcaacatatatgcattttttgttaagcattgtaaaatacccggttgaaaagcgacatgaaaaataacgacatgttagattcaaaagtacctactgctctttaacagctacttaaggattacctgataagagtaatccaccgtaaagaacattatcagcaacaaaatttgtaatccatcatgtctggaagctatcaacatttatcaaacgttggatcgcgtgttatgaaaagattggggaatcgacccaaaaactttcttcctcatagtgaaaagttcattaaaaaatctacgcctgagttcatgaagtcagatttaaaggaagtagatgagaaaactagtttcaagagtgaaaaagaatggaagtttatacctggcgacagagtagtagtaatgagcggggcttccaaaggaaatatagctgtaattaaatctttcgataaaagaacaaattcattcatattagatgagaatgggcccacaaagactgttccagttcctaaacaattctggcttgaaggccaaacatctcacatgataacaattccagtttcaattttgggaaaggatttaaggctagttgctgatattgacgatgaaaagaccccaggaaagacaagaacggtggcagtaagggatgtttccttcaatggttcctactatgatgcagactacaaaaaggtaatgccatatagatgcgtaaagggtcaaccagacttgatcattccatggcctaaaccagacccaattgatgtgcaaacgaacttggctaccgatcctgtaattgctagagaacaaacattttgggtcgattccgtagtgagaaaccctattccaaaaaaggcaataccaagtattcgcaatcctcattctaagtacaaaaggggtaccttgacagcgaaagatatagctaagctagtagcacctgagatgcccctaacagaggtaagaaaaagccatttggcagaaaaaaaggagttggctgagagagaagtaccaaaactaactgaagaggacatggaagctattggggcgagggtttttgaatttttggaaaaacaaaaaagagaataaatgtaccaagtgtatgcactctatttttatatttgattctctagtgtgatttttttaatcagtatatccccttcactattcacgtagtaaataagttatattcgacctgtatatatgaaagcataaagtaaagttcaaagaatattcagatattgatgtgggcaaacgtgatgacttcaaattacaaaatcttttctttaaaaataaattatgtgcgtatgtacattatttttaaccaataaaagggtttaaatatttatttacaagattaatgactgccctttaagcgttgtctctttatctcattgtactaatgctaaaatcgttcctgtggtcgctttgcttcaccaggatatatccaatcccagcggccttttttatgtataatggctaggattagaattgccggtaggtgcaatacactagccataaaagttttccttgcataaatgttggctacacttagacctttattaaacttgacgttatcttttaatgtttttgcagaatagttgattctttgttgccaatagaatttgaaagcccagaacgttagccaggcatttataagtccggaatctatttggtagtaccaatctgtgatattaaaataagacaatccgaaacataaagggaacattaggatagagtatctcaacgacacacgggcgtttaggagcggatttttccatgcagtcataacgtatccggcatttttgtattcatttctaatgttatgactcaacgtattaaagtgtgggaattgccaagcaaacaatagaccagcaaggcaccaagatcccggatgtgaaagcggacttgcggctgcccatcccattagaggaggtaccattcctactagggcacctaaccatgtgttaatgatatgctttcttttcatagacgtataggcccagccatataacgcgatatttgaagcaccaagaatagcaacggtaggattaacaccaaagtacaagatagatactcctaatgttccgataagtgcggcaaactcgaatgcctgggtaggtgtaacatcacctctaacaacgggcctcgcctgagttctcaccatttgtctatcaaattctggctctctgcccatatttatagcgtttgcagaaccggaacacaaagtagtgcctactgttaaacataacaattcattgacggaggctggatatggagataaagcatacgaacaaatggcacttaacatcactagaatggtgagtcggggcttggtcaactgaagatatggcataattaccttcttctttaaagttttcatattcagcccttcgctgattgcgtgagatggtctcttagattttcttaccatcgggtctacaagtttgacattaaatggaagttgtgtgcttgcatcggtagtagcttcgcttccacttgaagttgatatatcatctgtgcatcttagcgttttcatggcagtcgattcaacctttttattgcaattagaggttctatcaccatatccaaaattgggagtaaattctatcggcgcagtgtttatatgttgctgtttcccgccatgattccgactaatataacgaactccattaaatcgaatttttatttgagtatcgtgcagctgtgtaccaatttgtaagtatatattccctttattatgagcaagaacatttctcatcaagtgagcatatgttcgaggaaagtaactcatctaaagaggaaaaaaggagaaatcgaaaaaaagagatactataggcctaaaataaaaagaccccgctatgaggaatattaatcacgcccgaatcacgtctattgcagatatcaagaattttcttctttgattaatctcacttgcggtggatttacgtcaatgggcttgcaagcataaaaaagtcattttattattccctttgaacagcgcgcgggcacgagaaagctgccctatataaacaaagatcgagtctttttggcttggatgatgtttaaaatactttaaaaagtgaagacaaaaactatctttatttccttaagttataattattgatgtatcaaatataaatatctatatgtgagttttgtaattaaaaatatggcaggaatatgaaaaatacataacatcaatgtctttattcatgatttcagttcttgttccaacctaaatctactgcctcttcatatgttgggtagtcggtataaccttccgcggacatggtgtagaaggtacttctgtcatacttgttcaatggcaggccctcttctaaacggtagactaaatctgggttagagatgaagaatctaccatagcctatcaaggttctgggatcctttacttgttctctaaccacttctggatgaagagcgtaattaccagctctgatgattggacccttccatatagagtaggcaaaatcgttagtaccctcggaatattctccttcgccctccaccaacgatgggtccgtgacacgtggttcaacgaggtgcacaaaggccaaacgcttaccagcctttgccctcttctctaattcacccaaaacatacgaatattgagcgataatacctggttcagcacccccagacatactgttaaaagtgccgtacggcgacaacctcaaacccacccgttcaggaccgatagtttcgataagagcatcgacaacctccagtgtaaagcgggccctgttttcgatcgttccgccgtattcgtcggtcctcttattagaatgtggatccaagaactgattcaacaagtacccattggcgctatgaatttctacaccatcggcgccagccgcgatagaattcttagccgcatggatgtaatccttgatatactgtttaatgtcgtctttagtcaaactatgttcgagattattcgcatctttggccttttcttgtaacgtagcattcatatacactctgtcagatgcacagtcatagcgtaacccgtctcttgccaatacgtctgggaaggatgcccagcctaaagaccaaagttgtacccacgcgaacgactgacaatcatggatggctaaaaagatattcttccactcagcgacctgctcatcagaccaaatcccaggggcgttgtcatagccgccggcttgaggggaaataaacgtaccttccgtgatgatcatggtaccaggtctttgagcacgctgaccataatacacagcagcccactccttatttggaatatttccggggtgagtggccctcattctggtcaatgggggcataaccgcacgatgtgcaagctgagtgttaccaatcttaattggttcaaaaaggtttgtgtctcttagggagatcggctcaaaaccttttacaaatggcatcttctaaatttaaacttcgctatactgaactacagttgttgtatatatcaagtacgtacttttttgcatatgatgggcaagaatcaagcacagttcacaacccttatataggttcgagttgtcctacttacaacactgtgcttagtaatggttattgcgactttatccttgttctgaacggagttatatcaggaacgcaaactgcttactaaggagcccttctaaggagccctccgcaaataataggatcggcaatttcagacggaggacggagccgcctaagtgccaagaacattaaagaagaaagaaataaaccttgagcggctacacgaaacagtggtcaagagtagaatctctgaaacgtcgaaccctctttgtcagttatcgcgggcatattctgagaagaagcaatatacaacaaacgagcaggacagattaaaattttcaaggcgaggtaagctgtgccagatcagtgtgggacgacgctcagtagttggcgatcgaagcacgtgatcagttttccacatccgtgatttggcgcaaattaccatgtgagcgtgcgggaataagctcctttatttgcggagcgacaaaggaaacgagaccatattaccctaccttccttgttttattttacttttttttctaattttaattttcttcgttccttcaactgtatgtaccctttttctaccggaaataagacggtcgtagtgtccgcgtttttggttctttaacgacaagacatcagtgccttctcgcatttttgttgaattgtattgtattatgctcgatgtttccagaacgatatatacatctgagagtttatatatcaacgatcattttcttgttgcagtaagctataatagacgcgtcaaatagtctaaccagtctaaatctcatcagccacacacacgtacatcggaatattatagagaacaaatgtccttcattaaaaacttgttatttggaggtgttaaaacaagtgaggatccaaccgggctcacaggtaacggggcctcaaacacaaacgattctaataaaggtagtgaaccggtagtagcgggtaatttctttcctaggacgctttccaaatttaacggccacgacgatgaaaaaatatttattgctattaggggcaaagtatacgactgcacaagagggaggcagttttacggtccaagcgggccatacactaactttgcaggccatgatgcgtcgcgtggtcttgcattgaactccttcgatctggacgttattaaagattgggatcagcctatcgatcccttagatgatctgacaaaagaacagattgacgcactggatgagtggcaagagcattttgagaataagtacccatgcattggtactctgattccggagcctggcgtgaacgtatgacgattgagctccgcacattatttattaatagcaaacaccaaggaaagggaaaaaggaaggggcgtggtggacgatgatatatgtatacatatacatatctatattttgaaaaaatcttctatataacggttgtatagaaataattacttatttatgaattagtacaaaatatacaaagcatgctgctgttcggaacgtgacgaaaacagtagcttaaactgtatattttttgtgatactgtgcggctgaaacagggaacaatatcattagaactgcacaaatgcttctctagggatgccattcatgctactctgaaaaccctttatggcaacttcatagttccagttactttgctcggccaacataaacgtgtattctgcattcaatttcgtttccaaatgtagtttattcagcagctcgagttgtacgggatttagccgcgactggacatctggaggtagttgcaaagtgggagccatgaccatggctccttggggtgcgccgggaatgctcatccctcctggtaccactgaaggttgtggctgcggtggtgtcgttatatttgggttcatgcttgcgacctgtggtaggaccgaggcctgttgctgtggaggctgtgctattgcaatagatgcagttttccaagcgcctgtggaatacgctcttacagttaacagatcagatgcgattatgacactattattcattggaacaattacccaggttctatcaaaggattttttggataacttattatttgatgtggagttgtaaccatgattgtatcttctattcttttgatagttatttttccccgtttttttattggattccagttcaggcttgccagtctcttcaaaaaatccgtgcaacgtaataacgaacccatttatttgaggataactaattgtttccattgagtattcattgggttgttcttgtaaatggtgctttgttttcggcaaagtcttgaatatactattaatggactcttgcccgattgacaatctctgctggatagatttttcactggacactttggatatattacgtgaggacgacatgtaataaccaaatgctggagtttggtccgaatctgttaccgtagatggaggaatagtagaatccacggaaacagaaaactgggattggggcgaatacaaatttaacagttgttctctattattatcccatagattcaaaaagttagttgcaaagtctgtagatgattgccctaatgcatcgttttcgaaaaaaaactgttgaatcttcatcggtaatgagtaaacggtttgcaatttttgttcgtctctcacaatcacgttatctagtacaaccaatttcggaaataatcttaacatttcagtgcgatacaacttatcggtggttatcgggttatttgtcatcaaaagctctcttagatctttgaatttgttcttccaaacttctagcgatctaaatctaaaaatctgattgttggccagacagaggtttttcaaattaggaaatgtttgagccaatgtggaaattgctgagatgtccttaagttggttgtcagcaagattgacactttccactatcaaacttttttctgtagaagccagtttcatcattgctggaaacatcttagactgggtggagatggaactaaagacgcccttttgaattagctcgggatctgaatgtaaagcgcccaaatttagtaattttgtttgtgggtcatacctcttaaggagcacccccctcaagaacgaaatggtgtctgaagttcccgcagaggccccattgttatctaaaagttcgaactttaaattactgcctgcaaaccggacaccgttccatttcattaacgattctgcttctgcctttgagttgacatatccaataactaaaggtccttccacatgagcgtcataaacagctactcgagcgttgcggcttataaaattaatcaaatcgttcatggttgcattctgccagttcctcacgctaatctttattctattttgttgcatctgctgttgagccatcatattgatatttccaacattgtgaaatccgctcattttttttgctgctattagcgatgcagaatttttaacgatttattttactcttccttcttagagtaagtatgtcttcaacagtctgttactatttttttttctacatactcaattcagctcttactgaaattttcttctggaaaaaaaaggaagacgggtaatgatgatcttatataacagtataatctgtaggtatatttatcgttagaatcctctacgaaaggcaagtgggcatggatttctagcttttgaagccgcgtttaagtttcttcagaattaatattcgtagaaattttctgttctttgcttcttttctgagctttggtggaataaacttggttccattcaacttaaaggaaggaggaagtactgttcaaaatgacagttttatacacatctgcatcgctgaaaaaaatgaagtgcttggcattcaacatgggcatgaattgcgtacgaacagtatctcatgcaagaagtggaggtgcaaaatttggaggacggaatgtatttaatatatttgactcaaaaactcctgattcagtgcgtataaaggccttcaaaaacacaatataccagtctgccatgggcaaaggtaagaccaagttttctgcaatggaaattaatctcataacaagtctagtgcgcggatataaaggagaaggtaagaagaacgcgataaatcctctccaaactaacgtgcaaattcttaacaaattattactaacacatcgattaacagacaaagacatattagaaggaatgaacctggcagccggtcctgtcaatgttgctattcctcgagacataacaccgcaggaagaaaagaagaaagttgaactaagaaatcgaaaagcagagaatatggatcttcacccgagcaggaagatgcatattaaggaacttctacactctttgaacttagatatgtgtaatgatgaggaggtttatcagaaaatatcactttacttacagaaaaatgaggaaagcaggacttcagtgggtgcctcgcaacaaaaccacgtagatatcgatataaactccctaaaacgctatctacaaaatattgaaaagaaggcacgtcaaaaaagtgccatcgataaacaaaaaaagaatcaagctcgtatatatcaatggaatactcaatccttctccgaaatagtacccttatcagctggaaatatcttattcaaaagggaacccaatcgcttatggaaacgtttacaaaatggaataagtgtatttttaggttcaaacggaggaggaaaaaagagtaaaactactaaaaaagtacttcaagggaataacatattgttacactcattagaaaacaataaggatatgaccctgtcaaacaactttgatcacagtgtctttaacatcaattttacggacttatttggcgttattaatgcatctgggtccccaccagatagagttttgaacgaaattaatgagatcgaattaaaaggttggaaatgtgtggggaacttatacgataataataaaattgtagtttttcaaagtagcaatccactcttagaggatacgaagattcctcaaaagtctttcactaattcaaagagattccttatttcactctcagcattgctggcctccttttttgcatattatagataccgtctatctcaacgtcaagaatcaaagaaatgatttttttctttcttgtatataacaacgttatacatagaaacaaataactactcatcattttgcgagacatatctgtgtctagattaccaatcatttagagatattaatgcttcttccctttgaacagattgattatctctcaagtatctttctgctttgacacgagagtaaaatactggacagtcatatgaattgcatttactagctatatggtcattttcgatgcctgcatcggaagtgtaacgataactgcacgtcctgcacacggtctttagtgtttggtattctttttgtctctttaatttctttatgagaaatgataaggttgtggtgcttcttttctctaaacagtcatcacataactgaagtgaacatattttagtcaattcttcaccacaattacaacatgttgcagaagttcctactcttgttatgttttccacttttgtagtagttgtgctcgcccttttggattttactatttcctgagcccagttgccaacatttataccaatcaaattgaacaatctatcaagaggaggtatcagaattttgtttatataatactccgaatctaactctaaattctcaccttctaagaactcttctggtgatacgcatctttcccgaagcagttgtccttgctttcctttaacaacaaggtaaggtatacgctccttgtattggggttctgctctatggtcttcatttattcttctttttacaaccacggcacctgcaggggctgtcttttcgcttttatacgctcctaatttaacttcttttgcaaaacaaaaatcttgggcagatacctttcctatttgaatcttaaaaaattcattttgaagatacttttttatttttgacaggtctttggtttgaaaaagtaatcgaatacatttttcaataatcttctgctgggctgggataccatcccttctaacagtttcaatacccttagcatcaaaaataggaagggtctgcgaaggactttcataggaaaatcctacgtacctttttttgctaattaatatggagggatggtatactttttcaaacttcaaaaagattggttttggattgttttgagtaactctttctgccatagcatgtcctatagaaaaagcctcaatagcagtttttccaggtagatatacaaataaactatctgtgtctccatagacaactttggcgttccaagtttcatctttctcaataatatctattgctttctccaatgtttctctgcctgtttgtacaatgctatcagctaaatcagagcatggcattcgtccagaaaatgaagctgatgtataaccgtaggtgacattcgccaataattttagtgctaactgtttgttattcaaaagcctttttagggtagtgttgtcatcacctatttcgttcattgttttctttatcatcactctgacatcaaggatatctgttaacattttggataacgttgattttctaacagaggtcttggcataaacaacaccatttggagcgatagttacatcattttttaataaagctaaaatgtttcttggtaatgaaaacttagatactccaaggttattttccgttaagtttatttctcgcactcttcctatcatagtcgaatagcaatagttgtatccaatcataatggatggatacaatgattggaaatccagcacaattaaaggacttttgtagaaagcagattctggctccataaccaaaggcacacattcaagtgctttttgcttacgaacatcctttttgcctggagaaagaaggataaaactttcggacttgcatattcggattaaaaaagactcaactttaaattgtgatcctctgtaatatacagaatggaaatctattcctatcaatcttgcctgttcgatatttcgagcaatgtaatcctgctttcttaatagttgtatatttatctgagctcttgataaccaataatttaacacagtctttaattcggttgtgctctttttagcgttccacatattagttaatgactcaaatgaaaagtgaggtaatcgtttatggaggatattgaacgcagcactttcaatagtatattgcgttaaatttacgtcggacctcaacgctctccatatattaatcatatgtcttccggtaatcataattcctgaggaatgggcatatccccaagtatctgacaacttcgtcttaatttggcatttgactctggcaagttccctgacaatgtcaaattgatgtattttttgacacctttcaattatataaccccacgaaaaattatgtatttcgaaaccggaaagaatatcaggatcaagaagtaataccaaatcagttagagcctcaaacatttcaaattcactttcatagaacatcacgggaatttcgttaatacaatgttgaattttagtaggaaatgtactatcctcagaagctttgtggactatcataatcccttcgtaagcgatatccaaatctaaagggaaagtttcttcttcaagacaccatataatcatggaaacttcatctattgcagggtctggaattttatcacttctcgtgtttgcatgaatctcaagtgtcagatgagtaagagaatcgtgaacgctacttttttttcttttttgttttccagaaacgtcactagcaaatttgtataaaaacttactatgaggggtgtgcatgcttatctgagactcagtttttttgtttcccatcgagggtactttattgtaccatttttgaacagcatcatacgtaggtggttttaacgcatatttccaggaggaaaacatgtcgaaagttggcttgttataaactgatacggtctctcccccaaattggacgggtattctcgttgatacatgtgtcgagcttatttcaaacctcttacctgcgtacgcgtaaggtttattttctagatcaactggattcgaaaagaaagggtccttatagtctatttttgggaatccctcgtcttccaatttattcagaatatcttgataaccgaaaggaggctcaccataaacaaaggctctttttccatagcgtaatcccgcagccataaccttctttcttttccgagacagcaacgatgttttattagcagaaacagatgatctaagttttcgtttacttgccatattttgcgtcatagcacaatccattgaaaaatttatcgtattgtgatattttgtttgatgatctaatagtatagtagaatctttcggagacgcaatgctttccggtaaccatgaataagaccgagactttatattgcttccttttacaccttcgttctcattatcaacaccacatatctcgtattcggtgaacgatgcattaacttggtcgtcgttctttttatcttgcatactattattgtttatttcaatctgtggaagccttggccacaattgcggtaatgcttcatagggcgtatttatggctgagaatttttgattcttatctataaagttctcaaaatttggtatttgaccatcaaaagtacttgttttatgttgtgctttcttataaaacgcttcgaactctccagaagattgccattgatgaccactcacatggcgctttgtttctggtggttctttatattccttcaaggacaactcctctcgttgcatggtaagttcatttatcatgtccctagcagaggatacatatggtttgacaggtatgtcagaaatatctcccagtttttccaaaaagtcgtgatgtatatctctatgctgtaacttttctctatttttgatgaattgcggtagtatatctatctcaatcaatccatttccaacccgtggaaaatcccttctactgagtacgttacacttgaagtcacaaaatcgatctagtaacaactgaagatcatcattaattgtcagcttatctatgtccagtatactatttaaaacaggagagcgaaaataacacctatccacgtttatccatgaacatccaaataagttaaaatctgcggtccattgtagcaagtaaggaatatgtgattcataaatttcgaatttctttccgaaaatcttgccatctctaatcaattccgaaatcctacttagacaagaaggattaagcaaagaaattttgtaaaacagattccagccaacgtggtaaccataaaatggtataccctttacaacagagacatcagcgacaaaattgagatttccaagtttgtcgccggctaaatcgtgtttatcatcttttttccttttaaaggatgccctaatttttacttccagcgttttatgaacttgggcacatctttggtgtctcaatgtactcgtgtcagttatttgtccatcatacttgatgaacatgtaaggtagaatgccatggacgtggcacaatacttgatgccctgtgggtaaagcaccaaacaccctgatgtttgggacctgtgaaaactggtttaagggcaggctttcaccgtgcgatgggtccaaaaaggtgggttttgacatatagtagtcttgattatttagctggattctaaaatagtctgatttagaggatgatctaaccgtatcgctctgtattgtgtcgttcgactccctcgacatttccaaacattttatttcgccacaacttgtagttttgtattgactcaaatactttctcttgttttgtgcttctattacagagatggcttttttcttcaagtacactatttctagacgcactgcactcgtcaaaaaaatgattcaaggtgaaaataaaggggtgttagtgaatacttatcaagaagagacatacataattgtactgctgtgcattttcctacttgactttcatgattatgaatagtacaaacacagttgtatatatcaaagttaagggtaggagaccacagggattcttggatcctcccaaatttgagtggaatggaacaaaggagcgacagctttggacaatggtatcaaatttgaattattcacaagatcaaatagattggcagaatttatcaaaaatatttgaaacgcctgaattttttcttaaaaagagaacatataaattatttgctgaacacttagagcttttacaactacaattggagaaaaaaagagatcttgagaagtattcaaatgatcaagtgaatgaagggatgtctgatttaatacataaatatacccctactttacaaaatgataatctattaaatgtatccgcaagcccactgaccacggaaagacaggattctgaagaagttgagacagaagtaacaaatgaggcgttacaacatttgcaaacttccaaaattttgaacattcacaagaaaacatcggatagtgagaataagcctaatgacaaattggataaggatggtattaataaagaaatggagtgcggtagttcagatgacgatttatcttcgagcttaagtgttagtaaatctgcgttggaagaagcgctaatggacagattgcaattctgatttacatctttcacaagcacaatcaaaaaaccaactgtcggccaaaaaggcccggcgttttactgttggtaagtccagtaccccggaataatcgatacagatctgctcatccttttttatatctctattcatagtgaatagcattgaattacctttacgatatttcgttatattggggttacaagagtggttgaaataggaggcttctggaaatacccagtatccaaaatattctctgctgtctgaggcttcgccctcttgccataaaccaaaagcattcccatattcagtacctaatatatgtctcaatagcggtatggagagcattctatgcaaatgtgaaggtaatagaatatagagtgtttgaaatactaatttttgaaagtgcagtaagacaggaaatttagatattttgctaagctcattcgattgtaacatattgaaagctcggtatgttatgcactgaggatccatatatttaagattaaacaaactctcgcacacaaacctaatgcagcaatattcatcttcgcaagtgggtggtaattgatttattctcttcgcagatttcatgttgttgatgcgcggtatccatttactttcaatctcatcccatgaagactgtatgacattttccgaaattaagatagagtttaatttttcctcctgttcagaggtataattatatcttttcagcatgcttggaaaatgatgcagtaatatctcataacattcaattaattcaatgatatttggtatttgaagataagaagttctgcaatgttctgaacagaaccacagtccagcgcccagaaacttcttagggttaatttggtagtgtgcattacaaaccaaatctctcaggtaatcgtagtttagtttgtacttcatagttttcgcattagcgtatgcgaaacaattgtgacaaacttccttcctgaactcataggaaatagatgttcctgtaaaattactgacttgcaagactgttgtccctttaggaatattaccattactgaaacaagccctaccgccccatttagtttgcctaacctggaaaaatggggaaatttcatgtacgtctccatcaatagtcatttttaaattttaggttattttgtgtttgcatatataaatggtatatatatatatatatatattcatataaatctagggctacatttataatatcagagatacataaaacggtaatgcaacagtggagcagtattgtatcgcacgtttcttttttgtttttgttttttaaatttttccaggttttgacaacgtgatgaggtaatcttctgttttgcatatccgcgcaatttaaaatgcaggcgacaaaccttgttccaggattaaggttctctttacttcaattctgcaatgggtaccatagaaggtctcccgtgggcgcattcgaatgggttatggcatcgcgagagcttgctaattaaaattatgcactcttgccgggttaattcatctccaaacataacagcagatctgcatgccttgctgttaagaatttcatgaaagaccgttggaacgcagcttgagtacttccaccaatataatttatcaaccgaagtgtagttttcgaaatgggataaatccattggaagttttttgaaatccttcaggtcatgagcatgttgcagcaagaccatttttaagtagtctttatccccgttatatttggaagttaacatctcaggcagtgttttaatttccaaaagtgaggtttccattgttccctcaattgtttcatagccaattccccactttttaaattcactttgataatgcttaaataagtcagcctcagtacgatcaacttcaatgcaacaatccttgaggtctcgtgcaacaaaagttccggttacaacttctgtcaacaggctataaaatagctcttctagtcttatcctctcatcgcaagcatgttgatcaactagaactaatagtgggcaattatgaatagattggtctaaacaacgtatgagaataaattttttatctacttgattaatcacttcatattttgccaggacagatcttgatattgaaaaatctgttatggtttttcctatactgtcataatcttctgtaaaaccactatcgtagggcctggaagagagtttattccgtaaccttgatttctgaccgtcgattcttatattcttgattttttcgtagtttattgtactattgtttattctacatccattgacagcgggttttcctatgtatgaattaatgcgtgcaatcttcatttttgaatttaatacttgattacgtttactgatttggattcgactatcaggcaatgttgccgtcttctgtgaacaattgactatttcgaaagatgaatctgatttatcaggcgttaagtatccttgaaatgtcagaaaggagcgaatggtcttaacgatcaatggttcaatggtacgtatatgggaaggcttaacaattttctttgctggatcttgtaacaggtcatcgatagtttgggggcaccgaacatcaaggatgaagacgggatgtgatcgatacggttttcccacgcttttagttttgagtaaactcatgcctttctccccgaaatcttgtgcttggaataaagaatcgacgtatccttgaaaggcgctgtccgcataacgtctgccattgatatatataaattgaagatccttcaatccaacgggcatcttcgatatgatcccttcaatctgatattcattaaacttcaaggaaactttcttaagcatatccggtggtattattgccccaaacacatttctcagtacttgagacatttgctggtgctttgttaacccctcagttatgttctttgagcggaaaagaacttctgtattgattctgagtttgtctgtatattgtacgttgagtgaaatcatcgggtgcattaccagtatctgtagcatatctgcctttattgtgttaaaagtcttgaaagggggttcttcctttagtattctgcgccggacaggtaaattatacagcatatcttcaacaataacaacagtaccagactttgttcggctccaaggacaaattttccaaaaaggatctattgggagtatggtattctcactcaacatgacgcttttggatggaaattttctcatccatgcagagttgtaatcctttttcttggaacaaacaaacagattagagacattagaaatgctatatagggcgtctcctctgtaaccgtaggttttcatcgttactaaatcattcatctttcgtattttggaagtataattttgtgtggccaatatatttaggtcacttcgagtcaaaccaataccatcatcgtaaactgcaaagctcaaattagggaggtcgatcatgacgtcgatagtggtagcgtgtgcatctacagaattttgaactatttctctaaccgctgatgctagcgataccgtgcatgcctgagatttaagtctttcagaaacatcagaatctaatttcctaatatgctggctcattttctttttgagttgacgagttcacgttcattcttccttgaaagcctcgctggtttatgtatcggtggttgaaatcatcattcgatgtttattgcaaactattgatctttttttcctgccccttctcgtggcgctcgcaaataaacgcaaactaaatataagcgtacaaacagacagattttgtgctacttattgattatttagaaaagctactattgttcttgaaagtcataatagaactacttatatatgtatcaatggggttgaatttgcgctttatgtattttttaaggaatgatatgaaagttgtctctagtctatttattgaatcgtaaatcaaaaaatactagtgatcccatataggataactagtaaaggtttcgttaaaagtagctttttttctcgattcaacgtcacgcattaaatgtgggtaccgttgttagcagaacctgtaacattactagcatcggcagttatagtaacgtatttaacaacaggctccgccgtagtagtaaccacttcggtaactgcagcagctgtaactgtaacatacttggtagacgcactacagtactgttcatcggcggatgtggtttgaatcatctgagattgatgttcagcagagactaacttttctaaggcatcaacattggaggcggcgtccccagctgtggatgtcgctattgtattactagcttgggaattatatacagtaaccaataaggttgaggtcaaagtagaggtgtatgtactgcccgattcggttactgtagaagcaatttctgtgacgctcgtggaaatctgttcagccttctcgttggcggattccgtagatagagttattatgtaagtagaggtcagagtagacgtgtaggtggtgtctgtgtcagaataggtggtggtgtattcatttgtggacgtagttaggctaggcgtgcttgcagtaggtgtacttgcagtaggtgtactaataatagcagctgattgggaggtagtgaaccagtaggtagagtaaaaagtagatgttatgtagaaggtggttgtttcatcgctgtacgttaatgttgtctcttgaggtgaaacagagtatgttggagttaatgtcttcgtgtatggtgtatagctcgtagtttcattgacatataaggcagaagcgaagttggaggttaccagtagtaaactacacaatattttgaaaatcattgcgatatatattctaatttgttggttgtgttagacaactagtgtacaagaaagagactagatggccataacggatcttgataattcattttcttacgtcttttaaatacactccctctccatcacatacagattgatttaatgtctacctcttctaagccatctgaaattcttgggtctttctctgtttacggttatttgaaacacgaaattacttaagaacacgaaatgccaattattagcgtcgcgaattgaatatccaatgcggcgggaaaatcaaaaaacgaaaatagaataggaaaaactgccgtagttatagaatcaaacctgagcgccagtttcattcttctagcggagaatgctttcccaaacaataacccacagattatgtgttgaagagtctaggcttgtggaaattgaaatcaaaatgtttgttccctttaaaaaaaatcaattaagcaaggaaaggaaataaacagtgcatgctttccttatccttggaatactatattatgctaccatagctggaaatgttgttatccttgttaggcacttcatttgagacttccgataaatcaggaatttcgtcatttaggaatgtgttcgtttcaaaattctctgcattggttatcgttaggctctcagaatgtaacctgatgacattgtcgacacaaaagtactggaagcaattcagtaagataggaaagacaaacatgaccagaaaaacttgaaagtttggccatgaatctgaccagccaaggataagatcggcgaaccagtatgccaagtcttctaagtagtttagtattagaaacacgcagaacttcatcacgcccagcccaacaatgaatataagcagctgtttcacgaaggcagagaataagggttttctggggtggctcccaacggttttagatggaaaataattaccactttcaatgttttggaagtgtaaggattttagcactttttcaattatgtataagcacaaccaaagaatgggaatcccaacagtagtatccaggagtaagttaagaaaataccaatcgcattgatcctcatcatcattgccttttgcagtgattgcgaagagtgaccttcgtcttttcttcagtatgctgatgcctagattcaaaaaatggattccaagagagccgatgatttgttttccaatgtcataactccacacaatcatttttctccttggatgctcatagtttcttttcaccaataacacaatcacggctgtcatacccatcaatgtctggacaaaaagagacacgggccccaacaactggcaagtgtctttcccattagaaacatacatattcttttcgattaattggcagttctgctgaacttgtgtgactgttgggcctcctgctaatatgtattagaactttttctgcttagtacattcaagtacttttgtgcagatgttcgcatctgcaataaacttttaatctcccttccactctcatcgtctacaaacccatacaccatttgtcaagcacatgcttaatccaacaatattcaagatttaatatttatatatatatatatatatatacatgcagagggaacgttttctcccctcgtaggtaaggcgattacgtgtctaaaagaacgattttgcaagcgcttctaaattttgttcctctggcgttaagcatttcgtatttttcacaatgtttagtattatgcccgctataaatttcccattgttgaaacaactctcgctacccttatctttattttctttaaatgaaagtatggtctctaatatcagggttaacttttgaatgtaatccttgaatagtatattttcaatcggattcacgtcagctgttacacttgaatcttttaaataaattccaaccgtttttgtgatatgaaataaatctgagatgcttagttgttctgcttgacctaaattttggaatttgaagatcgaatcccatagggatgtaatagcttctttaggaagggctttcttggacacaagcagcttatccatcgcaatacaggacgttaacgttccatgctctgctataaaagagataattgttggatcactgcttattgaattgtgtatttttgaacttggaagcaccgttaaagttttgtttaataaatttgttaataacgatctcaggttgttataatatttagtttgctcgtgacatcttctcataatctgaaatagggtgaagaggtccttgatatctagccacatggtattttccagatttaacagcttcctcagtaaatctaggaatccttgatattgtagtgggtcttgtagcaagctaccaacttgaatcaattcactaagagatatgagcttcagtagcgcgacagcgtcacttttggatgcaactgagttacataatatcatcaaagctgcggctagggcataactacttgcggaactcttaatagtttcgatacataatgattgctctcgtttgttagagtttgttaggttggcggagatgttgcctgcgcacgatatgagtcttctcattacaattagcttattattgaaggtttttgattctaagcaaactaaggacaatattaaatttttttgcatgcttagcacaagctgctcctcattggtaaagtttatagtttcatccttggctacaatagtttcaagacatgttgacagatttaatagcaattcacaattaacgtcctcctcatcatcttcttcctctttttcgatgtactcttgatttccttggccagcgaacttctgagtttcagtatttgaatatgcttcgactgctccatcttccattgcctgcaattctttattttgcacatttgaagagatttttttgatgtactggcttaagaaaaagagatcgcttatttgaacatttgagtaattgacttttaaaatatcgttcaataaatctgaacctaaaacaactttttcgggagatgacaaatagctatattgtgtggttttcaacaaaacaaataatggacctctaatgaagggagccaaattttctgtatacttgagatttccaatgcaaaaattccttagtagcacaactgaccgcatctgtaatttatccactaagctatcctcactcttgtcagaagaaatttcgtccagctgaagaaccccgcctatataataattaagaagctttttacctccagaatccaagagaatttcccgattatcatcattatcaattattgcgttagcgatacatctaatcacttcagaactgatctcataaaacgctattttatcattaattgaaatgctcgtatcatgaaagcagatatcaagcgcttgttctaatactcttactaggttcagtagcagcccagttttaccaacaatatctctattacttggttctctcaacgaaacagccaattggtccattaccgctaggtagcttcctaagtagacatcgttcatcggaacatcctttattgaagacgcattgaggatcggttgcagaccaaataaaatttcttcgtaatccatttagtaggacagttattttcacttgaaaccacaatcttttggggctgaaatatagatgaggtgatttgttattcgcggttagttttagttcgcgagtgacctgcttacgttgtcttcagccattttacgttgcttggcttgccgccggcgggtaatatgatcttattttgacatggttaaagaaaaatacttttgactaagtacctttatcacaagaaagtttaggaagggattcactatttgaagatcagacaaatgagtatacgatattggctcaatattttagccgagtttgcttaaacttagtggcagaactttagtcatgggaagacaagaacgatcttacgaggcccttaggacctcggcggctaacagtaaaactggtaactgacggacaaggaatatcaaggtcatattttgaaaaggtctttttgggtgactacttgggtaagaaataattagacgaagtttctttctgatgtgtattgaactagtgctcgtgcttacatacacatcgcccattattgcctatagttatcctcactttatacgaggtctggccgttaacggttcttttacattgaaaaactaaatcagtcacccacgcaaataatgaaaaaaaaaaaaaaatcaaaagcgaaaagaaacctaacgcatattctattcaaacgttgaatgattgtattattataaatcataatcacgtaaagccaccgaaatttttttccagagtgaagaatataaaaaaaatatctttaaccagtctataatgtcttctggtttggtcttagaaaacacggcacgtagagatgcgttaatcgccatcgaaaagaagtaccaaaaaatatgggctgaagagcaccaatttgaaatcgatgcgccatcaatcgaagatgagcccattacaatggactctgaagagttacatcgcacgtatcctaaattcatgtcgtctatggcctatccttatatgaacggtgttatgcacgccggccattgttttactctctccaaagtcgaattttctattggttttgaaaggatgaacggtaaaagagctttgtttccattgggttttcactgtacaggtatgccaatcttagcatgtgccgataaactaaagagggaagccgaactttttggcaagaacttcgacaatgtaccagcagaagaagaagaaattaaagaagaaacgccggctgagaaagaccacgaggatgttaccaaattcaaagctaaaaaatctaaagccgcagccaagaagggccgtggtaagtaccaattcgaaatcatgttacagcttggtatccctagagaagaaatcattaagttcgccgacgccaagtactggttgacctatttcccacctttgtgtgaaagtgattgtacttcacttggggctcgtatcgattggagacgttcttttgtcaccactgatgccaatccttattacgatgcctttattagatggcaaatgaacaagttaaaggctgctggtaaaatcaaattcggtgaacgttatactatttactctgaaaaagatggtcaagcttgtatggatcacgatagacaatccggtgaaggtgttacaccacaagaatatattggtgtgaaaattgaagctttagagttcgccgatgatgccgcaaaaatcattgattcaagctcagatcttgacaaatccaaaaaattctactttgtcgctgccacgttgagaccggaaactatgtatggacaaacatgttgttttgtttctccaacaattgagtatggtatatttgacgctggtgattcttattttatcactactgaacgtgcattcaagaacatgtcttaccaaaagctaacaccaaagagaggcttctacaagccgatagttactgtcccaggtaaggcatttatcggtaccaagattcatgccccacaatctgtatatccagaactaagaatattgcctatggaaactgtcattgctaccaagggtactggtgtcgtcacgtgtgtaccatctaattcaccagatgactacattaccaccaaggacttgttgcacaaacctgaatactacggcattaaacctgaatggattgaccatgaaattgttccaattatgcataccgaaaagtatggtgatttaactgcaaaggctattgttgaagaaaaaaaaattcaatctccaaaggataagaacttgttagcagaagccaagaaaattgcttacaaggaagattactacactggtaccatgatatatggtccttataaaggtgagaaggtcgaacaagccaaaaacaaggttaaggctgatatgattgccgccggtgaagctttcgtctacaacgaaccagaatctcaggtcatgtcacgttctggtgatgactgtatcgtttctttggaagatcaatggtacgttgattacggtgaagaaagttggaagaaacaagcaattgaatgtttggaagggatgcaattatttgctcctgaggtaaaaaacgcatttgaaggtgttttggattggttgaaaaactgggctgtttgccgtacatacgggttaggtaccagattgccttgggatgaaaaatacttagttgagtctttatcagactctactatttatcaatcattttataccattgctcacttactatttaaggattattatggtaacgaaattggaccattaggcatttcagctgatcaaatgacagatgaggttttcgattacattttccaacatcaggatgatgtcaagaacaccaatattcctttgcctgctttacaaaagttgagaagggaatttgagtatttctacccattagacgtctcaatttccgggaaggatttgatccctaaccatttaactttcttcatttacacacatgttgcattattcccaaagaaattctggcctaaaggtatcagagctaacggtcatttgatgttaaacaattctaaaatgtcgaaatctacaggtaattttatgactttagaacaaacggttgaaaagttcggtgctgatgcagctcgtattgcgtttgccgatgcgggagatactgttgaagatgcaaattttgacgaatctaacgctaatgctgctattctgagattattcaatttgaaggagtgggcagaagaaattaccaaggaatctaacttgagaactggggaaattacagatttctttgatatcgcgtttgaacacgaaatgaatgctctgattgaaaagacttatgaacagtatgcattgactaattataagaatgccttgaaatacggtctttttgatttccaagctgctagggattactatcgtgaagctagtggtgtaatgcataaagatttaattgcacgttatattgaaacacaagccttattgctggctccaattgcgcctcatttcgctgagtatatttaccgtgaagttctaggtaaccaaacctctgtacaaaatgccaaatttccacgtgcatccaaaccagtagataagggtgttctggctgctttggattacttgagaaatctacagagaagcataagagaaggcgaagggcaagcactaaaaaagaagaagggcaagtctgctgaaatcgatgcatccaaacctgttaagttgactttattgatctctgaatcatttccagaatggcaatcacaatgcgtggaaatcgtccgtaaactattcagcgaacagactttagacgataacaaaaaggtcagagagcatattgagcctaaagaaatgaagagagctatgccattcatttctctattgaaacaacgtttagctaatgaaaagccagaggatgtgtttgaaagagagttacaattcagcgaaatcgatactgtcaaggctgctgcaaggaatgttaagaaggcagcacaagctttgaaaattgctgaatttagcgcaatttctttcccatatggcgccaaaaccggtaaggatatctttactggtgaagaagttgaaattccacctgtaacaaagattgttgaaaatgctgttccaggtaacccaggtgttgtcttccaaaatatttaaaggagaatatttcaagatgcctcatggtgattttccgataaaagatacaagaaattctcatagaaatacttataaagatcaataaacagcaaccagaaatcacgtcgcattgataatttgcctcgtatatatcgtataattattgtaattgcacaactgtttttgttttgtattcgttcattttcttgtaaaatgtttccacattttcttgtggaggatatgtatattgattctttacttattcgtgttattttagctgcaaatatctgggtttgagggctatttgactagtctagagaaaagtagtcgtgagaaaactatattagatagatggatgagaggagcaggtcaataagtaaaagaataataaataaatatataaaaatatacatgtaaaaaaggtgttctaaatgaatgataaagtttatgaatgtaatatactctaaggatgtaagaaaaaaaccgttgcgtatgtataataaacaggtctatgatgttaaaagatgaaaaggcctaataaagtgaacagaaccggaagaaactaaaaataaataaaacccaagtaaccacgtacaaaaagcacattgatgctaagaagatctccctgctaggaaaacagaaatcagaatgaaacgtttcaataatcatccctcaagttttttcttcatttggagcaacgtcactactgacttttttctcccctttcctcttctctttgaaaattcatccattttccgctgaagcgtctcacttgttttattgtcaactaatgtatttctcttagcacttacatgaataagctcatttgtgttcattgatttttccttaggtggatgaaaaggcttcaaatttttcagtagttcactaggtatattctcccactctgaaaagaattcaagtccagtggcagaggaaatccatggtgatagaggttcatttaaatcttcaagcttcatcgcaaattcgtataacgtacttccggtgtcttcctttagcttcgggtcattgggattgatgaataagggtctatatccagaatagagtacatttgtggtcatgtcactctgctttaaatgtgaggtggatggtactcttggtagccacgaaaaatcgcttcttttcttttttaaatgagaacctctcacatcgctatgttctttctttgtgattgtcttgttttgctttataagtggtgcagtatgttcgtgttccgggggttgacgatggtacgctgcctttttactgcccttttttcttttggatttcatttgatttttagatagtaaagactggttacttaagaacgtaaaggaagactgaaatcttctagaagtgagaactattcctgaagaaatggcattgttccttgataaaggcggaataaatggacgagctagcttcaacatagtttatcgtccgactttgcgttctgacctgctgaatatacgattagtagttttaaaagcacctttataatgttcgacagcaaggagtgctatatctagcgggtgtttgtgtacgtatgacggaataagttaaagaaacatctaagttatttaaatagttgctataactaccctttgggataaacgattctgatattgcgagcgaaaaaaagaaacggtagacagaataggcgtttgttatcgtcgatggtgataaaaggcgatatcgccattaaggtaaacaattattatgattatggttcttatggttgatacgttgatttatattaatattaatgaatgcaaacttatgttattatatatttttaaattttcataccgacaggaagagtcaatgacctcttgaccacacctgttggtagcgatataatgctgtttgagtaggcaggatttagcatagcaaatggagatcttaacgtaatactcaaatcgctttgttttctcatcggacttaattccgctaattcgtctacctcttttgccaaatttcttccttctccttcttttcttttttcttcttcttcttcatcatcttcatcatcttcttcatcttcttcatcttcttcatcatcattttcttcttcttcttcttcatcatcttcatcatcttcatcttcttcttcttcctcgtcggcccttactgtaacgccatcaaatatttgggaggagctaccatcagcctcatattcagttaatagagaatcgacaagatcttcgtagatagttgagtttgtttctgctgatttattcatataaacaacattgctcttataattttgtatacgagcaatttgtaccctgagcataattctttgagcaattacggtgcttaaataatgtttcatcaaattgtaactctcttcatttgaagtttcctcattatttgcatccacattttgaatttcattgttgcattcaactctgtccttattatctacttccgttgtctccattgcatccgcataattagagtagctttcagatgattctctgtcataatcagatgagcaaacgctattaacgggagataattctctcatagaactagtatcaattacatattcgtcttcctctttaatagaatatcgattcatggataacggaataactttattttctaccacaattgatggctgtcttgcaattgcatttagggccgtcgatggttttgaccttaccaatcttgacctcgagtacatgctgctgttgcgagtgacggcatgactaacattatccggtacagaaatgaaggagtttttattatttgccggtgtcatagtggcagatgcggttaggatggatgcagcccttctaatagaggaatttgttcttctcaatgatggagtatagcttaccaaagggctccttggggtgtttgatccaactttggaatcttcagattggggatggtttgctttaaatttcgtatcaactgtcaaaggtttagtctttttttgtggagccaatacaggtactaaagattttgatgagatcgaccgttgtaaattagagacgtatctctgcgattttttttgacgcggagtagagttgctgtttttgttgactaggttcgtccctcttttttttgacttgttgttaatgtttgctttagatttagtggttttggaattcgtggcggaggggaccttttgaacattatatgaaaacagtcttcttcttaaaactagccgtaatttccgtaactttttctttatcttgattcccaatgaggtgaaataatataagagtccgcccttacatctaatagcttttgatcgttttagagaacaacgactgctacttgatttactgctgacacttgaactatacctggaattggaaaacctcgaggattcaactcgtcttatggtcggaactctgtttagcttttttttaggtttcggtactacgctattgtttaattcgatagtttttatatccttttccatatttaatttggtcatcggtttggcttcttgggtcgacggcagaatggcgcttttagatgtcgatttccttggtaataacgatgatgctgatgacggcgcgatatcgtaggaaacattatctgctgttgggatagtctggaatgccgttgagattgagccagttatgtttccctctggaatagcttccattgaatgtaactggtttttaactacatttgagctgctataatgaagagagtcatttcctgggaagtcatgagaagcaaaaaagtcacttttgttcgagtctgaggaagttaatctagcggtttcattttgattgattacaatacgtggtgaagacgtagtattgtcagaaatgttagcaaatgaatagtatccatttgatgaataaccggaatttgtatttgtattggaagtggatgtatagtctgataatgtttgagagtttccgtcttcatcgcgagaaactccattttctgctgcaaacacatcatttaaaagatgatgattattcaaatggtactcttctagcgttcctcttggtaaactttcgttagacgggaatttaaaatccatttgatcgcctctaaacgacttggtttttgtccttattggagctctgatgatcattccgtatgatatatttgttgtgataataagccaaatttatttgagcactattgttaagttaattgttcttgttttacttgttaagccgttaagttgtcaaccgaattatcaagcacttaaatctatatatacaacatatttgtacaagaattgatgacctgctgaaagcccagcaatctggttatcccagttgaacatgtttaaggataggcatatcgacttctttatcttactaaccgaaatattgaattgcctgtgtaatgaatggctggagcagccttttttttatcttcgccagccatcgctttttttgaatattttccacatgaaaacaatgtatgaaaaattctaaggcatcgcaccaaactatatgaaggggaagtgagttattccgcaaacagcgagtaagtttttcgttgtattgattgcccatattatataccgtgttgtgggggcaacagacagaagtagaagaaaaaatttttgttgatttaactgaagtgatgggaaggacatttattcatgcttcgaaaataaaacatgcggcacgcaaaagaaaacatcattccaactttagaactctgatcaaattattgaacaatgatgcctataagatagaatcatcaaaaccgttgaaaaatggtaaacttttcaaatactggaaaaataggcgtagattgttttcaaagatagattcggcgtcgatatatatgactgatgagctgtggttcagtgtgacgcccgaaagaattgcctgcttcctggcaaattttgttaaggcatgcatgccaaatgccgaaagaatactggatgttttctgtggtgggggcgggaacaccatacaatttgccatgcaatttccttacgtctatggagtggactacagtattgaacacatatattgtactgcgaaaaacgcccaaagctacggtgtggacgacagaatatggctgaagcggggatcctggaaaaagctagtctctaagcagaaactttccaaaataaagtacgactgtgtatttggatcacccccgtggggtggtccagaatacttaagaaacgatgtgtatgacttagagcaacatctaaagcctatggggattaccaagatgttgaaaagttttcttaaactaagccctaatgtgattatgtttttgccaaggaactctgatttgaaccagctttctcgagctacgaggaaagtactaggtccatttgccaaatgtaaagtattatatgtaaaggagaatggatatatgaaaggaatattttgcatgtggggggaatgcttttttaactacgaaccagcaagtacggagaatagtcgaagggagtcgtccgaaaaggaagagctgagttctgaaaacgaagagctctcgaaaagaaaaaagcatgaatccacaacaacgaccaaagataatactgtagacatttacgacgtaaatggttaaacacttgttcaagttgaatcgtatgatagaaaatgcaatgactatgttatgaatgtatatatagcacataaagaggatcgcttacgtgaatttgggaataattaaaacgttcttttagctgcggctgctcgtcgataggagtgataacaaattaagaattagaagggatgtcttttttttctaccagcaagttgccacgcgcttcagactttagaagaggtagtagcaatcccttcgaatgaggttcgattatatctctcaccattccacgatttatcacggaaataccattcaaaaataaataaggcgactgaatggattccaaggcagcactagtatcgatatttagtttattttgtttgatatacttttctaattcatagccatgagagtgtttttccaaatcaacagtggccaattcgggtgaaatctcaaattctctttgtaatagattttttaagaaaatggagtctgcttgtgatgatttaatgaataataccgctggagaggttcttattatatctagaaaatctgttctagggtcgaattttttgtgatcgcagtttttctgcaaggccagagaagatgaccgtggatttagtgttgttgtggtcgtcgccgtcacgacattatcagtttggaacgatcttgaagaaaattttgatgtagctttggatgagggttctgggatgtcgacttcaacctcgctttgaatatttgaaatttcttctttgactttttggaaatttagttcattttcattacttagaaaactgtctgctgtctttaataagtttggcaacttgtaaacgaacttcttttcactttcttcctcactattttttttgttttcgctagggtcagcagagttgtagaattccaaggagtcattccatgtaagtagtaagaagctaaatacgccaagcaaaacgagtgttagcgatattattctcgtacttctcttgattgctgtgtgctttttcaaaactgatgaatccgctatcatctttaactgttattttcctttttttaattgctctttactgttcttggaacaagagattatgaagtctataaaagaacatatatataagtatttaagagataagcctgattcaaagacgtttgcaagtttcagtcacttggccttaacaatctttatatattaatccctttagtacctgcacaattaaggccgagacagactcgaaacaaccccaaaacttcttgatctttattagctgatgccaaattttttggtaccacactgaaacgaacttcgtaaatccattatttgtgtattttcttaacgagaagtgcctaaaaactgccttttatgcgctgtcttctgagaatagatcccgttcaaggcaagcgccgggcaagcggaggcgcagtctacagaacaatccgcacaaggaaaaaagcacccgagatctgggaccctcacctaatcatttatcgttatccacgacagggtgcggtgattgctgtgtattaatgagtggtttcaaagccctatcccgcagtcgtttggcactctgcagggcctcaatcattttatccttcctctcgagcatcttctgtaattcgatcacttcagtgccgtcacacccagttagcgacattgcagtatgaccacttttttctagcgccatgatcttgtcttcaagtttttgagtgtatttcctatattgccttatttgtgattccaaaccttggaactttgtttccaaaagggtgccgacctcaaagggaagcatttctacaatttccataatctcagaatcttgcaaatcaaccacatctttatctagtagtttttcacaattctctagtttatattttaatactcgattctccgctctcattagagccaaattcggatcaccatcattgccggtggctttaatgtctttataagtactttcattggaagatttggttaagggctcgccaatgtttgaacggttcttcaattcagagatcatcctacgttgttcttccaattggcgtctcagtagctcaatggtgcgatctttatctccatcgttattcccgttactgatgatggattttttggatacatgaagtgcgacgtttttcgctcttgatgcaaacctcagcgtattcatagtttccgctgccgcatcatttctggtgtcgactgtacatatcgttgtcactatgctgtcaccgcttagtgccggctgcaataatctagtcaatttagaatcacgatatggaatgtggttgcttgggctagtgccgttattggtagcatttccactactgctgctactgccacttgcagatggcgagggaatgtttgagcctactgagttcatcttgtcggcactgagtttggatatcacagtccccaaagcaagtaaggatttgttgatgaatgaaccttcctttctcctctcttgttgccccgtagccctttccgaacctgctaggtcacacaacgacaatgtactcgatcttgaggtgccgttctttacgttagtacttgttaaacgaatcagtacaatggcatgagatcgtgagcttcttgcattgtagtcagtttcgccaattttcctacttttgtcaccaactgcaatccacctcaataattcttcactactttcacatcttctttcggtgagaccgataactttgaccccatactgagagtcatctctgatttttaattctacgcccaatccattgctgttgctcttgctcatatataaccttgaaggagtactgattctactaccggattcttctaatccgctttctaacaggtcgtaaatcctttcattgtaaatttcgaggtacgatattataacgtcgaactttttatcgccattcattgattgttccatgatattggtaaataaatacgacacagataaaggaattaggcctagctcttgttcatttccgctcattgtaaacgttttacctgacccggtcataccgtacgcaaatatggtggcattaaaccccatcaataacttatcaatcattggtttactggttctttcataaacttccaaattagtgcaatgggaagcaaaaacatgatcgaacttgaactctccaatttcttcatgcactattgttttgtcattagtaataaaccaggggtctctaacaaatgtattgctaccgtgatgtgagttggatcttggttgagagtacctgggcgattttagccccacatggtcacgggaagttccaacgctccgtggtttcggccggatggtcacagtgattgacccagtatatgtatcgttttttctcgagttgttgttaatactgtcgctccgcctgatccttatcctacctgggtgaaggaagggatcggatttggctgatacggatcttagtggggagttacttctagtggaagatgcagaaatcgactgagaacccgaattagaggtgctccgtatggagtttcttgtcagattagaaaacgatgaagttgatcgtacagagggcgattgtgggatattacttgaaccagaactagacctcgttgatggcctccttaagcttgggctcattttttgaatcatcaatggtggtattatggtaagaattttatcaagtgttctatgtttgccttgatttcaaatgtttctagagcgcagcctgtgaatctctgcagcctatttctttttatttttcgcttctgcttacattgctttattatcaattgttccgctattggaaaaggataaacaaggaaattctcgagccgcatcatcgggctacccgcatataatgacattatgggcagcagcatagaacaatggattctaaaactgaggacaagatggtttgtcttgttttttttttttaaatatactatagttttttttattgttatctacttataaaagctctctagatggcagaaaaggatagggcggagaagtaagaaaagtttagctcaaattgctttggccaaaccaaccgcattgttgcccaaatcgtaaatagaatagtatttacgcaagaaggcatcaccaacgatggccagtgggccaacaggttctgggaaatccattggtgtaattgcagagatacaggagcctgaaacttcaagcgtgtaatcgtatggcccaatagtgaagttgtagccattgaagttgaaaattagatcaggtagattgtctctggtgttacagtctagagtatattgaccggtccaacccttcttggccccaatttcagcattaatcatttcagctaatcctgatggcaaggtaatcaaagaagtaccagtatcgatggcggcaccatggctctccaattcggcgtactcgtcgcctaaaccgataccttcaaacttgacttcccagtaagccttacgacgaacaggtaaccaagtgatatcgcccttgaacttagactcgtcaataccaccaaaggtggcttcaccgccattttcagtatcctttgaagtgtctcccaaataaaaggcaaatctcttttcgtccaacaaatcttgttgaatggcgttgtaaaatggagggaccaccttatcaacagaaatggtatcgtaacccaaacccaaaataccatcgaacttgccaaatgcaaatgttaagcccggctcgctggtagcctcagcgaagtcttgttttggaatggtcaaatccccgatggacaaagtgtcttgagaaatgtaaccttccaaagaaccagtaccatattgaatggcaaattcagtaccattagctttgtagcttgatgaagcttcatgatcgtatttagaatgtaggaaacaagccaaggaaccacattcgttacttggaacccaaaggtttgaagaaccagtatccaaaataaccttgaagttttgaggtggagtacccaaagtaatgtcagtgtaatattgtgcgttcaagtaatttgtcaatggaacatcgtgaccaccttcagtgaagaaaggatgctccctagaaaaaacaacttcggggttagctttctcaaattgagtcaagtacttttggcctaaatgagctaaatgttgctcgaaagtgacttctttcatctcatcggacaactcgtgtttataaattttagccttgtggacttttgcagcaacttggttggcgctgaccaacaacaaggccaatggcaataatgctttcaagctgaacatgttagttttggtttttgtttgaattttatttggattaaatactaggtcactaggctttttttttttcttttcttatagaattctaatagaaaaaactttttatgaatacagtagggtgagatatactttttgttattcttcccttacgtggtaggcttctcaaataaaaatagaaaagaccactaaaatttgattataaaggcttcgctcaaaaaagaagaaggtggaatgaataaatagcagcgaattacccaaacttctttactctgttcccttaaccagttgataagaggttacgaagtacggaagtatggctttttatataaatcctaaaaagggccgcctccgccccttaatccatcgacacccgcaaatgaaatatagtacccggaaggcataagacgggttacagcctctccatagattcaataaccgcttttggttatagaaataatcagacctcagcaaatacaattgaggagctcaagatattgaaaacggattaacaaactttttaaaattatttatgagcttgttgtaccacatcaagcaggattatgtttttttcagaacttctttttctgattcaaaaattcattaagcataactaaaactgaaaatcaaaacttattaatatacaaaaatctatatatttcaaaatgtaaatcgtatcaaaacgtcactctatatgtaataaaaacccaaaaagttatgaatagatgaattctgagtattggtatctaccatcttctctcttaaaaaggggcagcattttctatgggtatttgtccttggttacgaaaattgcaaattctcggggccttttgaggtttggtccaattttgcccttttaaccttcttactaggatcaatttgtgattgcgataaacttaccgaatgtattctcttcaaaatgttccccgtattcgcattaatcggtgactctaccaagtcgtttagtaccgaattattgccgttattatttgtatcgctaactggcggcttcttagccgacattgatgaagaagaagccgagggttgatttgcacgttgagctgccatcatctgggttaactttttcaccaaatctttttcttcggctgtttgcttaagtactactctttgttcttgtaacatacctaatccctcgttaaacagacctgtagtatcgttaatttccactttaaagccaatgacaaatttattgtttttatcccaaatgatcttgatttcatctccgtcttgtaaaaggaatttcgtaccctgtatcatgcggttattatttaaatagctcacgttagttccggtgtggcaataccaaatatcatctaaaccttgtgccggagattcatacatgcttttgcctacagcatgcctctttttgaaaatgaagcaatgaactcgagacaacctattgtcttcaattttacaattgcaatcctcggatctaccaatgaaaaatggattcacaccttgctgaatctccaggctttcttgaataatgctgtcaggcaatggttttaaagttaaaaacctaccattaccctttttctttgagctcttgacattctcagtattattggaatgtaaaagtttttgttctctagtttctgcttcaatgcttttgggctgtgtatatcgaataggggcgtgtgcgggtattttaaatccttgaatttttccatcttggtcttcctgatcctgttcttgaagttgttgctccatttgtaatttcctttgcgctttgacaaattcgtattgagcatcgtccatattttctaataatttctgctgcgacaacgattgtgataaggatatttgtgaaaaatcaccatatgattgtgagcccaatggactcatcttgatccagggatgattcaaggcttttgcagctgtcgacctattatttggatccacctgtaacaatgaatctatgaaatctcttgcttcttcagatatccggaaatctttgaggggcccttcatgatatgagcctcttccaatctgtttatataattggtcctgtgtgctaccactaaaaggtaagtggcccgttaggataacatacacaagacatcccattgaccacatatccactaacgaagagtactcattcctttcttcgtattcatcaggagatacggatgtatctttacctctgatgacttcaggtgccacatatgccaaagtgccacagaaggttttcataaaagacccatttccttgtacttttgccagaccaaagtcggttatctttaccaatacaggatcgtcttgttcaataagaatattatcgggctttaggtcacgatggctgatgcccatagagtgaatgtattttattgctgtgagtatctgcctggatatctccctcccagcatcttctccaaccgcaccatgagcagcaacaaaatccattaagtcaccaccagaaacgaactccatcaccatataataactctcagtatcttcataaaatcctttcaatcgtactatccttggatgattgagcttttgcaatacttctaactctcttgtcacaccatccatattgcctattactttgcgtttacttataatcttcaccgcgaatgttttcccagtagttctttcaatggctttctttactgtggcaaatgcaccctggcccaccacttcgtcaataatcgaaaaatccttaaaaataccagtcttgttggccaccattgatgatgcagtagatgatgtaagaccaggagaagctattttagaggtatttttcaggttagatcttatgcgatcaactttgttctgctcgaggcactgcttaaatttgtcgtttatgaaaatgaccagagataaaatatctgattccacgcctacaccaacggttatttcatcaccttgagacagtaactgattgctgttcttctcgactttttgcccatttaaccaggtcccattagtggaaatgtcattcaataaaaggttaccgtcttctcctagtagtatttggaaatgcttatttgacagtcttgaaatgtttcctaaatgatagtcacaggctgggtttctaccaaatgtccaaactttctttatggatcgtttttccttaagcacttgtgaaatatcagctgacaaatctcggatgggaatttgacccgtggtacaaatgaccctgcacacaatgttttcgccgatctgttcttgagaaaacttctcaatcaaaaacctttgagtagcctgcgtggattgctgtgtgggttgtgtaatattttccatttttagttgatgttgtgtaacactatcttttctcactattctctcttttaaagcttaagaaaatcgaatgcatatacaaaattagtttgtcttccaataatctctaccgtccttttctgctttcttaccttttcttgatcagagatttcaaaatggtaactttggtaccctttatcttctcaacctgtacctttattctataaatgttttcatttccaagtctacccacggtgatgatttttctgccaattttacgcgtcactcccgttgccgtatcaacgcgtccacaccacctcaccctcgaaatgaaaataaatatgttaatagatgcacgtttcattgacatctgtgacaaacactttccggcttaattaaaaggaagcaggctattaatgcaccaaccaaacaaatgatggttcacctcacgctgaaatctcatctaataaaggaagaattactttggcatgctttatctccgtcctatagttgccgataccacggtagataatacagtatcattctaaaagtaccatttaggtaggtgctgagcgaaccaataagtaagtttttgttttttctcagtgtttgctttgaatttacattgaaatacgttgttttggacgtactacaatagccgccataatagattttcgggtaacttttacactcttccctctctttcacgtgagtaagcacagaataaaatcctaacggatgtgatagaacaaaagggatatcaatgacaagagagaggtactttatgttagtcgcctgtgcagaaagaacagtccataaacaacaatccgtaaagaacaatataaatatttagaaaaagatgttgccagaaaagagactattgactccagacgatatgaaactatgggaagaatccccaacaagagctcatttcactaaatttattatagatttggctgaatctgtcaaaggacatgagaattcccagtacaaagaaccaatatcggagtcaataaacagtatgatgaacttgctttcgcaaataaaagatatcactcagaagcacccagtaataaaggatgcagatagctcgagatttggtaaggttgagtttagggacttttatgacgaagtttcacggaattccaggaagatcttacgttccgaatttccctctctcacagatgagcagttggaacaattatcgatttatctagatgaatcatggggaaataaaagaagaattgattatggttcaggtcatgaattaaatttcatgtgtttactttatggactctatagttatggaatattcaatctttcaaacgattcaactaacctcgtgctgaaagtttttatagaataccttaaaataatgaggatactagaaactaaatattggcttgagcctgcgggctctcatggtgtttggggattagatgattatcatttccttccatttctatttggtgccttccaattaaccacccacaagcacttaaagccgatatcaattcacaataatgagctcgtagaaatgttcgctcatcggtacttatattttggttgtatcgcttttattaataaggtcaagtcatccgcctccttgagatggcattctcctatgctagatgacatcagcggtgtaaagacttggtcaaaagttgctgaagggatgataaaaatgtataaagccgaagtccttagtaaattgcccatcatgcaacatttttactttagcgagtttttgccttgtccggatggtgtatctccaccaagaggccacatacatgatgggactgataaggatgatgagtgcaattttgaaggacatgttcatactacttggggagactgctgtggtataaagttaccgagcgctattgcggctactgagatgaataaaaaacatcataaaccaataccttttgattaggaaaagtccatttatagatgctatctcattgtatatacacgtatacagggtacgtactttttccatctactcccactaaaatcttttggcgcttaagttggggttccacgctagccccggttctgactcttttgtagccgtctcatcctgtttccaaatctttatgcttttgtctgcttctccagtgattaatcttaaacctgttttatcgaaagtgctacaaagaacactccgttcaccttccagagagcctaccatttctctcgtggccaacgattggtatttgtgaccagacttataatcataaaaggaaagcacaccattgtcaccgccagcgaataatacatcatcttgattaatgcttaaagtattgattatgcctgtcttttcagactcaaaattggtgagtaaagacccctctgctaatccccatgatctgatgtcatcagtacacgcagaagccaccgaaaactccttaggatgcaacgctgtagctctcacagacctcttatgatgtgttagaactttcattgttttcccagcaactacatcccataaccttaccgtagcatcagtcgatgaactcaccacttgagggtctactggagtacactgtacttgattgattggacccttatgcccaactagtgtaataacaggtattctggttctcatatcccagagtttgataacgctatctcggcctgcggtagctatgagatccagcgttggatgtatgctcaccgtacgaacccccgataaatgtccatagtaatctctaataatttggtttttctctaggtcccagcatttgaccgtcttatcttcactaacagaaaataaataaggatgtcgatctgacacagcaacgtctctcactgtcattacatgccctgctaaggtagtttttaattttcctgttgcaagatcccaaactttcattgtcgtatcattacttccggtgatgaaccattcgttgtcaacaggatcgattgcaacgcatcgtacccatccaagatggccattgataacgcgtgaaagtttccagggtgcatgccattccggcctttgtgacagaagtttttcgtatcgattaactataagttcttcagcaacctctggttggaaaattttattcacaaaagcagatgcatgcgtatcgtgatctttcttgctaatcactgcttgtgatgcttctgaaaaatctgtaggaacatgctgcagagtaactttcttgccttcaccactaaaagaagaactttccttcctataagtatcatatcgcattagcaatgatttctgaccttccatttcgctttgtaggtggggcggcagagtggccatatatgaaaattggttattccagcgtattctggaataaaatttgtctacatctcctaaattttcgactttgtgatcatttccgtccattctcactaatctccatgtaacacagtgtctgcatcctcggaaatggttttaagatgcaatgaagtgggtaataattactgttagcttcacatcttgaataatcttttattgccaaaattgtagcttttccgtattagatgatgaagaattttgagcacccttacttaataaaagagttgttgaactcgaaataggaatacgagatgaggagtaattctctgaaagtagatagctcctcttgtcacattgaatgctactttattgtgactataggtgatttaagcgaacgaatgttcttaggtcatcgtggatttgtgtggtgattttcggcttatcttaacaatgttgaccgcgtggaccctcccaatcttgacaacagaacacttatcaataacggtatacaataaatatcttgtatgaattaaataaagtaacgttttttccctcatatcattccgaatcattacgaaaattccaatacctgtattttgaagtcaacaagagtttcgttatccgaatactattttttgtatcaataaattttgtttcgtttttcattaataactagtcactgtgtagtggaagcaagttctccttatccgttgccaagagacaataaaagacccacatataggtgaatatactgctcaccatggttaatcctgttggatcctcgaaattggaacaaaacaatataaaaagcattataggatcatcgtacaatcgactatacagccaatttacttctgatgagttgacagaagtgggaaactacaagattttaaaacaaataggtgaaggaagttttggaaaagtatatttagcgctccatagaccaacacatcgtaaagtctgcctaaagacgagtgataagaatgatcccaatatcgttagagaggtattttaccatagacagttcgattttccttatattacaaagctttatgaagtgatagtgacagaatcaaaagtgtggatggcattagaatattgcccagggaaggaattatatgaccacttactttctctgcgtagaatatcgttattggaatgcggagagttgtttgcacaaatttcaggtgctgtttactatgcacactcaatgcattgtgttcatagagatttgaagttagagaatattttattagacaaaaatggaaatgcaaaattgacggattttggttttacgagagaatgtatgacaaagacgacattagaaacggtttgcggtaccacagtttatatggcacctgaattgatagaaagaaggacttatgatggattcaagattgatatatggtcattgggagtgatactatacacattaattacgggatatttgccatttgatgatgacgatgaggctaaaacgaaatggaaaatcgtcaatgaagaaccgaaatacgatgctaaagttattccggacgatgctagggatttgatctcacgattattggctaaaaatccgggagagcgcccatcgttgtcacaagttttacgccacccttttttacagccttacggttcagtggttttagatcagactcagaaaattttgtgcagacagcgcagtggagggactcagtttaaaagtaaattagaaaggcgattgctgaagcgtcttaaacaatcaggggttgatacgcaagcaataaaacaatcaattttgaaaaaaaagtgcgattcactctcgggtctatggttattgttgttagcccaagggaaaaagcaagaaaattgcaaatatccaaaaagaagcaggtccgttttatcagtcaaaaaagttattgaaagtgctacgcataacgacactaatggcattagcgaagatgttttgaaaccctcacttgaactttctagagctgcttcattgagtaaaatgctcaataaaggctcagattttgtaacatcgatgactccggttagcagaaagaagtctaaagattcagcaaaagttctgaatcctactctctctaaaatatcctcacaaagggcttatagtcactctattgcaggttctcctcgcaagtccaataatttcttacaaaaagtttctagttttttcaagtcaaaaaaaagctctaacagcaatagcaacaatagtattcacacaaatgttagtgaaagcttgattgcaagcaatagaggagccccatcttcagggtcgtttctcaaaaaaaacagtggttctattcagaaatcaagaactgacactgttgcaaatccttcaaggacggagtctataggatcgttaaacgaaaatgttgccggtgccattgtgccacggagtgctaataatactacattagaaaataagaaaacttctgggaatgaaataggcttaaaagtagctccagaactattattaaatgaacatatccgaatagaggaacctcgcctcaagcgcttcaaatcgtccatatcaagtgaaatatctcaaacttctactggtaattatgatagcgaatctgcggaaaattctaggtctatatcttttgatggaaaagtttccccgccaccgatacgaaatcggccattgtcagagatatcgcaaatttctaatgacacttatatatcagagtactccactgatggtaataattcgtcattcaaaatttcagacactatcaagccgagctatatacgaaaaggctctgaaactacctcgcagtattcagcttcatccgaaaaaatgacaaatggctacggtagaaaatttgtcaggagggatttaagcattgtatcgactgcgtcgagcacctctgaaagaagttcaagaacagattccttttacgatatcactacagctacaccagttgtgaccactgataataggcgcaataaaaacaataatctgaaagagtctgttttgcccagatttgggactcaaaggccatggactggcaaaaggacgtataccacgtcccgccatggcaagaatgctaggcgttcgtctaaaagaggtctgttcaaaataacttcttcaaatacagactctattattcaagaagtaagctcatcagaagaagaagatcataatgttatctatagcaagggaaagggtcttccaacaccagttttgcaaactaaaggattaatagaaaatgggttgaacgaacgcgatgaagaaggagatgacgagtatgcaattcacactgacggagaattttctatcaaaccgcagttttccgatgacgttatcgacaaacagaatcatttgcccagcgtgaaggctgtggcaactaaacgttcgttgagcgaaggaagtaattggtctagtagctatttggattcggacaataatcggcgaagggtatcttcattgctagtagaggatggggggaatcctacagcgtaggtaccggataacagagtaactggtaaaaacggcaaaaaatactgtaaggaagttgtctatatatgtacatatggatattgcggtataataaaaaagctttaaaattataaagaaacccgacttttatcacatataattatattataaaaaaataatggcatctgtatgaactcgcgattaagctcacttttttctaatgatcgaagttttgtccggttatccaactgtggcaagaacatcgcgaggcggagctaaacacagaatttttgtagcgcgatgagaaacataacgcctctttagataaattatcatcaccttttttacactaaataatgaagtagcatgctcagaagtgcgaatgaatttttgttcttttggttctagaagaacggagataggaaacctatgatgtaagtatgaatgacattaaacaattactttggaatggtgagcttaatgtgctggtatcgatcgatccttcatttttgatgaaaggaagtccaagagaaattgcggtgctacgaataagggtaccaagggaaacatatttagtcaattatatgcccctcatttggaacaagattaaaagctttctttcttttgacccattgaccgacagtgagaagtatttctggtttgagcataataagacgcctattccgtggaattacccagtaggtgttttgtttgactgcctagccggaaaaagcgctacttttaccacctcttttgagaaccaggtaaaggatgttctcacttttttgagaattcacttggttatgggcgattcgttgccaccaactatcattcccatcgcatctagcaaaacgcaagcggaaaagttttggtttcaccaatggaaacaagtttgcttcatactgaatggttcctcaaaagctattatgtctttatcggtcaacgaagctcgaaaattttggggcagtgttattacgagaaatttccaagatttcattgaaatatctaacaagataagttcatcaagaccgcgacatataccgctcatcattcaaacctcaaggacatcaggaacttttcgaatatcacaaccaactatcagtatgactggagtcaatcctacgttgaaggatattgaaggcgatattctggacgtaaaggaaggaatcaatggtaatgatgtcatggttatttgtcaaggaattgaaattccttggcatatgctcctgtatgatttgtattctaaattgcgaagttttgatggctttttgtacataactcttgttcctataaaaggcggcgataaagcttcctctgagctctaagagctgttatatacgcatttaaaagtgtcattcaaatatcgcagaaaataacttggacgttgaaaatagggccacatttatacggctgcaagaaaacttttactctctttctaccaagtttgttactgcaattaaataatctttatcatgggatagcgaaactaaaaactcatgagtggaaaagagagaatcgtagtttttcgagagctgttgatactttggatacttttttccaaacatcttatcaaactctaactgaggtacacctgtatcggtttgtgttttatatagcattccagcgtacagtacttgggcaggaggtagatcatgctttgaaacacagcaacacaacgctttcaatgagcattccttcaaagcccaaactcccgctatatattcatgcaatcgtggagttaagcagttttcttcgatgagaagattactgaaatgaaatctttccttttcatgcatgaacttccgtgttattttattcaaggtagaacggccacatgggtcgaatggggaatatttctctagtatatgtgcaaatcttggcaagtatacaatgtcaactcccactcctgctatcttacgtccaatattcctcgatgcaaaactcatcactggaggcattcaaagctagcacttatgaaataaacgttcattagaaagcaatactcctgataagaaaatagtgcttagcttctattcagccttcttaaagaactagcttttctatcaaaagtcagatctcttatgaccgcttgaacctgtggaatgtatataagcagttttgatgttaagatttttttttcaatagaatttcttccttcggaaataatcccgattaagaaattattcttgacgcaatattcagctatatgttgatcgggcttaaccgcataagtttcgttacccttttttaccccaatttttaatttcggcggttattttcagcccttttagagtcaagatatataagaatgcttctctaagaagtgagactaacaatgaaacccgtttcagacaatctggaagtcttagaacgcataacacagaaatgtcaacaacattagcagcaccagcgaaactaaagagtttgctcctgaatctacatactcactgtattgggctacacgttaacgatgtcacacctaaagtatatttcaagttattgatacggcatcttctacagatatctagatcaaacgctgctcatcctaagctaagaagaagggcccagattttattggtatcgcttttcctatctggtgtcacacttttttctggtgtaacatatagtactttcaaaattattctaaaatgttataaattttacaagtttccatggaagagaaggaataggagacctttaataagaagaacaagatctcaaatgcaattagacagtggtgcaagaataatgtatattcctgaagtggaattagtcgaccgccagagtcccgatgacaacaaatttatgaatgctacagataaaaaaaaaaggaaaaggatatttattccaccaaaggataacgatgtatatgaacacgataagtttctttttaaaaatgtagaactggaaagagccaagaattcgcagttattctactcaaaatttttaaaccaaatgaacgtcttgtctaaaattttaattccaacagtttttgacaaaaactttcttcttttaactgctcaaatttttttcctggtgatgagaacttggctctctttgtttgtagccaagctggatggacaaatagtcaaaaatataattgctggtagaggaagaagctttctgtgggacttagggtgttggtttttaattgctgtccctgcttcttatactaatagtgctattaagctacttcaaaggaagttgagtttaaactttagggtaaatttgacacgttacatccatgacatgtatttggataaaagactaacattttacaaattaatttttgatgcaaaggcgtccaattcggtaatcaagaatatcgacaactccattactaatgatgttgcaaaattttgcgatgcgacatgctccgtttttgcaaacattgcaaagccagttattgatttaatattcttttcggtttatttacgtgataatttgggaactgtgggagtagcaggtatatttgttaattatttcattactgggtttattttgaggaaatacacgccaccattaggtaaattggcaggcgagagatctgcttcagacggcgattactacaattatcatctaaacatgataaataatagcgaagagatcgcattttaccaaggaacagcagtggaaaggacgaaagttaaagagttgtatgatgtgctgatggaaaaaatgctgctggttgataaagtcaagtttggttacaatatgttggaagactatgttttaaaatatacatggtccggtttgggttatgtttttgcctcaatccctatcgttatgtctaccttagcgacaggcatcaattcagaggaaaaaaatatgaaggaatttatagtcaacaaaaggttgatgttgtcgcttgcagatgcaggctcgagattgatgcattcgataaaggacatctcacaattgaccggctacactaataggatatttactctgctttccgtcttacacagggttcactctctgaactttaattacggcgctgttccttcaatcctgtcaatacgtacagaagacgcttccagaaattccaacttattacccaccacggataattcgcaagatgctattcgtggtactattcaacgcaattttaacggtattcggttagaaaatatagacgtaatcattccatcagtaagggcgagcgaaggcataaagctgattaacaagcttacatttcaaattcctttgcatattgacccaataacttcaaagtccaattctatacaagacttatcgaaggcaaatgatataaagttaccatttttgcagggttctggctccagcctgttaatattagggccaaatggttgcggtaaaagttcaattcaacgcattatagctgaaatatggccagtgtataacaaaaatggattattgtcgattccttcagaaaataatattttttttattcctcagaaaccatattttagtagaggtggaactttaagagaccaaattatataccccatgtcctcggatgaattctttgatagggggtttagagataaggagctagtacagatattagtcgaagtgaaactagattatcttttaaaaagaggcgttggcttaacttacctagatgccattgccgattggaaggacttattaagtggtggtgaaaagcaaagagtaaattttgctagaatcatgtttcataaaccactatacgtagtattagatgaggctacaaacgcaattagtgttgacatggaagactatctgttcaatcttttaaaacgatacagattcaatttcatttccatatcacaaagacccacattaatcaaatatcatgaaatgttactagagatcggtgaaaatcgagatggcaaatggcaattacaggcagttggtaccgatgaagcaatcacgtcgattgacaacgagattgaggaattggagagaaaactagaaagagtaaaaggttgggaagatgagaggacgaagctacgggaaaagcttgaaattatttgaaaacaccctagaaagggagagattttatttagcgaatataatttatatattatttccgtaactgaatttgtacttttgaatgtttaactgatatctagagatatcgacatgggaatgccctctcaaactagaaaagggcagagaacgaaaagaaaatgaaacaatttgttacctactatacagttgttggtcttgccaacacaaatatgaacatatatatatatatctcacttgatgaatccacgtatcaaggacaaccttttcatggaaacatatactgtaaaacaaaaaactctatttgaagtccttatgtgtccacttttcagtgattttctgcttatactttctacctttcctaacgggcactcttgtttcgaccttaccagaactttgtagttttctcacagtatcatatagcagatttccttcaggtttcagttttctcaatgagtcagataattcgtcagaaaatttaatctccaatctttcatcaatcacagagtatttcgtccctaacttgtgtttcttatttttcttgctttttttaaccttgttgctatctgactctatggctgaaagtatctcagtctcttcagaattgataacttcttctaaatctttaacacgttgtctcaattctttcaactcttgttgcaattttactttctcttcatgtctctttgccttgtttctttgatattttgttttctttttattcttcacaggcttatttattgatagttttatttccttatcagatccactacattgcgtactttcattttcattttcattttcttcttcttcttcttcttcttcttcgtttgatgaagactcttcctcttcattgtcatctaaagtttccattaaatgtctaattctttctttgtacttttccaaggcgattctttcatcttctcttgccttttcctctttatactctttgtttatcaattctgaccaagctttattgttgggattgtaggatttaccagcatgtggaatttctgtgaattcttttactgcaattggctctatatctaaagtacttggtctgactgaagcagtagaccaacttgtcgtggattttttcaatagttcttcaggtatctggtcctttttttccacatcaagtttgataccggaaggtaatttgaccttctgtttctttgaattggattcttcaccccataagtcgccagccgttgttttaactagaccgtctttggcaactctattcttgatcttcgattcgccgtgtactctgccagccaaagccattaatttctttaattcgtgtttagaaacaccttgaatcttattaggatttccactactattcttatggtgatttagtgctgcaatttttgaattcgttttaacggcgtctaaaatctctttactttttagaaccttcttaatttgtttccttttaattaatttatttttcaatatctcatcaccctcaacatcaacatgaaaaagagcatcattttgcaaagaggttatatcactggtaccatgcgtaatttcatgatcaattttcttttccatatattgttctacgtcagataaatcgatattttttctccatgctttcttaccctttcttgaagactgtttgtattgagatggtttcttggttagattagttggagccatttttaaataaatgattcattaacgtgaggatggtatggatcacaagaaagccgaactaatagcataagttgtaatgtaaggaccccatcgcatttttattgctcttttcttttttagaagtgaaaaagctcgggcacggaaaattttttgatggaattatagaatttcgtcaaatatgactgtattctctcagagcacacctgttaggtaatacgcaatattatgataatattactttagtacttggcgttagcctcttgtgtttcattgttatggagtgataaaacaggcctatggttcgataagcgtacagattttgggatataccataaactttgtatagaaagtgttgtataagtgcatatactccatcgattatgtggttctacaaaattgacataagaaaattagagagttataaaaaagacaaaagtgaggatatcaacagagaagataaaatatagtaataggttgtaaataataacaaaacttgcatgaaaacttggtaaacttcaaattttaaccttcgtatgatgattaaaaaggatatgacatcatgagaaaaaaatgagcgatctgtctatcaataattaaaggaagaagtagaaatagataaaggttttttctgcttcatctttaacagcaatatagcatattcttgtggttcgaaagaataaattctagtcattatagtgaaaagagaacaaaacaatataagatttaggggatggtaaaaatgatttcttagttcctctaatgatttcatatcctttcctgtcacatgaagagaaaaaggaaggaaaaagaagaaaagatagataatatattagtgcaacggtaacaagttgttactttatcgttctccttacaaaacaatttccttttcttcgtcccacaactctctttggaatctccaatgaatggatgaaagatcctccttcctgtcttctttgtcacccaccaaagtaccacttggagcattcttcgttgataaatttagagcagaggcgagttttaagaaagtgtcatccttttcaggtacaagggcgccttcttcgggcgtgacagagtagtcaaaatctttgaaccatcttctttgccagctaatgcctttagcttcttcctcttttctcaattctctttgcgtttcttccaattcagttttcgttttggcaattaagttaaaatcgcctaatttgatggcaccagccacgtcgtaccaggcttttctactttccagtgggtgttgctcctccaaaggcttgacattcagatgttcagcagggattctagcagcatcgtaaaataatcgtgattcttctttcttatttgccttgattattttagaagagccagaccattggcctgatattgtgtataatgccttttccttgtccttgctatctttagagtctttgtaaattcttgccttgaatgaattctttttaccagaaaagtagcctctacctgaaaattcaataacacaaagtagacctgtcgaagattggatatatgattttccttccaattcaacaaagggagaagcgacaagaataccttcaatatgcaatggaggtggggtaaccaaataactctcatccttaatatccaacatagtgtgaccaaattgtttaacagtcagcattaaggatttagtgaaactggctttaatttggttgtagccttgcagcttaaccttgttcttatcattgaagatggaaaaagcagtgacgggtggatggtgagaaacttgctcacttaacaaaaccgtttctccaaattcaggatgctctttattttcccatttaccaacgaacaactcacctagaaatgggttcaaaggttttttctcagaacctaaggattcattacgagaacagtattgagattttaaagtggaaatgaaccatttagtaacggccagcatacgggccaattcgggtgactcgacttcagggtcaattaaacagtgttctttgtaattatcgtcattgataaaagagggttccaagaatagctctggatgttcagcccagtactgagaaaactcggtcaatgagattggagataaaatgaatggaggagccgataacgaagaaagatcaccattgaatgaagcgattgacttcaagaaagaagtccatgaggatgagcttgcgtattgagacatgacttgaaattcttgagactaaatcttataaatttttcgatttgtttctaggagaaaagtttgatatatttctgttatgttcagactggtgatttcgttgaaagcgtgaacaaatagccagtttctatccaatgtatagttttctttctttgtttttttctttagtacaacagctagaaattgggtaaaaaaaaagccaatgtgatagagtcaaactcaaagaaaagtttacttaagaacttatcgacgaaatatcgttttacttggaatagtaatacttgcacagctcaagacagaactattgaaaaataaaccagagcccaataaacgtggtacttgtcgagtagtccaggaaatgggcaaaggttggaaaacaagaataatcaacgaacgcaatggcaaaaggagaagtccgcatccgtgcacctcacaattccgaaagataatgacttacgtgagagggcccaaaaatgctgcagctagtaaaacgcgaacggaatgagttactggtcccgtgaagtgattgacacaatggtcggtgcgattattcttcgtgctgtaacaagatgaggtacatacgggaaagagcttattttagttcgtttaggagctccggaaattatttgcacgaaagttttcgttgcccggattgaaaatttactgttgacatgaaagtacattaaaagattaggttctggtatattgtttatgttttacaaatgatttggaccgggaaattgcaaaagatgcttccgttgagattagacgcgagtgattgtgatgttagtaaagacgattagccgaactattgaatcagaatctggatttctacagccgacgctggatgttattgctactctacctgcagacgatcgttctaaaaaaatacctattagtctggtagtgggatttaaacaagaggcctcgctgaattcatcttcatccttatcatgttattactacgccattcccttaatgagggatagacatattaacctcaaatcaggcggaagcaacgttgtggggataccgttattagatactaaagatgaccggattcgtgatatggctagacacatggccacaataatatctgaaaggttcaataggccgtgttatgtaacgtggtcatcgctgcctagtgaagatccctctatgctagtagcaaaccatttatatatcttaaagaagtgtctcgatctcttgaaaactgaactcggtgagtaaagtaagagttctttagacattcatgattgtaatgtaatttaattaaaatactaagtataatgcggctccaaaatactgaatcaaacctttgattcgaaaatattttggaaaaaataaatgatttgattgacttgtcagactgccatttgtacccacccatgaatccctatccttccaaaatggaagcacataggatgggtcaagatcatcgcgccattaaatatcgcaacaaattccaaaggaagttatcacaattgcaacggcaaagcaaaattttattcaaaattatagatggccgaaccgctaaggattgcggaccaagctaatttaaattcgatttcatttcctcactctggggtacaaaggttatggggctcatcaaccaagttggattcagtggctcttttgaagagtcaaagagtgacgattcctatagaaatgatcctactgttgaatgtgttagtcaaaacctgaagctggtgaaatagaagatggttgttgaatacgacaatcgcattgcctaattattgggtatgctttgttatattcctaataaagtatatggtataaaacatactgaagtacgtcgacaatttttttagtaaaaagaacaagaagagaataaaactaagaaaaggatgaatgagtgaagttatcaagttgtttggaaagagctcactatttatatgtttctttaactttactcattcacctcatcgagaatggaaaaactaatgaaaaattcagccctaagaaaaatgctcgaaatacatatcgtagtagttacccacctctcgttgcaattttttccacggcaatattaacatccttacctctttacacccttacacttcctttgattacttttttttttcttctctcagtttgtttcgcgtacacaccttgggtgcccgtcgaagaattctccgctcaatggaacgtacggaggtcatactcagcttccctctagcagtacagtcgttagacagagctgattcatcttttccggcctaaactcgtatcctgtccctcccttctactcttcaccggcatgatacctttgcctcccgtttggcaaaatattcgctatcaagctttaatttacgtgtattaatcactagttcaaaacttgagttattttgccttgagcaattgtaagaatccgtaagaaaccaacaatcaaataaattgaaaaatggctgaatcccatagatgtatgttaaaactgatgacgagaagacattaaaaatattttgtgctagtaatttggaattttcaagtgaaacgttgataataaaggaaaaagcgacttcagaaaagctaccagatcatatacgtggtgactaaaatgtgcaagaatatagaaagtgtaagatgaatgcaaaactcagatttaacaccagacagctaaagggtccaagtagaacaaatcaagtataccagaactatatctaagttttatctttataataaaagagtctactatcgtttctgggtaacttataaaataatttgcagtatcgaaatttacgagatcacatttaccatcgatatccaatttgactgttaaaagctctaaattatggcattcttcgacaatggagaagcctaagcttgatgatgaagtcgcataactcttcgataatacagaatttgctagctcaataataaccaccatctaagatgatcattaaatactaacattttgttttgggattttattccttttttttttttagtgtacgtcaaaggtaagcacttatcctaccaaagatccaagagagtcaacaacccaaatgtctctttgatcaagatcgaaggtgtcgctactccacaagatgctcaattttacttgggtaagcgtattgcctacgtctacagagcctccaaggaagtcaggggttctaagattagagttatgtggggtaaggttaccagaactcacggtaactctggtgtcgttagagccaccttcagaaacaatttgccagccaagaccttcggtgcttctgttagaatcttcttgtacccatccaacatctaaatttgttgattgtataagtactctattaaacatcgttattttctcttttattactattaatattattatattttgagaatagaaaagactaatatatatatagtataatttttaaaattaattccgtacaaaaggcaaaagaaattgtcttcttacttaaaatgtctgcgaatctcgctgtaagcgcagtgaaacaatgttcccgcttagaagacgtgattcaagcggagtgaagctatgattgataataagtaacaatttagaaaaatttttgatgtttttagtaatgcaaaatatatatggtaggtatatgcatatatatgctcaatgtttattagattgaaatttcataaagtatattataacattattttgttggtctggcaaatcgcaaaattttagcgacagacattttaaatggaaaaattgcagatagtactgattttttcatatgataagtggatattattgtcaaatgagataggtattatctctagattttcatacttcttcttttgaaaaaccctaatactctttttgcggttgaatgttctggactttgggctgctttattgtctacgcttgccttgttgacctcagataccattatggaggacctgttgcttcggaccgcttttttagtttctaaagtacatttattttgcaccatcgttggtgcaggcaggtcttttgagacttgatgggatgtttgcatatttgaagcagtgatataatgattctttgaatttgtttgataactgtcatccttttttgggcgtctttgggaaggtggagaaggtttccgtttggaatccattgatgagtataaactagatttggaagtatcataagagtacaaggaaagaaagctaaatcttttctttgttgactctgcttcgttaagtgatctttctagatggttattgacgtgtttttgtgctgtagctttcgcgatgttgctacttttactacccttttcacttgtgtcctccgttttcgccttatcaattgattcttgtccttcatgttgttgaagaggagattctggtggcctcaattcatcagactcttcggtgaccgtatcgcatgagatgtcactgaatatgccgctatatctcaaacttttgcgcttctgtttgtatttttcatcatagattctcgttactacatcagcgtccctcttatacttgatcaagtcaccagatacgctttgcaaatcaacagagggttttgctactgaaaattggccgtgcgtaattaactttggagagctttcgatggaagaggatgaggttatgcatgtatctagggcaaggtatggtgtggaatcaaatggggatgtgtctctttgattcagcgtttgtgatgaagcgctacttttagctttttcgttgatctcatatatggagagcgtatttgaattgtagggaggtgttgtgtatgagccaggatggtatgaagttggccgtggctttgtatgggatgaggaagacgtacggtagaaatttttagcagattggagactattttgggtcttatttttattgtattgatgattttgtgatgaagccatgttatttggttgaatcttgcttgtttgcattgtggtagacgactcttcttctaaacttggtacaatactactcccagaaattgtatttcttttaataggtgtggtttcgattataatatcgcctggacttatggctggtggaggtgaaagactggcagtcatgtttcccgtagtttgtctaatgttttgtactggggataatgattgttcatgacttaacacatattccctatctgcgttcaccactgcctgcaaggcaacggatgcagcagagttacttctattgtgcctattagatcttcttataggtgacagccgctggtcagatgcaatagaagccggtctggttataatatgattttgtgattcttgaggcggagccgggaaagtaattaaagttgaatcaatgaccagtgaatcccttttatcactccttgagccaagagatgaggtagaacaactggattgtggtctagatccatatcttcttcttggttttgctaatctgaacacggattgagtattgtttagtttgtcccactcatcaggtgttatggataagaatgaagaatgaggctttagccattcatgtttcttgatctgtttcaggtttattcttttctttgggtctgagaccagcatgcgtcttaataagtcccgaggtataggaagaatataatcagggaactttaatggtgtggagttaatataattataaagtcttcctatatcgctgccttcaggattatttggatcatcatcccacggtaaatatccagctagtatagcgtaaagtataactccacatgaccatatatctgcttttctagcttcgtatggttcggcgcttatcactagttcaggcgctgcgtagcatggagagccacatgacgtcttcattaattcgtttcgtgagcaaaactcattgacaaacccaaaatctgtaataactaggttctcattcttgtctagtaatagattttccaatttgagatctctgtgaacaagtcccttagaatgtatgtaatgtactccacttattagctgagaaaataacctgcatgcattcatttccttaagcctcctttttttttgaatatatttatagaattctcccccgcatgcgtactctaggacaataccaatgtacctagaattttgcaacacttcttctaattttacgatattcggatgtgataagtgttttaaggcgttgatttctctgtatattttaacttctttcctgtaatcattcgatatgctatcacgtttgataagtttaattgctacttgttttgggaagtcaaaagttgaattagagctgtttgaaaaattctttggccagcctagcttcacttttccgaactctccttctcctaacgtcgaccctaggatataaggaccaaacgttacatgtttccgcctttgctcatctgttctttgagggtactgaaatgtgtcagacaaatcgttggtaaaccctccgtagtatgtatgacgtttattggtgtacgacattaaatttttggcactctaaatcagtatatagaagtaatggccaattgaatattgaacgccgcttggctcgcctttcttgtattgtggatgggtaaaaaaaatagcgattattgttaggtttaattagcaatcaaaaaattctcgcaaacacgtcacaagaaacaaattaatgcaaaatgtggcacagtcaaaaaactgcgaaaatgtgttaaagatgaaaagaaccgtgatcagcaacagcagtgtaccagattttgtgatctgatttattatagatttactcgatgacctgaacttgaattatatttaaatcgatgaaggggttgaaacaggtgttgatctgggtttcagaatttttctcttgtttaccttttttgctgttctacactcattctttcgattgttttcaattgcttttttaggaagtgcggctttgtttacataaaaggtgtgcggcattttaatgcaatatgaaatttaaaagtatatgtaacgatagcactattatttagggttcctgaaatgatatactttatggatagacattatctgttcattgagtatacagtaggggctaaaccttcttttaagggagtaaaaaagatggatatgcattacgtcggccacatgacattaattgtgcaggttcagctgatgtataggctgaagaggctacgcttgctaatttataatgccatttactaacctaaggagaatagaatctcccatagagtgagtatgttgtgattaaagagatatggtttcatctttactcgagtccattttctttatttttttaatggtaagaggatgagtatagcaaaaacggtcaagagacagcagtaagtgtcgtcgtaactagaacaaataggccttataacagaaatcataagggttgtcccgtggtcggagcccttgtcggaactaaagaaaatcaggcaatatagaggatattttctacgtacaaaacgcttattgtatttatagctccagttactgaagtggtaacttaagtaagcaataagtatgttaaaacccttttatttttctgagtcgagcagatttttgttcgaccgttgtatataggataatatgacgccatatgattttttcctctttggtagggagggaagaaattttccccgcgcggctgagtacaaaagcgcctagtactcacttgagtcataatttagcacatcatagcgtgcctgccagaaagacttggatgcgcatttctatttgatgtaagtaaggaaataggagaactttcatagcccatggctagttcggttttcagtaaactatatacgtatatgttaagaatatttcggagtgtctagataataaaagaacatcgttaaacttatgaatggtgaaggaggagaagtctcgttaaagaattcctgttgtagaaaaagtcagttctggttacgagaggaaaatgttggaagtttatatcccatccttttccttttcccagcatttctttacaaaccgttccatgttgactttttttttcatttgccctacaatccagggatgctttaacatttgcctgggagaaggcctctctctggcatctttttttaaacaatagtcgataaaagatctaaatgtcttgctccaggatatgtctagttctggctcatctttcaactggggagaaaacgtcaggatcatcgtcaataattctataggagccacgttttgcgttattttgtcagattcaaatggaaatctccctccagcaacctccagaagagttaatcctaaggaccatacatcacaggttacgctgtatggttggccttgtattcgttctggggccatataaaatgacgttccagtaaatgtcatcgctaaagagttaacagcctccccactgacaccgaaatcgcataatttgatttcccctttttcattaagaagaatgttttggggtttaatgtccctgtggatgactttcctttcgtgtaagtatgataaacctcttaagacagattctgctatctttcctatcaccctctcacttattctaccgccacgtttcaacaaatttttatacgttgcctccagtgattttcctcccatatattccatggcaatgtatattgaagaactctgttcgtcggtaaacataccatagtactgcacaatataatcggacttaaaactcttattaaattgtagctctctgaatatttgcttttgatattctgggtcagtattcatagtgttgattgtcttcaacgcaaaaaccttttttccattttttaatcggcacttggctacagaaccacccgcgccttctcctagaattcctagtgtagtaatctcatccttgagatgcccaaacctccatgcttcttcctctaactggtctacgtcttttccttgtattaagttggaacaagaaattatgttatttgcacttaaaggggcggagttgctcccgctactgctgaagtcgtacgcagaaagaagtgtcgaggggtatgaatcctcgccttctggtgtgtcgagatctttcttgataaaagtggtatctatgttggataacttagtggaaattggagcactagatagtagttccttgtaagttatatcaacatgcaaattagaaaatctttcagaaagctgactatcgccggcaactctatattctataccgtcttttttttgcgttagtactaggggaggtaatggaggtggtaccggtctatttttaatagttgtagtagatgatctattgtacaacaaagtggaatttgaagccatggatgacgtagtggaagtagctgaagtgctattgttggagtatgggctttcgttcactgacgagtacggtgaccggttgagatgttgcccatcattagtggatttcgcattttgaactaaatttactggaagcgttaattttggagtcttttggtgactcctattggattctggtggtctgaacattgaagccattatcctgtgtatataattggtattttgtagatatgataacagtgcctgctatgctaatcaggtaatacttgctactagtaaaatgtctaattttttgagcgaacgaatttcatgcaaattagaaggtagccaacatataaatatatgaatatatatgtgcctacgtgtttgatgaggttttcagtaaaattaagcggaaagtattgagctttcccaactgatccctttgatttattctctttctaattcttcaactctaaggataaagtttatttctttttgattttttttcgcattgagaaagtgaacataaacaagggtaaaataggctcaatatcagttcacctttgagagtctggcaataagagatgtggttctaaggttaccttatacattctaaactctgaaaacgcgttttcaaaggtatgtacatttctctatattaaagagtagatccttgccgtttatatatacatgtagagcaattctcaagctaataattaatgtttacttcagacaataaaacattaaaaacaaatttttagaaaaacaaaagctgaagtaaagactaaatattacacaatttattcatacatttccgccccaaactcaaacagcctaaataatataaaaattaacttttggcagctccaacctctctactgccatctaaaacttttccagtaaacggcttatatacagttaacaacccgtcactatcaactgtagcaactagatcctcaatgtatttgtgataagcaacggtattaaccttattattttctcctatttctcttctgcagccctcagtgtgataaaatgccatgctttcggcctccaattcgtcagatattatgccttgaaagtcctcatgtatctcgttataaatggcaaaaacaggttcgaaattccagtggtaaacattacctaaccctccaattgtaaccacttccataggcgaaatggaagaaaactctattttggacacttgctcgctataaaagtgatgaactttgaatagttcattgactttattatgtccttggttgatatttaactcagcatcagcatcccctaaagcgataactgcacgtatatcccaaaccttgagagccccaccactagttcccgtcataaataatgtatcaacaaacggtgatgcagcaaaacaagttgttttgccgtccaaagaatcgtttagaatccaaaggggctttttgcctatctcattaccccaaaaccttatgataccgtcatcagaacaagtggcgaatatttgattattcaaaaacttgatttcttgaatattctttatgccaggaacaggtattgtacgaagcacttctcctattttacctgagttgtctatcaattttattgtagcgttttcattatcaagatgtttttccttagttactgttaaggtttttgaatcgttagaaattgcaaaatcaacacagggtttattttgatttccggacgatgctgaacttagagaagtggatggctccatcattgtgtaaacgggcgatttgacaccttctctgaaccatgccaaagaaccattggtagaaagggctatcacctttacatttatttcgctgttatccacgtaaatcatctttgcaatcgtttcacctttaaattcccattttggaatcaaaacagtctgctccaccttttgagattccatggtataatccggttgtactaacggttctgaaatgctttcaggttttttgtaatgaagtccgagtggcactatacaatccacctcaaagatttcactcccttgagaatataaaagtggtacgctcaaaacacctttggatttattacatgagctatcgttagtgaaaactatactcctaagtgtcgatggagattcgtcaacgcctgagccaaagataggcttcaaacttgaaatatgttggtataatgagggtattgattttttccaaattttgaattcttcattttttattttgttgtcttctgcaatatctaaagtgctcattttaagtgattaaagaaggaaataaatacgatactgaaggtatgcggctgaggagtggtgctttttcattcattcgatcatgaatatacaaagtattgcttgaaaaaatcaatatgcgcttattaaaatttcgcagcaaaatcggccgaacccttgcaaaacagagatagctccgctttattcacgtgaaatggggtcgaaattgaagactatccaaataggcgttgcctatgcaaggacgctccaattgatatatcatcactacgaagtatatatatatgtagaaactgatatttgattaggctccaacgccgttacaaacctcttcttaaaatttcctcatagtattgtatatttagttgctttttcctggcctgtatcagatgttgcaacctttcttgcatagattctaaagagtcaatctgctggaggtattgttcctgattagtagacacccaatccaaatgtctgttacacttccacttcgtgcatacctcatgtattttggtggcttcctcattacttccaaaatctctgacaaattcttccacagagcagggtattcgctcgtatgtagaacaatagccacatatatttttcctagccctactcctgctgctatttttcttcttcttcctttttgtccccttggaatcttctttaccacattccacatggcttgcagcatcatcgtccagcttgcgcatttcggtatatacgttgtctaaccatcccaaatatacttccaaaagttctagcttttttttgaataatggtagcgatatctcttgaacctcttgcagatcatcttcaagagtttttaacgtcatgtctcgtacaacaatttgatcgaatatttccttttcgtcatctgtttttacaactatattgttatcaatgaaatccagttgtccaaatttcttgaatttatctatgtgtcctgtttgttcgaccattttcttgacgactgctctatcctcatctgttttcaatcgcgaccaaatatcattcacaaattctctaccatgttcctcagaacagtatttactatcctgtaaacatggtttgtagcaatcacttatcctacattttcttttccataaggtttttggcaagctcccttcaccattgattatggcgtccttattcttaccagtaatccccgcttgacagtaaggacaataaaaagagaacaccaggtccttaaactgctcaggaatatgaaggcaggtgaaatgaaaccagtcatcacaaccatcacatcccaccatcagctccccatagtctggccttttacatatgcagtatacgtcctctcctgtagttggatttctttttaaggtggaatgcggtggacaccattgtggtaatgacattagaaagataggctgagaaattattgaggtcgaagtagccttttccaaatctcttgttttttttcttctgatgagcttcgtttacatttaaaagtaagcatttacaaagcccaattgaaattgttcatattttacccgccttgggttatatgcagtgtctaatatgtagccgaacatatcaattgattctaaagaggtaagcttaatcctctgtgctttaattcatcttaaaaagtttatctgttaagtctatcgaatatcgccaaatttactggcggtatatataaataaatatggaaaatatgaaaggttgataaaaaaagttttatgcagtgaaaaaaaggaagaagaaaatggatccatcagtgaagagaaggattcatgtatcttcaaagtctgattgacctctccatcgacaaattatttaatagtttgtcataggtagcagtgactttgacttcacaatttgggtcgtcagttgagactgcaggcaatgtttctacggatcctttatcggtattgggcgcagatacatcagaatccacgcctggtgtaaatgtcgaagcgctattctgaatggattcaccataaatgttctccaattctatgttgttggagttaacgttctgaatcaaatcatcgatagaatcaatacctttagccttcatgattgccgatcttaagacagcaccggatggaatttttggtaaaatcttaggattagctgggctaaataaactagtggtagcagtttcattgttagaagttgaaactgaaggagatgaagttgacttaccagctgtttctgtgttgataggcgtatcacctgatgcaaaaggtgtctgccttgttgattcattttcagggtataaagacctctgctgctgaacgaagaaaccccatttatgtagttcaccttcttcttcttcctgctttttacaacctacagaagtactagatgatgtatgcttgaacaccaatggtttgcctgtgaaaacgtcaatagttttaccagaatcggtggccattaaatgtggtcttgctgtaattacatcattctcaggttgtattttttcttcgggaacatggtatccggattcaacgtgcttcaatgctggtaattttgaatcttcgctggagtcaacactttccttcgaatcatccctgctggatccaaggacatcattcagattcggattatgcgaaaacaattctagtatattgcataagttttgttccaaaaggagtaatcttacaaggttttctttttcttgcaatggcaattcacctgatttccttttttcgaacatagtatctattgtatgctgaacattatggtgcaagatatggaacttttcaatatattttttcagcaaatatctcttcgtggtgtcttttttgacctttgtactcttatcgcttaacaagttcagtttttctaaaacactttcagcggtcatagttactaaagagccatcgaatagcaaatcatcttgcgaatccaattcatctaactggaaagtcgaatccatggtccgtttcatatttctcatcaagcacagtgctattcttgattgaatctcttctgatatcaaatcatagtcaaaatctaaaccaatcaagtttggagagtctctagcaaatgcgtaaagtgtggatgaaaaactatttttagcaaattggcccttaacgtccaatgtgctcgaactatccaagtcgccgtctgtgttagtttgttgaacgggagaatctgtgccgttcattagatagaagttttcaacgttttgattagtcattgacacatgcgagagcgatttgcacttaatcaaaatattacaaacgacagctagttcctttaatgtcaaattattgctatccaaatgtatcctcttcaggttcggaaatcttggtaaatacttgtacatgtagggtaaaatgtcaggaaagcattgcgacaaattactcaaatccaaaaaaatcaagttaggcaacttagaaagatatttcaagagcaaagctaaatcataagaagtcgaaatattagtgctgttcaaaatgaaatatcttaagttatcatatgatagagcagatagtttaccaaccattggcttaatcatagtggacagatcattaaacgctagatccacaccctggacgttatattgagacatccaattgaagataaatttcagacaatcctgagagatattggaagtagtggcacctgctaaaccaagcctgatgcccgattctggaaagtttttttgggtagcaaaggatgtcagtaaacgtgcaaagcatgagtaaggaattttgctaaattgaataccattgaataacaattcttctataggtttgtgagatctctgagacaagacgtcagtaaacaagttccaatccatgttatggcgatatagtgattcagcaaggtcagatttgattttcgtttgggaaatgtcgagcttgttcagtgatttgtttagcaaaaggaacttacatagtaatttccatccatcttggtcgattcgtacatttcttaaactcaatttgtccaaaactgtggagtttaccaaagcagaaataattattctgaacatatcctggtttaaagctacattgtcgaaaacaatcgtgtgaatgggagcaatggtgatgaaatcacaaaaggaaagaatatcgatcaaggtaggcttagggttcaaaaacttcaatatttgcaagggagctgtcttgtcctttacttgtcttagggtagacggaatgggtaaaatttcccttaaatggcagcatcttgtgtaaataacatccagcgtaacttcgttattttcaatagaatgaccgtcttggtacttatcttgatcaggttccttgaaatagtgctcatgcatatgaatgggcttatcaatgccggcttttgagaggttttctgcaagtttattattctcaagctcccgatcagcttcaacatttggaggtgacacctcttctctttgcttcgtaatggtgccttctgatgacttttcagtaagcttaccgcctgcatccgaagcagtcttaaaattggctacttcaaaggctattctattagcagcaaaatgagcttcttgctgatgcttagcagcctcccttaaagccaacttttgattttccagggcgagtatatattctttagacttcttagtgtacaacggtcccttaatgttggaattggttgacttggccgattggttgctactggaaatacccacggaaatagaaggaacctcgcttatcatgtcatcagggataaggatgtttcccttttttggggttcttgaaggaagttgttggggaggatcggattcgaatttatcgacggcaaacgagacccttttcaatgaaactgtagataggtcttttactgcaagtgcaggggaggggagtataggtgtctgtggcttgctagctgttggtgccactcctctcattggtgatgatatctccttcacccgtggatcaggagtcgcaactgctttaatgccaccagactcattctcagtcgtgctagtattaacaacaggtaatggtttcttggcagtggaagctgaagaagaggtagaccgtttgctaaacaaagatccaaaaatcgaccttttagtcttttctccactagtcgagttgcttctcttgagagtagcattagatggtgaagaaattggcgggtgctttcccttgccaacagaagaagatgcggtggcgtttatggcagaactggccagtcttggtttggacgagaccacagcattggatatagaagtggaacgttttttccttacaaattgagtacttgagccgttgtcatcattatctataaggtctatggcgtctacggtagccggattatcaatgtcagcggaatcgctccggttaccgctattaataggagtaagtagcggtatgttatcagtgtctgatgcagaggtattaccatcgttcctcttcaaatctggtttctcagtattacaaagtgctgcattggatacagatgacgacctcgcacgaggcttatcattgctagacctgttaccactcgtgctattgtctccgtttttcgaagaggacgtagatgaagaggaggctggcgacgtagaaggcctcgatggcttcgtatttgtcttccgtctactcttacctttatacaaccaatctacgggcacatcgaactcggtgttagttatcataacctagatgctatctccactccctatgcttgctttggtggactattgtttccgttattcgcaatttctataggactactatagattatataaactgaattttagctttatgctgtggtgttatttcccaaaacacgctcttctttcttacgctttccgttagcttatttgctcacggtatcaagattacttttttttttttttcttcttttctttttcttgcactaccctcttcttcttgttcttccttgcgtttttacccctcttccctttattttgcagcaaaaagaaagatggaaaggcaaaagtgaaggcatgatgatgacaaacttgaaaagaaagagaacagcgaaaagagatgaataatccatggcaatgactgcacgctcatgggtatcaattggctaggtctaatattgttattgtttggagtatggcgtagagaagtggttccttaaccttaattaatgcccgtgccatgatgattgcatcactgagacgtaatgtggaaacaccacttctcggtccgcggacatcaaccgaaggaaaaatgacaagctatttccgtgtatatccgcgccaatcccttcggggccgaagttcggaggctttatctccgcttagccaaggccgtcaaaggcgataaggtgcgttgcaccccaattagccatggagaaggaaaaaaaaagcatgtatgatcatgatgatgcaaaaattgagaggaaaaatgactcaggctatttatataagtaaatgaaagggtttcgttgtagccttttctgctctcttccttcgctcttccgcatatatatttgtgttcagagattattcttaaatccataagaacatcccttcatataacaattgaataaggaaaacacaacacataacacatatttaacctgatgcttcctgttataacgagatttgcaaggcctgctctgatggccatcagacctgtgaatgccatgggggttttgagagcgtccagcataacgaaaaggctttatcatcccaaggtcatagagcattatacacatccaagaaacgtcggctcattagataaaaaattgcccaacgtcggcactggtctagtgggtgcgccagcgtgcggtgatgtgatgaggttgcagatcaaagtcaacgactctactggcgttattgaagatgtcaaattcaaaacttttggatgtggctccgccattgcctcctcttcatatatgactgaattggtacaggggatgaccttggacgatgcggcaaaaattaagaacactgaaattgctaaggagttgagcttgcccccagtcaagttgcattgctctatgttagcggaagatgcgatcaaggcagctattaaggactacaaatctaagagaaacactccaaccatgttatcgtaatgaataagaagataaccgggacaagaacaagatcaaaccctcactaatcaacaagttggacttaatttgtgcaagcatggatgtttctcattaatattgtcatatttctttcccttaatctagcatttcctttctctccctcttctcatgcatatcttcctagatatatttctccagggtgaaagcgggacggacgtgcttgttttacctcacctggtactactagtattttcattactcttttttcatcctcccacttcccccttatatatttgttttcccatgtgtggtatatggcatcattattatataaatattctttagttgtaaaaggctgttttaattaacactatttatcgctagacaaaactagactttcattatttccttcatttcaacgcttgtttaaacatgtgctaggtaagcgagttttttacttttacttccaataaatatatatatatatatacgtatacatgtatgggcgggctacaacaaaatgaaataaaaagcgtcaggatcattgttttttaccatacttgacttctctgaaaaaatccatgacgttcgtgaaaactaccaacaataacccaccaccgggggcaagtctcatgacctttggcgcaaatcccttatacaatgctttaaacccttcctcacggtaaactaacagcactgaaggcagggaccagttgtacttcctcagcggcccggaacttctttggatcctagattttaccacgtcaaatggtgtattcaacaagcacccgacagtgccaccaatagcacctgcgatcaaatcatttctggtcttttccgtgcttgttttagccgccggcaaaagcttccgaatttggaatattataccgaaataaccggcattccaaagaacgtgtctccagatagtggcttccaacccattgaaaagtgacaaaacaccacctttcacaacactattctttacaacttcaatgggtgtcttgaactgtgaattcacatcctgtaatctaatcttcactagttcaaaaggcgcgacgacaaaggcttccacggcgccagcggacgcaccactgtatatggcgattttttgagtcatctccccattgggcgtggggaaaatctttttataaaacgtttggaatgtatcgtttccggagaacttaattgctcttttcggagcctccattaatataggcgatgtgatacccttgtaaagatgcgaaaatccttccttcttcacaatttttgtaagacaatccatcacgcccgtgtagtgatctactgctgctttcgctgcaacaacagcgggatgacctttggttgtcacttgtaattgcattcttgtcttcaccacgtccaatggatacatcaccaatagctccgagacgccggcaatggcaccggctgtgaactggtatatgaacggcaaaggtctattatctatagatgtcatcttacagttctttttctttcaccctcgttacagttctatcttgagaataaatgagataaaggttcccaaaagtcactgatatatatcaacggcggtcaccctcacagaaatacccgagaatctgcccttcgccaaatcagattcagccagttcgcagtttttttccctatctctggtcgccgcattatgaaaagatcctggggtaataatgggaatgatttgaaaaaaaacaaatgctggtagaaaaaggtcttcgtattgctcgtagtaatacggctatttcaagtaactgctcgggccagcggcttgaggaaaaagtaaacccgttactttgctttttaatgacgctggaaataccaattacctactatgtattacttatgcttatgacaaagggatgaaattcccgacgatgcaaattgggatgttgtacctatcccttctgatagtgaaactaaaacagcatggccgtttgcggattccatctttggttcgaagactacaacttgttaaaacagccttctgacccttatcaaacgctatggacccgtatttttcccagaaattcacagcgctttcttctgtcatcaactcgtagatcgcaagctttccatcgcgtaaatcatcgactgtgcagtcaaccagtgaagcaaactctttattggctctgtaaatctcaccggtacgcctacacaagcacgctggcatgctcatagaggtgaaaacacgatcataagataataacatcctctcgaagctctcctccactaaaactaagtcaacatccttcaatgaacgcgcaatggttctaaacgccggtctaatggtggatagtggtttcagaatcctttgcttggaagactgattcatatatttgtccatgtagtcttgtagtcttgcataccccttggcataattatacggcttcaataatcctgcttcaagcttcgcatttatgaccaacttcagccggtgttctggtgtcatctctgttgacggatccgccgctgttaaaaagaattgttccttcggtgtcggtgcactgttttcgtttgcattcgctagaattcgagactcttccttttcttgatcttgtttatcccctttcgagatactattggaagaacctgacataatagtaggcgacctattttcttgtcttgccactcctatttcatccctacgattgtcgttttggtactctaatggcgattgtgtggtttgtgagccattttccaaatgaacattgctcgcactgctggaacttagtgatgtttgagtcaatagaggattttctagcatagaaagaaattcattcaaagaactgaattccgaaccaacattctcggacacaaatacaggttgttgcggaagcagcaagctggttgtatcatttacaagagaggagtctagtttcggtgacagttcctctccatatgtggatccacttttattgactggttcattctgatagtcagacggaattccagtgtgtgctttatttgcatatttgccctgtatattattatcattcggagaactttcgtgctgtgatggcatctcatttggaaccgcaatatcatcttccctgcataaatgggcaatatccctcttgacgcacctagaacatggacgttgcttatcacatacaacatgtgaccgtttacaaaataaacatgttttaaaagccttactggctcgttttacaccactgtttgctgacattatttcgtcagtttatataaatatgtgtattttgtgttgattaaaattaaaaaaaactttatctcactggcaaagaactcccgcaaattttctcataagaattactttcttcttccatcccagagacctcatccttttttctaatattcaactatttttcattttccttcgtactctttgttttgctttttcttgttttctgccattccaaaacattattctccccatctaaggagcggatctgtaggaaaaacagcgtaaccattggaaaaccctttccctaaccaatgccctttgacggatgaaacatgatatatcttttaaggacatagatactaaccaatacaaatcaaagaacagtgaagagtctaaaggggcagcgaacgcttaagtatcttctttaaagtaataatattcctgtcgcaggtgaaatagcacttcagcgcacaaacaaataatattgcagccaaaattccctaatattgtcatgataagaatatgtcccattgttagatctaaggttccactgttaggaacttttcttagatccgactcatggttggcacctcatgcgctagctctaaggcgggccatatgcaaaaacgttgcattgagaagttattcagtgaacagcgaacaaccaaaacatacatttgatatttcaaaacttactagaaatgaaatccagcaattgcgagagttgaaaagagcaagggagagaaaatttaaagatcgtacggttgcattttatttcagcagcgtcgcggtacttttcttgggtttggcatatgcagcggtaccactctatagagccatttgtgctcgtactggttttggtgggattcccataacagatagaagaaaatttaccgacgataaactcattcctgtagatactgagaagagaattcgtatctcattcaccagtgaagtatcacaaattttaccgtggaaattcgttcctcaacaacgtgaggtttacgttctgcctggtgaaacagccctcgctttttataaagccaagaattacagcgataaagatattattggtatggctacttatagcatagcgcctggtgaagcagctcaatactttaataaaatccaatgtttttgctttgaagaacaaaagctagctgccggtgaagaaatagatatgcctgtcttcttttttatcgatccagattttgctagcgatccagcgatgcgaaatatcgatgatattattttacattacacattcttcagagctcattatggtgatggtacagctgtaagtgactctaaaaaggagcctgagatgaatgcagatgaaaaagcagcgtcattggctaatgctgctattttatccccagaagttatagacacaaggaaagacaactcaaattaattgtaaatacaaagtcattcaatgtacataaatactgttatgcttttgaattaagtaaaacaccatgacttcatattgagatgttttaagcatataatcacggcaccgaacttcttgtaatcatcaaatctttgttttctagccgtcatagaaatgaagaaatgaagattcttgttcatgtgatacagcttttctagacagctaacttgtacatccagacatcctaaaacacccataaagcaaaaaaaattattgaaatattctcttttttttcttttttttttttctggtggctttcaatgcggaatcgctcacatccgaaaatttcagaggcttcacttagcgtcgcagatcccagtagtcgccagatgctttgaaaaaaaaaaaaataaatagaaaagtttgtagacatatccgatgtagtatatttcagaggccaacctttacttttgttttctcctacacttcaaaataaaagacaccgtcacaaatctcagcaacaatggctttccaaaaagacgctaagtcctctgcttactcctctcgtttccaaactcctttcagaagaagaagagaaggtaagactgattactaccaaagaaagagattggtcacccaacacaaggccaagtacaacactccaaagtacagattggttgttagattcactaacaaggatatcatctgtcaaatcatctcttctaccatcactggtgatgtcgtcttagctgctgcctactcccacgaattgccaagatacggtattacccacggtttgaccaactgggctgctgcttacgctactggtttgttgatcgccagaagaaccttgcaaaagttgggtttggacgaaacttacaagggtgttgaagaagttgaaggtgaatacgaattgaccgaagctgttgaagatggtccacgtccattcaaggtcttcttggatattggtttgcaaagaaccaccactggtgccagagttttcggtgctctaaagggtgcttctgacggtggtttgtacgttcctcactccgaaaacagattcccaggttgggacttcgaaaccgaagaaattgacccagaattattgagatcttacatctttggtggccacgtttcccaatacatggaagaattagctgacgatgatgaagaaagattctctgaattattcaagggttacctagctgacgacattgatgctgactctttggaagacatctacacttctgctcacgaagctatcagagctgacccagctttcaagccaactgaaaagaaattcaccaaggaacaatacgctgctgaatccaagaagtacagacaaaccaaattgtccaaggaagaaagagctgctcgtgttgctgccaagatcgctgctttggctggtcaacaataaattatggatatataacgtcattttgagatattttaaataaagctatcttcacataacctttgtattcatttttagttaactcatttacatcatccacttactacatttgtattttttttacgatttgcgtaccgcctcattactaccctttttttgcactgcagtaatagtacactcaaatcatgatgaaaagagaaaagaaaaaaatgccacaaaaagtagttgattttataaaagttatcatccaattttaggtaattttattctctttatgtaacgaacatatgaagatttcttctctagaatggcattctaactaagtccgtgccataaaatcatcactaacaaatataagatcacgctatactatcaatgaagaaacaaatattaatagttgctgcacaaagtattttatgttctactgtttttggcgagcgaagtaatgtaggcctttccactgaagagctaggaggtgactcaattttatacttcaatgaagaccctatagtgattgaaatcgataagaaagctattgacaagaagactttggaacagttggcaagcacaagagatgttgttcttactgatttaccggacactcttgagtttatagacttcaacgagtacgcgaaaatgaagtcaaaatcagatatgctactagagtatatcaacgaatacgaatttgatgattttgaaagaagttctgaaggcggtcttgaagaagaagaagaagaggatttaatttatgacttcaatgcccaagctgaagatttgggtaagcttggttcaaatatatatgaagtagtcgaagaaaagaatattgttaatacttacgatggaaaccttatcaatgcaagtacaactgaatcaacgactactattcggcctttcgtgacttctcactcctacgttgcttcttctacaccttattcgaatatttcatcattgaatgaggactacgataatgcgagcaactttttgactcctacaacagtggctcttgcggtacttttaaccattttattatttatacaggcgtattaatagatcattattttatttaaataagaaatattgttggctagctttcctgttttatttactgtcactttttaaaatcactcaagacgagaaagctctttagcaaagtactgacaaaaaacttgaagtttgaacttgttacagtattacacgtcaaggctgtagtgcggtgaaaaaaaaagaatataccgtaatttttctccttcgtgacctcggagctgactgatattagataactaatcatggtagctgtatgttcgttaatctcttttagccacccacccatatgctttttgttttgttagctaaaataatactaacttacgactctattctcatcattaaataaccaacagacagtaaaaagaaccatccgtataaaaacccaacaacacattctgccagaagtgccaccagtagagaattttcctgttcgtcaatggagtatagaaattgtattattggatgatgaaggaaaagaaattcccgctacaatttttgacaaagttatttaccacttgcacccaactttcgccaatcctaacaggacatttactgacccaccatttagaattgaggaacaaggttggggtggatttcctttagatataagcgttttcttgttggaaaaagcaggtgagcggaaaataccacacgatttgaactttctacaagagagttatgaagtggagcacgttatccagattcctctcaataaaccacttttaacagaagaacttgcgaaaagtggatctactgaagaaacgacggccaatacaggcaccattgggaaaagaaggactaccacgaacacaactgcagaaccaaaggcgaagagagctaagacgggcagtgcatctaccgtgaaagggagcgtggacctagaaaaattagcgttcggattgactaaactaaatgaagatgacctggttggtgttgttcaaatggttaccgacaataaaacaccagaaatgaacgtgacgaataatgttgaagagggtgaatttataattgacttgtatagtttacctgagggattattgaaaagtctatgggactacgttaagaaaaataccgagtaataaaaggtaaaagggcgttaaatgcgcgcttttatgtttgtataaataaaacacgttgatattttgtcttatataaactttattccaataaccgcgacaccttaccaaacacatattattacaacacatttttatcttggattttaagtaattatacaacagttttcattttagaaaatgagaacatcaaatatatacattccaatgtaatagaaaatggaaaagaaaaaagaataaaaagaaaaacacgaggggaccaggttgctagaagatagggtgaccacgtcaaaagaatatacctagggaaccaaacaatgcgaagttaacaacccatcaaagtatttttaatagtgagtggttcaatagaaaattagaagtctgttcatttaagcgcgctacatcccatcttctaaatgaggatcaaaacctgtattgtccgatgtactattgccaaaaagtccgttagatggcatattatcactattttgcccatgtgaatcctcttgatgagtttgagtgtcttcagtagcagatgcagctgatgaaggatgctgagataaattttgttccataatagttgacgaatttggagattgagagaattttttctttgccttgtagattttctccaagttaccggtcacttttatcaaatagtcaggcaatggtttgccactcttcaagtattgtaatttccaattacgggctttatctttcagttgtacctgcgtcctgttcttcaaattttccgtgattttaccaccgggaccatataaatctagaatcttagaccacgatgggccaacctctttcaggccttccactaatgcttcttcttcctctttggaccaagttcttttcgcctttggttttcttaatccgatactaccattattgttgctgttactgctgttgttatgagaggaatgaggaccagagctgctgttgctcatcgaggccgcaacagcggcatccacaatggattgtgtgatagcggggtttttggaagacacatctgtggtaggtgtatgtgtgctgtaatgattcggacgagcagttgacaaaaaagcagacgcactgcttggctgattttggtcgtccatgaattctacggtcctggtccctgtagaaaagagtacttgaggatcaaactcgttgacatcaaagtcatataatggtgattttccgcgaccctttctgccccatatgatgagacccatatttttattacaataatccagcaactctctgataaattgagcccattcgtagctctgggtcagagagttaaaatcttggacgatctttaaattttctctccgacgatcgcacctttcgacgaagtccttctccgatggagtcaaaagtgtaatgtctccagaatcgccggttcttctctgcacgagaatatcagccagattggatgggaagattaagtctagtagctcttgtttcttttctaaagaaatttcgttcgtctcgtcctgaaactctttcaagccggcaatgtaagcctgtgttttcagatcaagatataggatagcctgcgatttcaaaaactttccgctttgttccagggagttgttaccgacagtgtttgtatttggacagaaaatatcgagaaatatcgactgtagcagctcaaacccgtaattaaggcagttcagcgacgtcaatagaaatgttagcagattcgcctttcttatggcagtaataataaacgcttcgtggcctctcaatataagggggggaggggagttgggaaaccataaaccaggcgccacgtcgtgaacagacagtaacggagatctggtgtggtaaatcattctgatctgcttaaagagcttgactaacgtttgaaaaatttctgtttcgcctgagcttaggaaagccgtctggtccgtcaaaaccgctataatattgggagagttggcattaaggataagaaacctcagtagttgagtggagatattgtccagcagacataatgagcatatggtcaacctagttcttgcaggcaggctttggatgatgtcattgaagcggtttaagctttcgttattattgggcacttgcgaatccatgacaaatggggaaagaagtgagtaaagaaaaactaatgtaaaatgatttctgtcgcagatgggacagccacaatcttaaatgttggcaaggatataggagcaaaacgccaatattgagatgattgtttattataatgtttacaaggaagggcaaagcattgaggaaaattagtcggaatgaggtctcgccgggcttctacggaaaggggcgaaaattaatagggcacggtgcagaatattagggcttcaaatgttcagattttaaagccttttcttcaaatacaataattaattttacacactgtaccttgcatatataagagaagagaaatttataaacagtatagttagttagttaagaatggaatttgaataaaatcataaaggagatatttaccgaataagtaacaaatagagaagggagagattaaaaaatgaaaatttacagtaccgccaacaaacacttgaataagattgaaaattagagagaaaaaaatttagaaataatacaaaatactaatagtgatgggacacaaaaatgaagaaagaaaataggtttgatagtattgctatcaccattgacattctcgtttggatattcactttttacgtggagagtttgaccttcttcttgtttagtttaataatgccggaggggccctttggttgcactaactcgccgttttcaacacatttcttgatagcgctattgaacagatagtcaaaatttgagcttgttttcaacttggaggagaaagtgtccttgacatacttctttaaaacgatacggctggagcccttaccgtcattaagttgaggcatgcttttaaggatcatttccttgtaggtcaatgaagaaggcgaagaggccttcttggcggtaacagtaggcgatttttttttcactactttctttggcgctagcttcgtggatgcggctttcgcttttgatgcggttgcactcacagaagtggcggcttgcttgggttttggactgacctctttttctttctttacttctggagatttcttcttggccagtttcacagcaccagcgggtccctttggctgttcaaaatcgccggcctccacacccttctttatggcattgttgaagtacaaatcaaagttgcttgcggatccgacgatcgggtagttttccttgataaacttcttgagtgccggacgactggatcccttacgttccttcaaagccgtgagcccttcaatgatcaactccctgtaactcttggaggaagcttcctccttttttgccgtggttttcttgatagcggccttggaagttgatttctccttgcctttgctggttgcaggcttcttgcccttacttgtggtcttggtagtggatttcttgggtgccatgttgctttagttgtattataattgcttccctcgctgccaagcattatcaggtgcccataaataacaactccccaaatctatagttgctcctcctctttaaataaaggcagataaacaaaaaactttgaccgcccgcttttccacacaaaaaacaaacaacagcagaaaacgcgacgcgaaaatgaaaagccaaagagaacaaacaaaaatcatccatcaaacctgttattgtgcagaatagcttttacctagacgcaagtccctaggagggggcatttttgacacagaatagcatttcatcaaagcaaacagcaacttcttggagatttgtattgcttggcatgtcaaaatctagcggtcacatcagtagggtaacaaaatagcacgtcagggttaaggcggcctactgcttagggtacgtggtaagtgatgtaaaatgtgagaaggagaaactagaaaaaaattttcctttctttttcctagcgatgagatgagatgaaatttttcgaacaaatgatttttggcacagtttacatatcagttatattggctgtcgtcacaggaactacaagtacaaaccagaaccattttagctgatcaccagaatgacgcaatccctaggtatcgaacagtataaactgtcagtcgtatctggtgggaaacccgctttgaataatctcagttcagtaaccggcaataagaatatcgcccgcctatcacaagaccaacgaaactatattataccctttaacaatcagatcaaggtgtattctgtggaaactagacaatgtgttaagactctaaagtttgcaaataactccttgttatccggaatatttctgcaagaagaagagaataatgaatcgattgtaaagattctgctgggtgatataaccgttccgcaacaagaagacgctcatctgattaccgtattcaccaataatggtcatgtaattgttttaaattataaggggaagctggtcgagtcccctaagcatttcaaaatctctttggcagatgaaaagcttgcaaatgttttccatagcgagggcaactatagaattttgacaacgttcaaggaccctagtcaaaaggcacataactctttgcaatcgtacaggttatatgcattaacctttgacgatgctaaaaagcaatttgaagtggctcatcaggcagaatggcacaacgttatcttgtcaaatatttcttccaatggtaaactgctagcgcatatgtgcaaagacgtctcaacaaaagatcacgaacacaaatccatctcagttgtttcgctttttgatgattctgtaaatttaagctttcccctcggttccatcctttcttcacagactcaatccctatcctataacacaaggtacgtttctagcatggccatagacaatatgggtcaacaactggctgttggatttgcctccggagttataagtatcgtaagcctggccgatctacaaataagactgctcaaatggcatatagactctgtgctgtcactctcattctctcacgatggatcctatttgctatctggtggttgggaaaaagttatgagtttatggcaattggaaacaaactctcaacaattcctgcctcgtttgaacggtattataatcgactgtcaggtattgggacctcaagggaactactactctttaatcctacaaatgactgaaaacaattcaaattctgactaccaatttttacttttgaatgcttctgatttgacctccaaattgtcgattaacgggccattaccggtgttcaatagcaccataaaacacattcagcaaccaatctcggccatgaataccaagaactccaactcaattacctctctcaatcactctaagaagaaacaatctagaaaactaattaaatcgagaagacaagatttcaccactaatgtagaaataaaccctattaacaagaacttgtatttcccacacatttctgctgttcaaatttttgacttctataaaaatgagcaagttaactatcagtatttaacatcaggtgtcaacaattctatgggtaaagttagatttgaactgaatttacaagacccaataataactgatttgaagttcaccaaagatgggcaatggatgattacatacgaaattgagtatccgccaaatgacctcttatcttccaaggacttaactcatatcttgaaattttggaccaaaaacgataatgagacaaattggaatttgaaaacgaaagtaataaatccacacgggataagtgtcccaattaccaagatattgccttcaccaagatcagttaataatagtcaaggctgtttaacggctgacaacaacggtggactgaaattttggtccttcgactctcatgagagcaactggtgcttgaaaaaaatttctttaccaaactttaatcatttcagtaactccgtttctttagcttggtctcaagacgggtctctaatattccatggtttcgatgacaagttgcaaattttagatttcgacacttttaaaaagtttgaatcattggaaaatacaaagacggtcagtgagttcacgttagactctgaaatccaaaccgtcaagttgattaatgacacaaatttaatagtggccaccaggactacattaaacgccatcaacttattgcggggtcaagtcataaatagttttgacttatatccgtttgttaacggagtgtataaaaatggtcacatggataggcttattacttgtgacgaaaggacaggcaacattgccctggttataaatcaacaactaactgatctcgatggcgtaccaactatcaattacaaatcccgtattattatattcgattctgacttatctacaaaattgggtaattttacgcatcatgaatacatatcttggattggttggaattatgatactgatttcatatttttggacatagaatcaacactaggtgttgtcggaaccactgtgaatactcaactatctgatgaagttaataacgaaggaatattggatggcctggtaagtaacaccatcacaacttcggcatccaatagcgatatttttgcagaacaattgcataaactgtcgtctaggggcaaaaaaagtgacactagagataaaaataccaatgataacgacgaagatgaagaagatatcgctttggaatttataaatggcgaaaagaaagataagctagtcaatatgaatagttttacgagcatgtttgacaacattcaaaacgtgcaaatggatacattttttgatcgtgtgatgaaagtattaacatagctttagggttcttccattggatatccaaaatagatataaaggtatatatatatatatatatatatatatgtttataaagcaaaccgaaagcaaaaatatctgtataacttagttacaagggaagggaagagaatgcattggttaataggaacagacacttcgtaaaaagcttcacaatcattaatgttaatagaactatcataatatacaaaaaatctcttcatacgatttttgtttgatgagcatcctcagtcaagatgaataaaataatctctccaaataagccgcctctttttttttgaattacacttctatagcgtacatttccatgtaagaagattgaagtttcaaacaattgggtagcttaatatttgtcaaacttcttggtaggtgttgtgtttaagaaaaaggaggcaccataaactattaactttttagcttgcctcaactgtcaaccgaatcaaattttaaaaggcgttaaacaaaaatggcctcgtctcttaacgagttaaacttggttcaagtacttgaacaagcaagtaacccacaacatattaggtcagatgttcaaaaattagccgaacaacaactaagacaatgggagactcaagcgggatttcattacttattacagtcaatctaccttaatttatctaattctttacaaattagatggttggcggtaattcaatttaagaacggcgtggataaatactggagatccactagaattaacgctatacctaaagatgaaaaagcctcgataagaggtcgtctttttgaaatgatcgatgaacagaataatcaactttgtattcagaatgcccaagcttccgcaaggattgcaaggctagattttcccgtagagtggccaaccttatttgaggatctagaaaacctattgaacgatgagatcatcagaaaagattcagttaagatttacaatatattgatgcatataaatcaaatcgttaaagtattaggtactgcgagaataggaaggtgccgacccgctatgcaaagtaaagttcctttgatattaccactaattgtcaggatttatttacaatcatttgaagaatggacgacatcctccaatctcaactacgaggatctttccagtttacaagtttcttacctagctttgaaagtgctcagaaggataatttgtgaaggatacgaccgccctcaaaccgatcagtctgtttgcgattttattaaactatccgtttcacactttgagatgttaatttcaaaccatgaaaacttcaaaaagtttgatatttacgaaaagtttatcaaatgcctaggaaagttatatttcaatttagtcactggctctccggctaatttcatattactgccatgctctacgcaaattctaatcacttatactaggctaattttcgataaggcccctaaagtatatagagagaattctgatgtcacgggggacttttgggaacagactgctattagagggcttttaattttgaaaagggtcattaatttcattcacaaaaagggggcaattacgttaaaagcaagaagtgataaactaaccatagatgcttctatcaacaaaatcaacacagaatttctgaatgagaatttgataacaaggttggttgacactttaatggaatggtacttgaggttaagaccaactgaattagaaaattggtttatggatccagaagaatggataaacgaacaaatggccacgagttacgaatatcaaatcagaccatgtgcagagaacgtttttcaagacttaatgaatactttctctgagctgttggttccctacctgttaaagaaaattgaaaatgatgcttcaaagctatcaaactcattagacgattttttaaggaaagacgcaatttatgcaagtttccaattaagtgcatccgctgttagtgaaatggtagattttgacaggttactaattcaggtttttttaccagaagctacaaatacaaacatatcaggcgacgaattaaggattatcagaagaagagttgctttaattataaacgaatggtctactgtgaagtgttcggaagaatctaaaagtttatgttacaagttatttacaaacttcctgacagatgaagacgacaaagttgttttgttaaccacagtccagactgtcagaaccatggttgatgactggaacttcaacaaggatacttttcagccatttttaactgaaaatgttcatttattgttgaggaaaattttaccatctgtgtcgttaaccgagacaaggctatatgttttaaacaccttgagcgatatcataattcaaacaaaacctttaattagcagggatctattagtcgaaattttgcaaatcataccaaacctttgggaaatagcaacaaataatgctagtgaggctattttggcaaacgcattgttaaggttattgagaaatttggtatcatctttgggatcacagtcacatttaacgtgggatatcgccatacctgtggttgcattagcctgtgatccctcttctatgcaatatcagttgttaagcgaagacgggtatgaactatggggcatgcttcttcaaaatttttcatcccacgatcaagagtttgacgataagttcgttgaattggtgccatttctaaagtatggtattgagacacacacagagattctcccaactttacttgaaattatcaaaagttatgctctgattctgaatcctgtggattttttctctaacaacacatttcaagatatttttaaacaaatgtctaaatatcttttaaagttaagggaagattcatttcagttggttttagaaatctgggaaattttgatattatccaatgagtcggattacgaaaatctgttattgcaaaaattctatgaaaccggagtattatcagcattattcgatgccattttcctggaagaagctccttcatcttatttatgctcgcaaatcattcaaatcatcgctagaatatcctacgtgaatccagacgccttaatgacttttttagctacatatcatgacaatctaccaacttctaacgaaaatgcacgcatgccggaatcaataagaaaaattgtgtctaaggatcagacgtatgattccgttgtaaacaagcttttaaccggatggatagtatgttttagagatatctttgatcctaaattcaaaaaagttcacatattaggtatttcaagtttactaaggactggtttagttcctattttgactgagttttcatccatcgcatctttatggatcgaaatgctcgaagaaattaatgaaactaatcgtggggattgcgaaaaataccacttgaatgatattgttacagagcaatcaattgcattccatcctttaactgccgaacaattaagatatcatcaattatgcaaaaacaatgatccagtgcataacattagtttaaaagattttatttcccaatcaatggaatatctagaatcacatttaggagtagaaaggtaccaagaatttttgaagactattaaccctagtttactagagaacttacaaatgtttttatccatccagcctcaagaggctcgtccatgatagtaataagtactaaataaaagtaaaaaattgtatatagttcgactaacaacattacagtggtatcttttgatcgcgcattctatacttttattttgctactaattagatgtcgcagttttttttgtttgctttttgcgtaatacaaaaacaaacgcgaaaagtgttcatgtaatataatgaagtaaaccaagtctcacggaataaaatcaccttcttccaattttgtaaaagtttaaccaaagatccaaagtggcttgtaggaataatggattatagtaactttggaaacagtgccagtaaaaagtttcaagacgatactctaaacagagtaagaaaagagcatgaagaagccttaaaaaagttgcgagaagagaacttcagttcaaacacgtcagaattgggaaacaagaagcactatagagcacaggaaaggatgagttcgccattacatagattgtctcccacaggtaaatcagacgataggaaagtgaagagcccgctagatgataagctaaggaggcaattaagggaaggtaatacgcgactacctcctccaccattttccagctacgggatgccacccaccaaccgatctaatttggatagaataagaagaaggactagctcaccagtaagaactgataaatttgcatcacaaaatgtgatagatgaccaaagattagaaataaaatatttagaacgaatcgtatatgaccaaggcactgtcattgataatctaacatcaagaataacaagactggaatcattcatactgaattcgatctcagacagaggagataaaaattttgcctctctcgaacactcccgctctttttctgggtttccgaccaacaagacgtatggcttacaaatgggtggactgtatgagaatgatatgccctatcgaagaagtagcgacaacattaataaagaaggagcaagagaagatcgatcgtcacaaatccatattgaaaatgaaagtacggaggatatactaaaaatattgtcttcgtcttttcacaattgaattaagtacttaactaaataataccagcataatcgtaactaaaactaaaatatagatatacgcatttcaatcttttcttctcagagaagggtaaagctaaatgaagttttcaatcggaaaacttttaatttttgatgaattttaatttaaacttatatttcttggaattttgttcatcgtctacagagaaaatggggctttgattccttctccttggataggtgtcaccgccccagttgtagttaccagaataaccaatatatccgtctcctcctttcgttggatcaaaatcgaattgacctgcatccttaatgttcctgaatttgcagaccaattcattagatgaagacgaaataatgtcacaaaacccttggttagttctcaagtagtaattcccatagggagatttaatcaactcgtaattcgctggtgtaccttgactcatccagtgtccattcttgattagaaagccttgcatctgatctccattattaatatttgatagacgaacgactcctctgtatcttgctcccttattaggtctcctcctgaaagttgggacataaccttttggaaaaaacttaataccatcttttttacaatttgttcgaatggcaagtgagtccatgggcacaaacatttcgctcaaaagggaacccttcaagtggttataataccatacttcgtttaaggaattatgtctatcacagcctatgaagactttttttccttcaaactctttacttagtgctgcctctatctgctccaaagaataggaattgtccacacttgggacaatattatttttttctagtgttgaaaatgtgtccaatttcttgaatagattataagttattctaaaataatcatagaccgctctttttctgtcaacactattagcaccccactcagtatagcactctggtctaattgtgctaatgcacgtgccatgtttattaaactcgtgtatccataaggactcatgattcccgttattactcttccaatataagtctaggtattcaagcagcttttcgcccgatatttgcagggatgtatcattattattaaatttcttgtcatgcaataagtagtaaacatcgtcaatttgtaaggacctattacagaattgttggtagccaccatgacaattatctggccataatccgtgaattgtaaatgaatctagaggccctaactccttcactaattcagtttcatttaaatcgtttttgcttggaaagtaattccagaattgggtttgtaaaaatattccacctggatattcaaaacaacacgagttgtctatatcagttttattggaacatgataatggaatgtttatagggcagtttggttctatacccttatctgctccattcgaaaaaattggtagttgtaagagactgtgtaagtttttcagtaacattgacacagtactttagtttgaaatatcttaaatagttggccttgcaataggtcgaaagttgaagcgttaattataaattcggtagttcccctacttttcgataggtttgcatttaagggatattttaggaaaagcttagataccgaaattttgttgatagagatgcaaaagaagaaagaatgaaaaaggaaaacaattactgcgcaagaaagacgcgtgtgttagcgcaattgttacgttgaatgcattgatatgtaggggcatatatatgtatatatacttattgtttctttttcaactttcttttagcgaaatcaagtacttgagaattaccttcctttgagatgaaaaatttcttctttttgtcgtctttccacaacaaaacaccgatatcttgagcgtacttacttagtaagttgtattcttgactagtctcaaaatcagaatataaggaaccttcatatgtaatgactctatctaactctaattgccataatctgatttgatctacgacggtaggaggcaaaacttgtaaaggctccttacagttggggtccagctctaattttttttctagtttctcttctgccaaccttctcatttgaggatgtgcatgtgtctccagataggcaatgatttggtcggcagtgataccattggtcaatgctcttcttatggattcccttgttatttgacccaataccatattcacaaatcttgcctttaaatgaacaaaaagagacaaaacagcaatttgcagaggtgaattagaatatgaatagattttgaaatttgtttctacaatcaatgagccatcgggtatatcttgattttttagacctgctttgttcaaatcatctgatgtagtgatatctgttgtggatttcccgttggcgccgtcttcatttactgacggctcttctctattctgtctcagtacactatccatcgcattggaggcagatctgattgtcttggtatcggaagtcagcatcaaagctaattttgttggataaaaaatgctatcatttgaatgcttctggaataccaaaccatagtctcgcatatcttgtaacataattctttgtgtttcgcttaatgcatcgattttataggctttgccaacttccaatgcgcctaacatgaaaataaaatgtaaaacatcgactaaatccattttggacgtttcgatcatttttaaatattgcaataataatgtccataattgggagttgatttcttgtaaaagaaattggaagccttcattagtgattttgaactctccagtagagtttacctcttccattagtttactgtgttttaaaaggttcagtactttttcagatgggattttagcgaggggagtgccaaccatgaaatgtaatattgtttcccatttattagctgaatattcatccaacaagtccaggctaactacgttttcctctacaaccacaccgaatgagttttgaacttccccacccgttaatgcgttcctcaggctgattttgaatgttgggtttaggttgatcatcaaagtaccagatgatttatttggtataagaagatgcaaagacttcatcgatttgattgcattctgaaactgcaatttaccattagagttaacccatttatctaaatccaacaaaggtacttcattttcgttgaaaaccattgccatgataaaaaatttagctagtggtggtaaaattctatagatagccagacatgtagctggtgaggtataaagcctattttgaacttgttgaggaatttcttccaaatactgagtgaccgaatgcttcagggaatagtcactcattatattgttcacttcttccctttgatggtggcttttaatgctaagttactagtattgtattctgacgatgaagttaggttatatgtgaatatatgatggtgcgtaatttgcgctacaacaaaaaaatacattcgttttttcagtaatcgcgtacctaatagaaatgcaagatgaataaacgttttacgcatttttcattgtggaaagattaagctgtagtcaagttttaacctagtgcatagttcagccattccaaaatctttcccttcgctatcatgcagcaccttattcaatttttccagctccgctattttttttttttccaactctttcagctgttcattcatttgactctcccactcttgtttctcaacttctgaaagttgtctaaagtcatcactttcctttatttcacagatttgatcttccataccgttgtcaatctgatattccaatcttctctttttagcctccatttctttttctagaaaatctttatagccgcccattctattgattttgattaaagtggaatttaaaataaaagacagttccatctcacaaattgtcctccatttttctatggattttctgttctcaatgatcttgttttcgctgagaattttacaagcctgctgtaagtgattattttcttgcctgagaagagtaagttgtttcgttaactccctattttttatcgcaatttccttctggttcgtaggcttcttcaagtccttaataccgcttttaccgacccgatagttattagtgtccttttttgtataagaatggttgatgcaagtattttcttcttcgttcaccaaagttttgtccttgtctagccactcttcctgattgtgcattactattagataactgtaatttggtgcttttcctggaaagtatacttgtgatgtggaagtattttaagttcaagtttcttgttttctttcctatttatgcggaaggtacatagaagtttgggcggctaatactttttccgcggctaatcctatagtaaaatgatcactttcatatagaaagttggtatataaagtgtcaactaagagagaaatagttcgaaccaggtgtattttaaatcaactatcgggaagtatggactggtggtataatcgaattacatagtccttttaccttcattagtagtacttaagtgtcacccgcctggggattttgctctcatagaagtaaaagggtagtgctatgggagcacattaggtagttcagttacgttttatggcagtcactgttttcgcaaagactcccagacacgggcattaaaatgaagtgccaaacatgtcacttacccctgcaactagacccatctttagaaggtcttagtttaacccaaagaaatttgctactttcaaataattcaattatcactgcaacgaatgaaaatgtcatcagcaacaagggcatcgaagccgcagataattgtgggcctcaaataccgaaggagaggctgaggcgattaggggagattcagaacataaaagacttgaatttaaaagatgataaattaatcactgattcgtttgtttttcttaatcacgatgatgatgataatgctaatattacgagtaatagcagagaggaccagcgttatggaaatgccaacggaaatgataataaaaaagctaatagtgatacttccgatggaaccagtacctttcgagatcatgacgaagaggaacaagaagctacggatgaggacgaaaaccaacaaatacaattgaattccaagactttgtccacacaagtcaacgcaatgactaatgtatttaacattctatcttctcaaacaaacatagactttcctatctgtcaggactgctgtaacatcttgataaacagactaaaaagtgagtatgatgatgcaataaaagagagagatacttacgctcaatttttatcgaagttagagagtcaaaacaaagaaatatcagaaagcaataaagaaaagcagtattcccataatctttcggaaaaagaaaatttgaaaaaggaagaggaaagactcttggatcaattattacgtttggaaatgacagatgatgacttagatggagaactagttcgtttacaagaaaagaaagttcaactggaaaatgagaaactccaaaaactgagtgatcagaatttaatggatttaaataacattcaattcaacaaaaatttacagtcattaaaactgcaatacgaattatccttgaatcaattagataagttgaggaaaatcaatattttcaatgctacattcaaaatctcacatagcggcccctttgccactataaatggattgagattaggcagtataccagaatcagtggtaccttggaaggaaatcaatgcagcactgggccaattgattcttttactggctaccataaacaaaaacctgaagataaatttagtagactacgaattacaaccgatgggttcattttccaaaatcaagaaaagaatggttaacagtgtcgaatataataattccactacgaacgctcccggtgattggttgattctgcctgtctactatgatgagaatttcaatttggggagaatcttccgcaaggaaacgaagtttgataaatcattagaaacaacattagaaataataagcgaaatcactcggcagctttctacgatagcgtcatcatattcatctcaaacactcacaacaagccaagatgaatcttcaatgaataacgcaaatgacgttgaaaatagtacttccattctcgagctaccctatatcatgaataaggacaagattaatggattatccgtcaaattgcatggtagcagtcccaaccttgaatggacaacggctatgaaatttttattaaccaatgtaaagtggttgttagcgttttcttccaatttactatccaagtcaattaccttaagccctacagtgaattacaatgataagaccatcagcggaaactaagtagttcatataaatgcattttttcataaatgtgataaagggaaaatttctttttccacttgaaagatatgtacgtatttaagaactgatcttcttgaccactttttttatgcgtgcaactttaaatgctttcatacatttccttggtctttcatcagatgatatgccagatatcaacaattatagacctaatataacattgagttattttttacacgtataataataactccttctccggcaatgaatattttgcttccaaattgcaaaattcaagatttaattataaaaactctgaagtaatagaccacctatttcaaaaatattccgtatttttccctctctataaaaacaaagggcttccaaaatatccattccaataaacggtaaactcacccatttatgattgggacaagagcaaaaaaaaaggaaattgggaaaaaaaaagagaaagaaagcaacagaataaagggaacttgataaaactgaagtaccgtgggtcaagtagcgtgaaagagtcaattcatcgactaatggatgcataaaacgtatgactgtatagtactggagtgaaaacgaagagataaagaaaggaaaaagggagattaataaaaagaaaaaaattaaaggagttctatatttggattagtcttttattctttctgcttaccaccatgaagcgttgctatttccgtaaccgtttttctcattatcatttctaaacccacctccaatcgaaccccaatttgatgttccagtattccttggcctcgtgctcccaaatgagccatttccaccatgtttacggtagtctcttgaaccgttattacgactattgaaaaaacctcctcctcccctagttcttccacctcttgaattctgtcttgacaggtcacttaaaaacgtgggaacttcttgattcgcttcatttaaaatttccatcaaacccttcacaatattctgattattactattgaagaatgaagtagccacgcctgtgttaccagcacggcctgttctaccaattctgtgaacgtagtcatcgatgtcggagggcaaatcataattaatgacatgtgtgacattcggtatatccaaacctctcgctgctacagctgttgcgaccaggatatcagctacgttagctttgaaagcagataaggcacgttcacgttcagcctgtgtgcggtcaccatgtatggctgtagctttgaaattttgcatgatcaaaaaatctgtgagttgatccgccattcttttcgtttcaacaaaaatcaatgtcaatcccttatgctctgcagacagtaaatctaacaacgcagactttttgtccatgtcatcgacatataatattctttgcgtgatattttctgaggtggaaccgactcttcctactgataaaaaaatataattatctaagaaatcgcgtgccaaatgctggatatctactgggaatgtggcggaaaacatcaaggtctgtctattttccacagagggcatatcacattcttcaactatatggcgaatttggggttcgaatcccatatctagcattctatcagcctcatccaataccaggtatttgatattagccaaagaaacttttccgcgttctaataagtcattcagccgccctggtgtagccaccaataagtcacagccgcggtcaacctccctcatctggttaccgattggcgcgccaccataaacaacgcatggcctaacccaagatctatacgtaaattttcttgcttcttcaaaaatttgggtagccaattctctagttggtgcaagtactaaagcagatggatatccctttctagaataaaagctctgtgctttctcgggtactggagagggcccagacctgaatagctccgtgaagagcggaaacaaaaacccacctgtcttacctgagcccgtttgtgcgcatgccatcaaatccctacctttggtaactattggaatagaatatttttgtactggagtaggtttggtgaaactagcaagtttgatattttccattaacagctcatccagagggggagaactaaaatctagtataggttcaggaacatcttttccagatgcatctacgggaatattatcgtaattatcaaactttataccagatgaatggtaatcgggatcgtcgtgtacaccaaacagttcggcttctaatttcgcgttcttaggccccggtatatgcttgccatttacccatctatttccagatgatttgtaatttgagctgcctccgcggttatagttcgcactcgtccctccatttctttccttagaaaagccaaaaaacccgccattgttcccagtttgccttccagcacgtctgaaaaaatcaccacccgtaaccttatcttcctgttttggggtacttctttcgaatgatggttttcctctacttctcaagtgcggtgggacataagatgatttgccgccaccaccaccattctctttgttgttgatgcttaaattagataccttctgtggcaagtctgccattttttcttgtaatactttcactcaaaggggtttttcttaaaatatcctttaactgacactaccgatatcttttataatcatgaataatccttgttataaaataaaggcattacttcagagatgaccttaagtaaccttcccttaaaattgttaaagaactcgcggggtaatatttacgttgacagtgatatttgttttgagaaatcaaagaatgaagaacttagatgtagagttaaaggagcaatacgaataggtgccgtgatgaagaaaaaaaatcatacagacatttgctacaacccttggtgagactgtttcgatcatttttctttttctttttctttattttagaaaaaattgaacgaaatgacattggcagagttgcttggacggtcgagaatagctcaagtagctaacaatcataaaccattgacatacactggcaaaaaatttcatccaacacatcaaatcatcgaaactaagccatcgacactatacagacaagaatgggggttgaaatccgctattccttcgaaaattaaatctcgatatttggtgtacaacgatttggatacgttggaaagaattaccacattcgaacctagaggcggtacgcaatggaataggctaagatttcaagaaatgggagtaccaattgtgtctaatataggcagacaaaatccatttttcaagtacatatctcgtcctgaggatgagtctcatgctaaattgtccttattcaaagaaatgaaaggagatacagatatttcgcctgctgctatgaagaagcgtttgaagaagataacagcactaattagatcgtttcaagatgaatttaaagagtggctggtggaaaatcatccggatgaattgaaattgaattctaataagctggaagactatgtagtgaagtttctaaacaaaaagttggaaacaaaaacgaataaaaaatttaacactgaaatcattggtacaggtggattatcatacagcttgccaggaaagctaaaaaactcaccaaatggtgtcattcaaaggactgtagtacccggtagaatcttgaacgttgttaaggagaacaacgacaataaatggctggcagctattggtgggtttgtggccgatgtggtatttttccaatcaccacctagttcctttaactccatgggagatttcatcagaatgaaaacgttcttgttcgagatcttggaggcatctatggagaaaaatggttctgtttcgatgcacgctagattactcgaaccacaaaatgacaagaccagagaatttttcaataagagaccaatttataaaccattgacctctagaagggcacgtcgaccatcagtgggaaacattcaagaggccaataaccttttgaatataatcaagggaaattgagaagagaaaaaaaaaatgtgaacaatcaatgtatattcagagttctgtaaataaataaagaaaataaagtttacatattactaaggatttttgtcgcctatttttactatttttcaggtgaaatgaaacgttttatatcacattttgctatgataacaaagttattatgatttttatgtagcctatattattgacgcgttgttatagcattctatgaatttgcctgtcattttccacttcagaaaggtcatctaattgctcccaccagttgaataagtaattctcgcaaataatcttaaaccaaggcgtaaacttgtaacttgggtcagcaaacatagttttcaaatcatttggtgaaacccatttgaagtctctaacttcattgacgtttgggttgacagtcaagttttctttagcgttgatcttataaaataggatgtaatcaatttcatgttcaccccatggttcattgcttggtgccatgtaatggattctgtttaaaaagtgaaacttaccccttgtcttagtttcatcttctggaatacctaattcatgatctagttttctcaccgccgcagtaatagcgcccttaatcttatcgtctagcttacccttcaaacctaattcgtcatcaatacatagtggatgagagcagcatgtgttagtccaaagatcagggaaagttattttttcagtggctctttgttgtaaaagtaattcaccttgttcattgaaaataaagacggagaatgcacgatgtagtaaacccttttcaatattttccattaaatgacaaactttcttggtaccggcaccaatagcattatcgtcccaatccaaaacaatacaattttcattcattaacttaatttgctcctcatcatgaccagaaaaacatgtttctccgctttcgtcatttgacgtctcactagatcgggtattaggtctttgttgtaatggaataatttcaggaaactcttccaaaatgtcttcaggtgtttggttttgcactaatttggcgtaactagatactgcaccatggggcatactattgttgtcggcagtcattgaggtgtaatgaatttttggcttatttttactcttcctgtattccaaatacgaatactctaatattgaattaagtgggatatacgccttcttgtcactagaaaactgtttcctgttaaatagataaaaatgaataaataaatataaatggagttaagaccgaaaaagaaaggcaacccccatcgacaagaaaagagttatgaataatcatgtttcttaataacaattaaagggaaaagaatcggctgggcatcgtcattgcgaaactgttgactggaaaaatttcaatcacaattaagttttgtccatttcgttccagcaagaacggaaacttttaccgatagcagcggaaaaaaagaaaaaagaaaaaaaaaagaaattaatataggcaaaatagccgcatgaagcccttaataacctatactattctgtgactgttatttatttaccctcgtaatattaaaaatgtcctatacaatttctgtaataaaacctaatttttttaggacccttgagtgttaccctgctcatgtttttatttttgttttagagaaatgtaaacaacagtttgggaaagtttcaagaattgtaaacaactaatcaagggataatactattttactctttcctttaaacatgaagaactattttttgtttacgtttttttctgaattgaacaataagatcttgttaatttttttatcgcttgatctattatcagatcttctcttttgaaaaactagtccttttccaaattacaaactttcttttcgtgtggagttgatcagttcagtttctccaatacttcttaagtcactgaaaatataacgaaaaaaagggctctggaagtaaacagagaaattcgacgatataatatgtcttccaagcattcagatccattggagagattttataagcaatttcaagcatttgttcaaaataaccctaatgtcatatcggcagctcgagctgccgcacaaataccggaatctgcaaaagctgttgtagtactatccccatattctttacagcatgtgttcccgagagaatgggtaacaaaatcgtataggaaaactatagtcgaacgaccagaaagattattagcaagctcgatgggtatatcagctgcgattacaatgtatccatcccttttcaccttgaaatcctcgcatcaaaggaaaggttcattgatggcacctcatgtgcttaaagttcatggcagtagctggccggctgagttaattgaactttgccaaatggcagatgctaaattgctaaaaggcgaaatcgaagtcccagatacttggaactcaggtgatatatacttgagctcaaagacaattaaagctctacagggaacaattggggccattgaaactggtgttgactcaattttcaaaggaccatctgcagaacatattagtaacagagcttttgttgctatacggcctcctggtcatcattgccactatggtacaccatccggcttttgtctgttaaacaatgcacatgtagccatagaatatgcgtatgatacttacaacgtcacgcatgttgtcgtgcttgatttcgatctacaccacggtgatgggacccaagacatttgctggaaacgtgcgggtttcaaacctgaggaggaacctgaagattcatcttatgatgattttggtaagaaatttgccgaatttcccaaagtcggttatttttctatgcatgatataaattcatttccaacagagtcgggatttgccacaaaggagaacattaaaaatgcatctacctgtatcatgaactctcatgacctaaacatctggaatattcacttatccaaatggacaaccgaagaagaattcaatgtattatacaggacaaaatatagaactttatttgctaaagcagatgaatttttcaggagcgcaaaactagaaatgaatcaacaagggagaccattcaaaggtttggttgtcataagcgcaggtttcgatgcatcagaatttgagcaaacttcaatgcaaaggcatagtgtcaacgttcctacaagtttttatacaacgttcaccaaagatgcattgaaattagcacaaatgcactgtcatggcaaagttttgtctctaatggagggtggatattctgataaagctatatgttctggtgttttcgcacatttgatcggtttacaaaaccaagattgggttaaagaatgggggtctgaacaagtcgttaaagagattgttcgtggttgcaaaccggcttggaaaccctataagacaaaaagagcaaaagatgtcataagaatatgggcagaagaagttatcaggctgggacgagcaatgataccggaattcgatgatatcatttttaaagacgcagttaacagcgcaccttctaattctctactaaaggctactgtcgaaccagcatccacgtcgacaattgctcaaagaataatcagatctcatagaagcaacgcttccccagaaaaagaacttcatgaaaacaagccgagaagcacggaaaaacaggaacaaagggaaattagaagcgataccaaggtcaagcagctctcgtcaaataatagagcagctgaaacccaaattccgtttttgcaacaagaattttccagtgaggatgaagatgaagaatacgtttacgatgaagaattgaacaaaactttcaatcgcacggtggaggatattaccattgatgatatttctagacatttggagaccttagaaattgaaaaaaaaggtgatgaagattcagaccatgagctaaaagaaaaaaattggaaaaactcgcaccaacgccgtctacaaggtaatggaatgtataaaattccctccaatacgaaaccgcatcgcataagacagcctcaaaacgcaaatacaccaacttatgacgatagtgatatatcaatgatttctcatgtttcaagaaaacatacaacaagaagtggtggaagatggtgataccaatgcatatataatgttgtcttgaacccactaaagaagtgacgcatatattacttttttgtatttagtaacacaatttttctatttttatatttccttgtatagttagtaattttaatttttttccttctttatctcagctcttcgaccatttggtcaagaagttagtttttttctcttattttatttgacaatatactaattttattatatggtattgtaaataacatttgaggaataaaaagacagtcactctataagctttatcagcctgacatttttttattattacaaatatatcgttgaaagaaagaagcctctatacatctcgccctctttctatcattaaatcaatggaggtttactggcaacgttatatttctacaattttagaccatcaaacctgaggaatatgtatatctactttctccctttcctcttctttaactggttcaccaccctgaaatatacacgcaaagtcagtgatgaatggttgaagcatactaattggaatatttagagttggggaaaacacgatgcataaatttcttagattcatcttattaaacttactattctcattgatccttaccagcagttcaaaaagagcatacatcaacgataggttagcgtgaggaactaggccagattcaataagttccttaaaccccaatgatatttgaacaggattattatgattttcatcaactactcttttaaacgacaaaaattgttcgtcaccaaataataaatggggcaactttctcaagtacaactttagtaacccacttacagtattcacaccaatgtaaagacttggagatgcctcatcatctttagcttcaatactttcattgtaccgacataaatctacatcgtactctttatcaaacctttcttgtaaagttttgataactgtactggacccgcttagtctaaatatgccttcttcctggataccacggtttttgtaaagatactctaagcaacgataaactacactcggtaaatcgtaaacgttttggtacttatgcgaactcaatcttaaacacgtttctagtgacgagccaaatattgcagtggacacatgtggacccgtagaagaatttgacgaagaggatacttccattaattttttgcttggtgacttaatgatagagtcaggagatgttggagaatccgaatcatttgaaattgtaatacctatatggttcattgcactcgccgggccggttaattttttaaaagggaataaacttctcattttggctctcctactatccttctcctcctctgcattcccgcttgaacttgctaggaagttagagtgagaagatgggtttgagtcaataccatcgctattagcaatgttattgctactattactaatattgttattattattatattcttgggtcaaatcagtgacatatgatggagtatcggttgctgagatagttgcgtttccaaatttagaatggtgtgttcctgcgctcaagtgagatgcagaatcagtatcgtttgcattcctcgagctagataacgataaactttgtgaaggatcaatgtaatcactaaacgcagaaagccataattcacgttccttcgacgtttcagtacaaatataatactttgttgaggttgacagtccgcttttcttatgctcagtgatcaaaaacccatttctcgttccaaatctatcttcagggagattgggtataagttctatagaagattgtctcaatttaatagtttcagtcaactgatttttgtcaaacaattgtaaaacatcatcgcgcaaaataccgtaccgaactctccatgtactattacctgttagagtctttggtcttctcagcaaaagtgatccgtctttcacattatcatccatcattggaggtgtcattactgtatctgtactaataaattgggcgatttttaaaccaacatttttgggaaattcagggacactgaatatgcttgtataatactgattcaatatgttctttcgcgtatccacttttgtaggtgataaagtctgaaataattgtctatcaggtaacgtgggcaatggtaaatcgggaacatgtgatttcatatatacatctaattcgcgaactttatgaatagattttgaaaatttaaacatctccttaccggatttcctgtctatgattgcaattaaaatggataaatcatcttcattatccctgtacaatgtgctcagtacttcaatctggatagtgccaaaatcctccggttgaacgaataatggaatatccgacttaagactttgggccacagacttcacggtgctcacgctacttgcatgaggtcttctaagtgtcttcaacgaaccttggggtgttgagctaaatgtattcaaggtattggttgaatggatggatgccgtttctccaagttgtttttgttttgatgaactttccacgggaggatttggaggaagagaagcattttgacttgttgttgacaattttgtagaaagattggggagtgatgaagttaacacaggtttctttaaattttttgcactttgagcaccaaaattatcatcctttttattcaagataaccggagaagccaaatggcttgataaaggagtagagttttttatatttccactagaagtaggtgagaaaaaagttggaggcgctggaggtgggggtaaagattcgttaatcgtggattttatggacagaggatctttactgtccgtattgactagatcctcttcgccaaatgaggagtcaagtaattgggtgaagtcgtcaagtttttctttagatgctggagagaaacccaaagccttgttttcaccctccttgacttccaaaagggatgatggacttttggctgctgaagtaggagttccagtagtgtatgcagaggatgttatagaagaataaacgcggtcatttttttgtatcgcgtcattagttagttgttgacttttactttcagtcagctcatctaaattattagaggtactggcctttaatggagaatgcaaatggttgttgataacagccgtcattctgttaggattttgaggggaacgcaaacgttcttgcaatggagatttcgaacctttattaggtgattttatggttatcctagacgtcgtataggtaacagaggcagctgggctagccaactgttctgaatgtatttttgtagggcttgagacagatctattgataattttgggagatgagaagctactatttgcttctatttcatcgtttagtatcatgttctgtaaatgcttcctacttattgaagtatttgatgtaacacctatttgaggtactgtaggcgttacacttgtttcaagtgcaacgtctgaaccttgttgcaatggaggggacaatgtcggtattggcaaattaagactcttgatatgcgctttcctttcagcagatcttgggggtaacacaaatgattgatcgttaacgtatgaatctcttgagtcattttgaacttgctcaagcacaacttctaaggaagcttctctgtttttttgtaacatatcaataaccttttccaaactctcaatttcagtttcatattcttggacttgtagctttagcttaatgttttccgtaaaaatttcatcataggacggatttctttcttttcctgaacatgttcctttttctatatgttctatagatttgtcctttttggatctatgatcattgtactgcgccaacaattcaagggtggtactaccaccatgagttgtggtcaaattatctgtcattgcgtgctgttagttgagtgtgagtttattctagaatatacacacagatactcctagcagccagtgtttcaacaaacgtgatgttgtatatgcctgatgtaatcacgaactcgaacaaaaggcaaaatggtagaaggcaaggacaaagaagaaaagagaaaaaacttccagatacaaagctaacacacaaaggtaaacggtgattaaaatggatatatcgttgatgtatttaacaatcttgaaaaattccgtttaaaaaacataccaatacgcgcaataaaaacggttcttatctggtactttacctagtcagacgattattgttctttataaaacggccgcgttttttttccaacatcaccgccgccatataactttcgacattcttagagttgtggtataaagagcaatgcatatacgtatgtaatcctaattgaaatgctatctttgtaacataatgaatggttcagttgagcacatacttaccatcacctccctcgacaaatatgtcctgcacattctcgagtgtgatgagtgtctgctttatgaccatgtcggcaactgtgctgccgatatgtggcaaagctgtaacatcccatctgcgaagtaactcttgcttaacgcgtgtttcctcatttttaaacacatcgagaccacagcttgccacttttccagattcaagagcgtctagtagcacatcttcatctatgcatgtgcctctcccaacgttaactatcctgacaccatctttacaccaggccaaacttttacgattgataatattgtttgtagaggccgtactgggcaaggccaaaatgatcaaatccgcattcttccaagtatttggatcatctagatcagaatggtacttagcgttgtaatcaagtagactcttttggacgggaccggtccttttgtagtattcaatgctcatgttgaacactttgtgcaagttagaccctatattttgtccgatggagccaaaccccaatattagaacttttttattcattggagattccatttttttcccgccaaccgtgtacttttctgctaaatgtaccactttcctatccttgttaggcttgcatttgtctgttcgagagggaaatttcatttcctgaccgtggtaactatctgtaacaatttcatacgagtcactagagatatatttcttacactgttcaacattaccattttccacgtatttaaaacaatattcccaaaatgaagtcattctaaagcagctaattgctaggaaaatagccaattctgtgacatggtcagcagcatgtggtccaatgttgcataaagtgatacctttcgatcttaataacttaccgtcaataaagtcacagccgacccatggtacaaggattacttttaaagatgcggggaagaattcaatataactcgaagggtttcctaacacagtgaaaaactcctcagtgagccaaaagccgtttattctatgagtttccaaaaatttaacaaaatcatcctttgtggacatctcatatttatagaattctaccctttctgccagtttgcgatattcaggaagatgactggcgacttcccattgggttttataaggcaccaaaattcttggtttggcagaataagttacatctgctatgtcaattgaagtaatcattgttatttaaaggttgctacttttgtacactcaagtatttttctgtatttgagagagagctatttgtactccacactccaccttttagatctgcgtcaaagtgtcagaataaacataccgtaaaacggaatgactaccgccaccccaatgacataaaaacggaagaaaaagagcaaaaaccgagcgccaaactatcttattcaacgaatcaaataacaatacaaatgcagaggtaaaacattattcgccacatatatatgtacatatctatatgtatacatatttttatatatcaatcttttgaagagcaaagtgacctctttgttgttatccaaagtttaaccagtccagttaagccggatcccagggacagaacggcatacgttccctttggagtttttaaatttagaatatctgatgtattagccatgcaatcaaacgataatcttgcaatatctaaataaacaagtgtcttttcatccttgatggcctttagttgtttgtgtattaacacctctgcgtcgttattaacatttaggtcatttaacaactgtttcctaattggcgattgtgagccatcgtctttatgggcctgatgcatcagtatgggtgagagtagtaacgcgttattttgaacttttagttgcacttccaattctaattgtctcttctgtaagctttgcaggttgagccaatggtccttcaagcttaaaagaatgtcgtattgccatgcaagagactcttgtctactgacaaaggaatagaatgatttatttgtccatattttcaatttgtatagcaagtctaattcatcaaagataccataatacaagtccaaaaattctctcaatgaagcttcattaaaccatattttcttaatttggtcaatttgaaagttgcactttctggttttattgaatttccccaagaaactgcacactcggaatggtgtgccgccaaaccttaaaatatatctaaaagtacttaattgttgactgataaaatcaattttcttgtcaaaatttctcaaaagagacaggagaagtactttaattaccgtgattggatgccttagtgcgacttttacagtcagatttttcaaaatcttggtatagtacgttaatacggaagggtccaaaacagttaaatttcgcttagacttttcgataaacagttttaatatatccagagcgtatttgataattttggctaatttgtctctaccagatagagaatccaatatatattttaagatggtaatattatccaccatctttgtttttgcttgagaatcctcatcatcacttctcgaggattcagtatgcgactcgcttccactgcctgcactgaacttctctgcaccggcgtctgatgaatgtggatgggtattgtcatcctgggcgtcctggtaacttgccccagaataaggtggtgtttctgaaccggaaacgatatctgtcgtgccaaactgactcattgttttacgaccagtttctataggtgaagacttacagggaagttgaggatatcgactctatttgttactttctccagcatacaaattaccgatgattctgagaagaaagaagaaaaacgtatttcaaaaattatataacctgaaataataagcccaatcccaccggaatttcatatactatcaccgacctggaaaaaaaatgaagagtaaaaagaaaaaaataaatttagcgccgctcggtttcgatccgaggacatcagggttatgagccctgcgcgcttccactgcgccacggcgctgctaaatcatgtgagtttagcgcgtaccgagcaaattcaccaaaatatttacatccaatttgctcccctcactcttccccgatgtcggttgtgattactgctacgcatggcgactcttaatttctttcaggtatagtaacatttactcctttaagtaattgtctatttttcctcgacactgtatgtagttacctttcaaggaagctattccaataccatcgtgagaaaaactctattggatacttcatctagctcgtatatatgctttttaaactttataccaaaccgtgtaggcaaaactggaccgcccggtaagttctgctattaacaaattaaataaaattggccaaactgaggattgacagttctgaatatccaagattactgacttcaattttctcacttctcatcataatattccgctgatttttacataccgtatatccaatttacggcccttcacatatagcggcgaaatgatggtaaagctacgcatactgtctgacaggaccctattctagcaaccttacatgaaacaaaaacaaacaacatcacatcatacggatgaactacgggtgcaatccctgactcatcaatgtttatcataaacttagatatcaacactgataaaccccacctctatttttactggttcttcactttttcgatgccgcaccgtcgcccgcgatccccgccctttgattgctccttccattaacagtttttttctatcccttacaagaagccgagacgccgcgaaaatatcggctagtgcgaatagtctctagctcttgcccttcgcaaagcaccgtgctgctaatggcaatcaacagcgcatcgccgctcgctgaatttttcacttagcggtagccgccgaggggtctaaagagtatataagcagagcttgcggcccactttctatcaagatctaagactgtttctcttctcttggtctgtatatgttttctcaaagttagcagaaacaacaacaacaactatatcaataacaataactactatcaagatggaaacaggacctcattacaactactacaaaaatcgcgaattgtccatcgttctggctccattcagcggcggtcagggtaagcttggtgtcgagaagggccctaaatacatgcttaagcatggtctgcaaacaagcatagaggatttgggctggtctacggaattagagccctcaatggacgaggcccaatttgtgggaaagttgaaaatggagaaggactccacaactgggggttcctctgttatgatagacggtgtcaaggctaaaagagcagatttggttggtgaagccaccaagttggtgtacaactccgtgtcgaaagtggtccaggcgaacagattccccttgaccttgggtggtgatcattcaatagccattggtactgtatccgcggttttggacaaataccccgatgctggtcttttatggatagacgcccacgctgatataaacaccatagaaagcaccccctctggaaacttgcacggctgtcccgtgtcattcctaatgggtttgaacaaggatgtcccacattgtcccgagtcgctcaaatgggttccaggcaacttgagcccaaaaaagatcgcgtatattgggttgagagatgttgatgccggagaaaagaaaatcttgaaagatctgggtatcgccgccttttccatgtaccacgttgacaaatacggcatcaacgctgtcattgaaatggcaatgaaagccgtgcacccagaaacaaacggtgaaggtcccattatgtgctcctatgacgtcgatggtgtagacccattatacattcctgctacaggtactccagtgagaggtgggttgaccttgagagaaggtcttttcttggtggaaagattggccgaatccggtaatttaattgcgctagacgttgttgaatgtaaccctgatctggctattcatgatatccatgtttcaaacaccatctctgcaggttgcgccattgcaaggtgtgcattgggtgaaaccttattgtagtttatatcatcatcccttttatcaaaataagcattctctttttattttagttaagcacatgcatacataaatttacgaacaaaaaaagaaaataaattaaaaataaaagtagtgtatcttcgttacttttcattctttttggttaacccacgtctaattgccaatacactatcgacgatcacggcatctacacctgcttcaatttgtatactggcattttcgggatcattgttgtccacaccgtaagtgacacataccagcccattagacttaaccacttgcaccaaccgtggggcctttaaaatgggtgctgcagcagatacaatccccaataaattccacttcttagcaaatcttataccgttttgtaacgatgaggctctcaaatcggccatctgttcacttccaccttccgtcaggaacaagatcggaataaccggttgctttaacgaaagcatgatgcaaatatccggatgaaatgacgaaaaaatgatgtccctaccattcgcattgtcaaaaactacttttaacacggtgtcaacccaatggttcatttccatcattatttgccctaactcttcctcttctgcctcatcaagcatgggaaacttacattctatgttaaacccaacgttggcagggattttcttgaatagttctttcaaggtaacaaatgatgaagctattgaatgtcctctagcgtttcccttaaaattgttctttttaaatgttttggttagcctcattcgattgtcagaccaatgagcattgttggacttcccattcgggtcgttgtcgtgtaaatcccaagctctcctcaatgtactaacgtctgaatcatctaccgaacgccctctatatttttgtagtgctgtatctgctccatttacatgatgaggtgagtgacctgctccacgttgaatgtgctctttatcggcattgttcaaatctaaaaactgttccagcgtcaattcatgcatggggatatcgacacctgtttcagctacgagaaaatcgtgatataccactggtacgttatccttcgtcaactgaacatcaaactctacatacgatgctcccaatgaggctgccatgatgaaagactcgactgtgttctctccaatttgtaatgatttattaggattatttttacccaggcctctatgtcctataacacgagtggacactaaggatttccagtacgtttctgttctttctaagggcagttgtggatgttcaaatggtgtgataataatatattcaaatttcagcgtcccaagtatctccagtgtatgattagcgatgatggggaccgtcacgctaccatttaatatacttctattaactcccactgagctgtacgacttattcaacatggaaacaccccttgccattacgtaattattgttatttttttgacaatctattctattatgggtctccaacgagcgtgttccatatgttggcacaatatcaaaatataatgtatgagaataatcaactttgaaaggcactttgaagtctactgcgtccacattatcatctaatggtaaatctaagattacagaagatttatcaattgaatcattgcatgaaattactaacgataatgcacaatctgtttccaacccaataacttttgctagtgcttccgagcttaatgaaattgaagggcttttgtttcttgtgtcattacttcccaatgttattagtataagtgattcattattatccaggaatctgtgtccatatgactttattggtccggccagttttcccaaggaccctttattacctccgtttccattttcatttctctcatttaattctccggcactaatttcgtttagtggttctttctcttcgctaccactgttcaactgtgaatggggatgcgtgaccagttcgtctctgatttgaaccatatcagcaatgtgcaaatgaccgcgcaataccgcgtgctccatcggcgtccacccaccttcatcttcaatatcaaagttcgcgttgttggctatcaagagctttacaatgtccgtaaacccttctgctgctgcaacgaagatagctgtccagccaaaaagtttttctcttatttcaaggtcggctccattgtacaacaaacacacagcagcttcgaaaaaatttaatctacaagcaagatatagcggtgtttcatgtaattcgttgtcttgataattaatatcaaacctttttgatgataggagaacatgtaaaaggggatagttattccactcagtggccaaatgtaacaaacttgaactttttaatttcacgttcggatccaaagattgcaataagacttctgttgttttgggatgagcacccaacacacataaatgtaaaggtgtcaatgattcggcatctccgaacgcggaaacgtcatcaatagggatttcattccagatattccattctttcattaacttgataatcaacttcgtaacttcagataagccatactggcaagaataatgcaagggcgttctcttgtaattatcatgctgaaaaaggcatggtcttaaatgaattggtaactcctctaaaatataagagagtgtacaggccgaacttttttcctcctctgtaatgctatctgattctgccggggcagatagggtcgtatgcagggttcttaaatctgttacaatttctccctcactattagtatattttgagggttgtgacttctttttcctacttaaaatttcctgttttctgattaacttcccgattgcaattatgtgatgatggaaaaaatttcttctgttaatatcttccgagtcatttagagacggaataacctttaagatagcatcaatacatgccagtgatttagacagtgctgccttgtttaaaacacttatcataattcttgttggaatcaaagacaattccgaatataggtttgttagctctctaatcaatcctttgctatcatcttcttctataaaaacgcaaataatcttaaagaattctgtattatcattagcatttgcgttcggcgaggtactcctcattactctctcgtaagaatttatcctgaacgtcacttgttcccagatagtttttagcaaactcaaatctttggtaataagagaatcattagcaaattgtaacggcaagattctagttttcatagttgacatttgctgatttgtgccgacttttttatccagtttctttaaaatcttaccaaaagctctcttatttagttcagcgtaccactttaagtttctaaattgttttcttaactcagctaagatagactgaatttcaattaagtcatctttatggtaagatagacggctggcttgacttgttccctttaaaagcatattcatctctctcgtatcctttgtgagtaaggtttgcgctactgcatcttctttgttggcatcgaccactaatgttgattttatctcattgaattgattagaagaaagcaatctctcaaatcttttcttatattccgcatactgggaattgtaaaatgtatcaaccttctcaatatccctgtcaactgcaaagaaaaacgacgccaataacttttggatttttggagagtccaaataattttgagcactattagatgaatctctcatttttgttggtggcctgccttcatcatagctattcttgttatgtgccctatatatgtcttcttgaagtcttgtaatttctttaatcattttcttcaacgacttgtagccaacatattgacttgaccactctggaatgcgatgattggcaaaggtttttccgaacttcattgattatattgtttgattatataaagaccttacagtttcagtagtttgtcaccttagttggagatagtggctatttttgtgtaatttgatgagggttcccttcttagttgggtttaaattttttgctaccgttgccttattgttcaatgaagcactaattgcaaaacttaaactctttaatagtctcactttgtaagacaataatttattttttacttctgtcagccaacgctctctttttaatataatgtgcacgttctaaaaataattctcttattcagttggcgctattaagtgaattagaaacgttttgacgaaatttactattaaaagaacactacgagtcgataatgacagcactggtctaaatttcagctagagcaacagcaaattattatttgtcacttaaataaacttggtcgtttttttggagagctaatatgttgggacagcgtgtgtaacattgctccacctgcgaacacgtggaagtcgcaattataaaagatgcataaaaagaaagaatattaataattaggacacaattgatcagtcctgacaagatcgtatatttgcttcatcgagagatgcattaattgacgcacttctaaaccaacccatatcttgagcattgataatgtgcttgcatctttcaagagacttttggcttcccgcttaaacccgaattcacgtaatataggcagcgaactgtttacgaagagaagttacaagatgtgggtatttttgttagtaaaagaatttctttagtagcaataaaaagcaaaaaaaagcaatagaaaagggttttaaaaaattgatgttattctttaaaaccgttaatccatgcgtaaaatacgaacctttcaaataagtccaagtttggatctaactggcgtccaataccctctagaagtaaaatagcgaccaccacggaaacaaagtcggactccattctaacatggtgcgaccttaccatactaagcatttgatcgagtaaatcgccaattgagacggttcccaatgtaaatgttctttgtttaactttatccactagcttttctaccttaaacgcaaatacttccttatcaatagctgtttctggagttcttgatctctcaatcatcaactcaccagctctataaccatcaaatcgggccaatgcgttgaatagagctatgaaattaattctgtttttttcattcaattctgtaattattcctgtatcgataaaacaaatttggggagtgtaattagttaatacagacttcagttttccaacaaagtcctgatcttggtcctcctctatcttcttcctcaggtcgtgcgttattctgtacgattcaagttcggaggatataatgtttgtgccgtatttgttcgtcttcacaaatctgattataacattgcctggatgcaaatcagcatgaacaaaatcatcaagaattagcatttgtagaaacgcgtcaacgaagggatcactgacttttttacaaagttcaacgtcgttaatttgcttcttcgtagataaaaacttttccatggaaagaccatatacatgctcttcgaacataacatccctatttgacaaggggagaaatggtttaggaaatttcacctgaatagaatttttaaagttctcattgaatctttccaggtttaacgcctcaattcttagatccaactgaatattcattaatatggaaaactgatcgacttcgctgggtaaagacagccattccatagtcggaatccaatttattgcgtcagcacagaatttcattattttcaaatctctccggatctgagatcttacatttggatgcaagatcttgatggcacaccaacgatttccatccttaccaatttgtatattgtcatatttatcgatgtacttttgggatagttcacccacgtaaacttgtgcgatggacccaactccaattggtgttcgattaaattcatcaaaagcatcttcgatcttgtcaacctttaatgcttgagaaagtttttccagagtaaagcttagagagtgagctgtaacgttactatgcaatttacccaactcatgacacagtgcgtgagagaatatatcggttctcgatcctgcccattgtccgagtttaatgaaactcgggccagccaattccaatgctttacgcagtagttgacaccaaatcaatgaacctcgagtttcagttatattggtgtccgtaattttgagtttatgaccaaaccatgatatggggtataataggagaagaggtaaaaaaatagctgaaatttctaaaaaccttaaaatcgtgcatacaggctcaacaatattatcattaaaaccgaaccaaaagattcttagatatcttattaatttatttcgtgattcagtgatcttagcagacctgaaagatttaagcttttcctgcaattcgttttctgaggaaacgtagaggcccatttcaaaagtatcacctttgggatccggttttagagaatcattgtatatcaaacaattttgttttggaaacgaatttttgtgtcaaaaaaaagcaattgcgtaggtattatgaactgtcttataggtattttatgaaaatgccgtgtggacttgctatagtatcgccaagagtttctataagcgaacttaaaaatgacattgcccagatggttctgatgttctttatctctattctgtgagggtttgatattgatgagtaggtagaagatatggtataaggtattttctataacatcaaacatcttttctttttcatcaaatgagtgaaaaggtattattcccctcatatattcggggttatttatttttcgttgcttgaagtaaagcctttaatacacacttagtatttaaacacttaagatttacgaatcacagattctaaatttgtatttaataaattgattctaagtacaggaagtatcaagggggggggttgacagatagaatcacaccttgattaatttagttcctgatgaacaagccaacttgaccaatcaaaccctttcgcggactttttctcttagctctgcttgatacatcgactgggaacttcttctctttgagccaactaacctcaatcccttaaagattttgtaaaccgcagaaacacctggttgttttcgcttgttggcaaaggttaataacacagtaactttcaatcttgttccgaagtgcagagtgcagttccctgtgtgttcaagtgacatacggcatttgaatacactacacttatcgtcatgtcaaaacaagtgttatagaagcagcgttaatataatattagtacctgtacagttttaaactcaattgagtgcaaagatctgatgcatcccattttagtttctcataaattattgctttggttcatagttcaattgtaagcattattaaaacaactgcttctatttagacaatacaagaacgcgatctttccagtaactgcctaatctgaaattatgtttttcagttgcgcctgtggcctacacaacttgcataataagcagttaaaaataactcctaatcttactaatcttgtcgaactagactagctgtaatgatctgtcatatataagttaatattcaacatcgactgtaattgtcaattcaatcttgacagcaacgattgaagtcatcgcctcgccgtaattgaaaaaaaaatgtaagatgaataacagctaagaaagataataatttttatgaaagaagcatctgatagagaagaagcaccaaaaatggtggaaaaaaactatagtacaggttttaggaaagcccacggagagaaggatcaatcagtgactaagccaatctcgttagatggtagaacaggtgaagtaattgttagaaaatccaccgggaaaactaaaatacgtaaaggtcaaacggaagaagagtatacacagcaattgcagcactacttcgaagtagaacaaggccctgtgcggacaaaggtaggatggatggatgaggtagatcccttggttgagatccgggaaggcaagtacgatatctccaataagcatcagcgacaggtgcttagtggtttctgccatcgtttattttaccaatgtaagtacaaggagtgtctggatctcagcacctattttctggggctctttgaaccgttcaacgtgaagaataaaatgaagagggagcttgaagagttggaatatatgatcgagcgatgtcgtgggcatgtattataagcccgaatcagatactcaaatttgaaaaaagatatctttctcctccgacatggccgaactcatttacataaatagcataaattaaacagaataataatacgtaaattacaacagtcagagggtgcatgaaaccgtcattagatagagacgtgatcaaaagtagaaaatgataagaaatcagggatggtcattactttacagaatttatccggtgcggaggttcacaagatactccagagtagatatgacttttgaaggaaacactcaagatatctctacttctgtcgaagaaagaatgaccactgtttttggaggacgcttaaagggtgaaccaccaagatccacaagtagagtgcttagcggcggaacgaagaaaatagcaggtgtccaagtgcctgcaaaaccacaagaacccgataactgttgcatgtcaggttgcgttaactgtgtctgggagatatatagcgaggatttaagagactggaaacatagaaggaaagaggctgcggaaaagatcgcaggaactaaggagaagtggcctaaagactggaatccacctttgggattgttacatatggaaaatgtccctgttgagttacgtgaaaagaagctggaaaccgatagcaaaaaagcagaacaacctcatgatttatctgctatcagaagtttgttccctaaaagaaaagggcctctgcccaagagtgtattggcagccaagaggaaaaatattgctttgagacacaattacgaacagaaagatggaggagaccaatcagtcagtgaatcagatgctgatgaaggctgggaagatattcctgtctacgttaaagcctttgcagagtttgaatcaaagaaaagattacaaaaaattcgccgacaggaagaaataaaaaagaggacagctttggtttgaagcaaatatatattattgaaaagcctatgtacaatatttgcggtcttctttgatcttggtagactttatggatggagaataataaacatacatatatttcacttagagggtttaggagactaatgcgtgaatacgcgctggcatgtccccattcatgcatacatatattcgtaaacatacacatattcataaaaattttcagttatattatattataatctttttttaactatacagagaagatattaaaaaaaatgtatccaaagtgagttaaaaaaatcggaaaaaacaataaagatccttttctagttactttgctgcattaacattagtccatgtcaacatcaccttcagtgtccttcttttcttccttcttttcagcttctgcctttctttgagcagccaacttttcagccatagcagccatttgggatgcttcttgcttagatcttatagcttgcttcttttcttcttctttagccaagtatctacctctaataatgttacctagagaagccaattcttcgtatttggcaatgtacttagctttgatggaatcgaaaccttcatcgtataaccactcttcggccttgtttaacataccttgtaacttcgtcttttcagcatcggaagcaaatggagcatactcttcttccaacttaccacgcaatgtgtagatgtactcttcaagagtgttcttacggtcttctgtctcagcaactagcttatcttgagcaagcatttcattttctttttcaattaattcattcaactttttagcgtctaggccaaaggtgtgtgcaacgatggttaagtcatccttctttacagttttagtaaccttcttaaattcttgctcagcatcttctggagcatcttctggtaatggaataggttcttcaacttcaatatcttcaatagtgtaagcctcttcaattgtgtgtaaaccagaggggtcgcatctcaactttaacttaacaggaacagagtcttgaccttctggtaattgaacaccagtgatctcccagttagcgatttgttctggagtgtttggtggtaactgtgtgatgtcagtgtagctagcagccattgaaaagtcacccgtacggttcaaagtgatcaatttagtagatgggaaggatgaaccagctgggaaaacttccatgtggtcttcgtcctcaacttgcttgtcccaagagtaagagacagagtaaggatggatatcctcaaacttgaatggtctaactcttagagttggagagtgaatggcgcaaataaaggcggcacccttggcgatggcttcatcttggttcaaagtggtggacaatggcttgccgaaggcttcagaaatggattgtttcaatgttgggatacgagtagtaccaccaataatttcaacaaaatcaacttcttcagcagataatttggcttgagctaaagctttggtaactggttcagtaacacgttccaacaatggcttgaccaattcttctaattcttcacgagataattgagaggaaacatcaacgtcgttcatgacggattcaacagagaatggggcattagtattagcagacaaaactttcttcaacttttcagcagcagttagaattctgttgtaagcctttggattttctctgatgtcaatcttgtatttagttttgaactcatcggcgaaatgttctgttatagccaaatcgaagtccctaccaccaaaatgcttgtcgcaggcagttcctaagactttcaattgacccttcttgaaggccatgatagaacaggtgtaggaagagtgaccaatatcaacaaaggcaacaattcttggcttttcttcgccttcaggcaaatcagtcttgaagataccgtaagaaacaccggcagcagtaacgtcgttgacaattctaacagggttcaaaccagcaattctagcagcatcagcaatgttgtaacgttgttcttcggtgtaccaaggtgggacagcaatacaaacatcggtaatatttgcctttgtgtcctgcttgacggtgtccttgactttgtcgatgaacatggcagctagttgagtagctgaaaaaacatgtttctcaccagcgaatctaacttcggcaccagtcttcttgtcatccaattcaaccaacttagaggtgaagtgcttagattcttgctcgaaatctggatggtggtaatccaaaccaataattcttttcaagttggcgacagtgttcttgatgttggaagtctgcttgttcttaccagtttcacccaagtatctgttctttggaccaaaaccaacaacagatggggtggaacggttagagacttcattaacgacaatgtcgatacctctgtttctagcaacggcaaggacagagttattgttacctaaatctaaaccaaatggagtactcatcttttaaagaaatgttgtttgtcaatgtactttttgcttatggctatcgaggttaaaaataagaatcagaactaactgagttataagaagaaaaatcaagacagagggagtttaaaatggacagtaacttttatcactaaggttatattgacaagtagtgctctttggaaaaggaatcttctagaatcatcttcgttaaatttcttttttcattgccttcgaaaaaaaaaaagaaaaaaagaaaagaaatacacgtaacaaatgattatgcgctcaaccaacttaaacacttctcatctccattaagaaccttcaaacagacgatagattcgctaaatgatacgttctgcaatttgaaaaatgtgcttacctttctcaattcatgtggcttcaaacatttaatcgatatactagctataggtagtttgcacacgctaacatattattgtagcgttcttagtactgttattagttatcaagatatttaatttcaattaattatacaaatagatgggagttatactagttaatacattgaatagaagatatacacgcgtagtaaacaactactatggaacaaaaaggcttcaaaatctttttcctttctttttaccaacaacttgaaattcccagtcttcggaactgccttcaggcatagctaatacttcactccagctcaaggggtcattaatttcttcttcgcattctagacgttttttgatgaaatcagtggcaaatctcctaccgtccattgttgaactgtaggaatatatggtatctgcgataatttccttggattctgaacctgggggcaagctaagtagcatttctaaaacattatcgggctgaacacccgtatttagttttaattgggatcggcaccatctcaaaaattcttgacgcttagagacagaagcgttaccgggataggcagggatgcgagacggtttaacttgacgggcctttaaagtcgggatactagtggatgagccaatttgtttactcttatcgctcattttagtttttgttgcggtagataaccccccagaagaacgcagtgtgtccaaactgatatatgactttgactggttaccagcgacaggcatggtggaagcgatgtgggttgtgctcttagaagaaaccgtggtccacgcattgctagtattcgaagagttcaatgccgaagaagatggggaaggcgttcttgaaatgaaatcatcgagtgaagaagcgcggttgaatttctttgttttcttttgaacttgttcccacagctttttctgctcttcaataaaagtggaatctggtttaatatcaccattgttggccttgttaattttagactgactgttaattttggtactgtctttcatcaattctcctttaatatcaactttgatcggttgctgtggctttataccccaggcagaaccagtttgagttttcggaatttgcgccgagcttaatatttctttctgtagttttaatgcctgctcacgatctaactgagtacgattaggttttttttctttcttggacgagttctccttcttcaaatcttcaagagcagatgaaatctgattataaacagcaccctcgggtttcttgttagcccaaggcgccaaattagtggttatggaagttgcggtgttttcggaagatggagtttctgtatctccagttaaaatgttatttagcaattctttttgcttttctttctctaattttccttcttccttcttcttcttttttaacttctcttcttcctttttctgcttttgcttcaattttttctccttctttaatttgcgctgttcttctcttctctttttttcttcttcttgtctttgttgttcttccaataatttttgtgccatcagttctgcctttgcaaaccttttctgctcttcagaagtcatttgcggcgtatctttgcttttcggctcatcagcagtggatattacatccttacggtctacctcttcaatctctggttgaacttgatccaatatattttgctctttctcgcttcctcgagattcttcctcctgcttagtaggatttttgacaatagattcctcttcatttgttatgttagaaacagttctgccctcttctgaaaaaacctcttgctcctctggagaagcttcctcgtgggaaggaaccttctcttcatgggaagaagtggttttattagatctactagaagtcgtggatagaggagcggtatatgcagatatctttggtatgcgatctacctttgtgatatgacggccgtcaaccggaacccaaacctgagtttcatgatagtaacttccatcttcaaatttaaggccaaggatttcttcatacgtaaaatcatcactatgcacatcagcaacaggtatcaaatctcttgactcaactttttgcttttctgatgaagttggtgcaacaagtggaacagcattcaaagctctaataacaatgaaatcaaaggcgacaaaagggtcttgataattattcaccagagtagtcaattcacctagtctaataaaccgatcatttacaccaaatggctcaggagatgttgctaatctacagatttgcaaagttggagtaaaataacctccttgataccactgtgacatattattggtaccaaaaggcccctgaatgttaccattagagtcaatgtatttccactgagattctatccccggtggtgggggttgattaccaacgttgggggcaggccctgttgcgttgtagagataaggagctacatttggaaatgtgctcgagggtttattgagaacggaagggctgctggcgttcatatgcaggttggatgatgctgcactaaatgcactattgttttcctgattagcagatatttgtagcggagatccagtaatttcagcgtcatatgcattgaagggaacagtactggctccactaatcgcattactccctggcacaaaaggagatggaactctttggacgccaatagaatccataatggaggagggcctttgcaaaagagccgcattgttcatggttggagtattgctatttgataatgcagcagtgtctgagttcgcgtctgcaagtttaacactgtgaaggtcaaacgctagagagttgataggattcatcacttactgccactgccaatcttgtgcaagctgtggcaaaatcgaccttctccatgcgtccatggtaaatgaaatgttttgctttctttttcgtgcttgcaaagtttggtagatgaaatttcagaaagctactgccgtaccaaagtacaataataaggtgaaaatgggagtaggaagtaatagatggcattgaatgcctcatttattcattattcatgttttcttaacattttgattcagttgagtgcatgcttttttgaaaagactaaacattacaagttttaatcatgttggcccgttccagggtgtgcttgcagacaatcactagacggttggcagactttccagaagccaatgctattaagaaaaaatttctctttaggaaggacacctcgaccatcaaacagttaaaaggactgtctagcggccagaaaatagtactcaatggatggatagagcagaagccaaaaagagttgggaaaaatttgatcttcggacttttaagggactctaacggtgacattatccagttggttgataacaaatcgttgttgaaaggctttactttagaggatgtggttcaagccgtaggtatactctctttgaagaggaagctatcaaatgaggacgcagatgagtacgaagtgcaattggaggatattactgtgttaaatgcatctaataaaaaaccagcgcaaatgcaggattttaaattgtcagccatatacccacctgagttccgctatttgcaattgagaaatcccaaatatcaagattttttaaagaagaggtcatctatctctaaggaaataagaaactccttcaacaattttgattttacggaggtcgagaccccaatgttatttaaagctaccccagaaggcgcaagagagtttctggttccaacaaggacaaagagatccgatggtaaaccatcgttttatgctctagatcagagccctcaacaatacaagcaactcttaatggctagtggtgtcaacaaatattatcaaatggcaaggtgctttagagatgaagatttaagagcagacaggcagcctgagtttacacaggttgatatggaaatggcctttgctaattctgaagatgtcatgaaaatcatagaaaagacagtttctggggtatggagtaaattttccaaaaaacgaggattattgactttagacagtaagggtacattagtgcctgcgaaaaaggaaaacggcacagtatctatctttcgtatgacctacgaacaagccatgacctcatatggtattgacaagccagatttgagagcgccagatttgaagattatcaatttaggcgagttcaatgcctttagtcatttgaacaaaaaatttcccgtttttgaagtaattattctaagaagtgccttttcaaatatggaagagtacaaagaacgatggtcgtttctgacaaataacagtaattacaattatagagttccaatagtgctaccaattgaaaatgacgaacaagctaattcaaattggtttgagaattttcatgcaattgccacgtttgaaaacccacatctaataaccaaatttctgaaactgaaaaaaggtgacattgtatgcggttgtacgagagagccaaaccattccattttcgagaatcctactcccctgggaagattgagacagttggtgctacaaagtgagcatgggaaaaatatctatcatgctgtcaataaggatgttgcctcatggattgtggatttcccgttattttctcccgttataattgaagataagtctggtaaaaaagaaaagcttgcatatccggagtacgaaaaggatagactatgttccacgcatcatccttttactatggtgaagcttaaagactacgaaaaattagaaaagacgccggaaaagtgcttgggtcggcattatgacctcgtagttaacggtgtggaacttggtggtggctcaacaagaattcacgatccaagattacaagactatattttcgaagatatcctcaaaatagataatgcatatgaactatttggccatttactgaatgcttttgatatgggaacaccgccacacgctggatttgctattggttttgatcgtatgtgcgctatgatctgtgaaactgagagtataagggacgtaatcgccttcccaaaaagtattaccggggctgatttggttgtcaagagtccaagtgtgatacctgaaagcattctggaaccttacaatatcaagtatagtaattcaaaaaaatgagcagaagttgatgttacctagatgtgagagaatcttagtgtggctgcagtatgtaggtttttcttgtaaatattatacctattttgtttgccttgtatatgaagagatgaaataacaaatcgatatccattacttgaattgattttttatcaacattaattgtaatttctttataacatcttattggatatcatacgaatgtttttaaattacaaaatcattaaatcataaaatgttcagtgagtacaatctcccaaagtctacgtttactgtaatttatcgctatttacagggacgctgcagcttaaatattagcgcctaagttagtcgaagcattctgtcttgcccaattctggacagtagcagcggtctttaaacccaccccactcggccaacatttctaatttttcctttggctctaagaaatattctccgcttaatacaaaggtcccccaatgaacgcctaatacatttcgagcttctagatctttcataatcttgagaacctcttgaggattaatatgtcgtggtttttggtgccactcagggcaatactgaccacatggaagcagcgctaatttacaacctttgccaaagcgttctttaattctaacgaataaatctttcacatatccagtgtcaccagcatgaaaaagtatgggattaccatggtgtgttaataaaaaggagcaccatagagacttgttcgtatctaagagcgatctcccagaccaatgcatggcaggagtagccgatatgtggtatatctcattgtttttctttacttgcaaagtttcccaccaagataattctaggacattatcacagccgttacttgtcatataagatttcattcctttaggtactatccataagggagagtctttgccactccagtattccaagctttctaaatccaggtgatcggggtgattatgggatacaaggatgatatctggtttgggcacctctgtaatttgagatggcatttgagtaattcttttaggacccagggtcttgtggataagaaagtcactgaacagaggatcagtaagtatcctcaatccattataaaccgtgtagttacaggactggcccagccatgtgttatagactgggcactttgatccttcattttcttctactgcagtcggtatgtgcaattcgtctaacactttgcattctagcggcaatgccgtttcctctgcggggtcgacgtccactaagttaggcccccatgttggcttgtgtacaggcattaacttattcatttggtgtacatcacgtggaatacctcccctatttctttcaaataattcgaacactctatttgcaaagaattcaaaaacggtctgaatcctgtattcttcgaacgggttctcaaatctgcctaaaacttccaaagggctatattttagcaaggatcccttataagtgacctcgttattattctcctctaatctttgacacatttcgtttcttaaatcaatttgcttcactgtagccaatgatacataaaacgcatatcctgtgtaaggtaccaaaacagacaacagaagtatacgtgcgtattttctcgagcatttttgtatagggcgtgtcttttgcgaagcatgtcttttgaaagttgacaatgatgtctggggtctaaacagctctgattctcgtaaacgcactagtctcctttggagaagaagcctcatctgaacatggcaggtaacaaaattcatttgcaacacaagcaggcatgcaatccttcagtaattggagtgctactgttcacaccatattctcgctattctcgaactacgtttttttttttttgttaagcatcagtagtgagtcttcgggaactgcttaacgacagtaaaggaaaaaaaaaactagcagctgttgataatattcagaaaatgaacgcagaaggaatcattagctaaaaagtttattattaaaatcagacatatatctcattataatattttttttttataataccaccatttgttctcatataatactgataaatatcgcatcgaatggaaaagacaaataggaggccgctattgtaatttgggccttaacctatttattctctctcttttaattgatattttaatctttttgaagcctacaatgtattttgggcgataatcaaggagaatatcagtgtcatatactcactgtggtaaatgtatttctaaagtagttccaattctttcttcaaaaaaggccactagacgatgtgctttcttgcacaagcattttgctgggctatcttcaatagtgataattctaactaactcaaaaccagatggcaagttcttccctatggtcgacttctctcagacgcaatagtagctatgttattgatggcttttgacgccagaccgggtaaagcgcatggaatgaactctaaactgttaaaataacaaaaacgacatatgaagatgtcgatgaggctggatagtttagagatgaggtgcagagaacaacattgtataacaaattcggctcccaaatatcgcatgtaccatgtcatttcgtaaaagaggtgaaatactgaacgatagaggtagcgggctaagaggtccactgttaagaggtcctccacgaacttcctcaacgccattgaggacaggcaacagaagagcccctggaaatgtgcccttgtctgacactacagcgagattaaagaagttgaatattgcggacgaatccaagacaaaaatggggctggatagctcccatgtgggcgttagaccttctcctgcaacctctcagccgacgacatcaactgggagtgctgacctggacagtatactaggccatatggggctgccgctgggaaactctgtactagtagaggagcagagcacgacagaatttcactctattctcggtaaactgtttgccgcacagggtatcgttcataatagaatttcagatagcagtgctgataaaactagaaacggcgacactcatgtcattgtcttgtcattgaaccaaatgtttgcaaaggagctacctggtatctacaagggatcacgtaaacaaatgaagaaaaacctaatctctgaagaagaatcaaaagttactgttcaaaatttgaacgagacccagagatcgacgccttccaggtacaaagacctgaaaattgcatggaaatataaactggcagatgaaaagagattgggttctccggatcgagatgacatccaacaaaattctgagtacaaggactacaatcatcagtttgatattacaacgcgtctgatgcccgctcccatagcatctgaactgacatttatcgccccaactcaacctgtctccactattttgagccaaatagaacagactattaaaaggaatgacaagaaactgataagaattgttattccttcccttctacatccggcaatgtatccgcccaaaatgtttgaatcatctgaaataataggtttaatgcacggtgtgaggagtcttgtcaagaaatactatgagcgggttgtactgtttgcttccatatccatagacattatcactcccccattactggtattgctgagaaacatgttcgattctgttatcaatctagaaccctttaaccaggagatgactgagttcttagaacgtgtttataaatcgcaaccggggaagattcaacatgggctagtccacatattgaaattaccagttttcacggaccgtggagagatgagagttttaaagtctgaatgggcatttaagaatggcagaaaaaagtttgaaatagaacaatggggcatacccgtggatgatgctgaaggttcagctgcctcggaacagtcacattcacactcgcactcggatgaaatctcacataatatacctgcaaagaagaccaagatatctttagactattaagaatatggttcaatttatgggaaatatacggcatgctttttaacaagcgtggtgaatgtattatttttttatctgttatatcttaaatacgactattatatatatatccatcgtctttttcctgactctaagcggtggcagctggaaggtagaaaaaggtatcgcctagatgtcaaaatatgaaaaagtgaaatgaatattaacaaaaaaggagcgtgagctgcagaaagaatttgaccaacaaaagacaattccactcctttggatttgaaatagacagatagaaaaggatatgaaagtattacaattcaatcaagatgcaacgtgctgtgtggtggccgcgtcatcgcatcagatttcgatttttaactgcgacccctttggtaaatgttttgaaattgacactaagaattccaagaagaagacttcaaacaataacggttcagcttcaaactcagaatcacggaataatgaggagagcatattaataactaatggctcccgcgatcgtactgatgcagaagaagaggaagataatgaagataatgccctcgttacaggaaatatactgaaagaaggggagtttgtcattgaaatgttgttttcaactagtcttattgctattgcagatagaggacaaggtctaaacaaaggaaaaaagctgaagattgtcaatacaaagagaaaatgtactatttgtgaaatagttttcccacatgaaattgttgatgtggtcatgaatagaaaaagaatgtgcgtacttcttgaaagtgaccagatattcatttatgatatatcttgtatgaaacccttagaaactatcgatctttgggaagatcattataagaggtcccaagccaattcgttctcaaatgcgtcaaatactggtactttggagggagattctgcaaatttgaacagggtggctaccaatttactagcaaatgccactcaaaaaagtgtgaatggatctaatcctagtgtaagaaccagaagaaactctctaagaagtaaaataaggccaagaatggttttaagtaacgatgatagaagtatactgtgttttactgcgtatagctcgcccaagaagaataagcccaattcagaagcactatatgatgtagtgatttatgacacattaaatgtgacgccagttaattacttgaattccgttcataaggggaatgttgcatgtttagcagtaagtcacgatggtaaactgcttgctactgcctcagataaggggaccataataagggtgtttcatacgggggtagattcggactatatgtcttcaaggtcactgtttaaagaatttagacggggtaccagattgtgcaatttgtatcagctagctttcgataagagtatgactatgattggatgtgtaggtgatacggacactattcatcttttcaaacttgatgacgcctctaatagcctccctggagataattctagcaatggccactggaatgaagaggaatatatactagcatcaaattcaaatcccagtatgggaactccaaaggaaatacctctctcgaaaccaagaattgcgaattacttctcgaaaaaaataaaatcttcaataccaaaccagaacctgagccgtaactttgcttatataacagttaatgaatcgaacaggagttgcttagggtttccagacgaatttcccaaccaagtctatattgcctctgatgatggaaccttcagtatatatagtattccgtcaaaacctggtgaatgtgtgctgactaaaaataataaatttacataatgcatatgtgcagttttcataatcttaatagatattgtacgtattcacgtgtgaattgctaaagagggtagaaatcttcaaaacaagcaatttgaaaatatttacataggcaatggtacattctagaaacacgaaaagccaacaagataactaattctcaccaaaaccatctcctataccaaggcttcatatgtgttgattcattactgccctttcccctactagtattgtgggttttatcctgtacaattaactcatttaattggtgttccaggatttctacctctttctttagctgactttctctctcctcatgctctagtttccaccaagagaagtgaagcagtaaataaacggaagatcccattagaatgaacatccaaagaggcctaataaatctttttacagggatctcatgtcctgattcttcctcttgcgagaattttttgagcatatctaactcctttttgatatttaattttgtagtatgctcattaatcaaatcgcgtatcagttcagtatcaacaccatccaaagaatccaaattagccaagtcttctaggctcttgatttctttcttcggtgacgttgaaacagctcttcgttgttggttgaggaggcgcctgtggtaataggcaacggttgttatgggaaacaatttagttctactcaaagtaatgagagcattagagcgtctttttaacatattgtctattatatgctttggttcccatttcctttctcaaagtttacaaatataacagagtgcttagcgaatactttattttatgagtcttgccgttagtgaccccacccaaaataagatgcaaaccggtatacatattagacatttcccacgtatacaaatatattaagtaaataagcctcgtcgtgatgaacttaaatacatggtattgagagagttataaacaggtagatagatatcttaaataaaaataagcagataagtaacaatgtttaagaaaacgatggggaagcgtaaatatatgcaaaatttccccctcagtccttacgtataccgtatttggcacgaagcttccacatttccagtcttgcctgttgctgtaggttcaggttaggatgggacattggactactttcactatcacttctgattatagacccgatggacataaatagcccaaaggtacccgctgaaccagcaatgtatttccctagtgttctaactacaccatcaggacctgggccttgagttgcgatggcaaatccaccaaataggatgcctgtgcagacaccgacggtagtacccatcatcaaccccattttgaatttgtcccaattcgaaggctgctgttgcgcataattttgtggaagaggaggcattatatcttaatattggacttgaagctgttgcgctatttgtgctatatgatcttgtgtggtgttctgtgcttccttcttatggaaaagtagtggagtctgtttggtaatgttggtcttgttcgggagttttgaaaagaaaataaaaagtggttggctcataatgttaagaaagaatttccagtttccgattgaacacagcaatctacaggtagacattgtgaatcatgctcgaattacgaagttgtagtaatttggtcaatagtagtaggagacttgtgcctctggtgacttattccggactaagtgcaataacattgcctaaatctcgattttattcacagcctagtgctttagaagtacagggcacatcggattctcgaagcgataatattttagacgaactcaaacaaaggggtctagtgtcccaggtctcacagccagagagtttccttcggacgaagttgaacggtaacgataagatcaaattatactgcggggtggatcccacagctcagtcacttcatttgggaaatctagttccactaatggttttattacacttttacgtaaaaggtcacgacattgtcactgtgataggtggagctacagggaaagttggggacccaagtggtaggaaaacagaaagagacgttatggagaacgatattaggcaaagcaatgtggcatccatctcgcagcaattacaaaggtttttcaaaaatggcctagaatattacagaaaccgatgtgctctcactgaagatgtaccttccggaaaatatacaccaaggaataatttcaactggtggaaagacatcaaaatgttggatttcttagctgattttggtaggcacattcgggtacaatctatgttggcgagggattcaatttcttcgaggcttcaaaccaaaaatggtctgggatttaacgaatttacttaccaagttttacaagcgtacgatttttaccatttgtataaggaagagaatgtgactatacaagtaggtggtaacgaccaatggggaaatataacagccggtatcgatctcatcaataggatacagcctataaagaataagggtttgccatttggtatcactgtgcccttgttgacgacggctacaggagagaaatttgggaaaagtgcaggcaatgctgtttttattgacccctcaatcaatacggcgtatgatgtttaccagttcttttataatactttggatgctgatgtacccaagttcttgaagatctttacgtttttaaactcaagtgaaatcaaaaaaattgtggaaacgcatatcaaatcacccagtctacgttatggccaaactttattggctaaagaagtcacagatatgttatatggagttggctccggatcggattcagaagcgctttctaatattatttttggacgttatgacggaactttatctgctgcgaagttagttgatctatgtaaaaaagccagaattttgcagtatgctgatagagagattgacttaataaagttaatttgtaaactagtaaattgttcagtatcagaagccagaagaaaactttcccagggaagcgtgtatctgcatcattcaaaatctaaagtaaacgaaaatatttctaacttggctcctttcctgatagatgatcgagtactgatcttgaggataggaaagcagaagtgttttataatagaaatgcgttaaaaaaaagggaggtatataaagtacatgtataaaataggcatgcgtgaggtgatattatatcattttatgcactgacttgtaaataagattataaacgattattcatctttactacttgcgaacatttcactgtcacaccaggctatgagggcccacagccagagagtcgcagggcatagcagtaatacacaccagtagtgcaggaaagagtcattgttgcgtaaccagtaaaatgtagcaagactaattaggagtaccgagtaagtaaaccctaaaaccaaaaagccttggtcacgtggtctcatgcgcttataaattctcaatcatgtaattgaaacagtcctgttgcctagtttcaactgttctatgcttcttgatgttttcgaaactttgcgtagtgtaatcttccttgtattgtagcgaagaaaaaaggatgcgttgggaacagatatagaagacgtaaaacaacctgaagaaggtaacaggtggagtagcaatgggagaggtatacgaaaaaaataacatagattttgattcaatagccaaaatgttgttaattaagtataaggatttcatactgtctaaattcaagaaagctgcacctgtagagaatataaggtttcagaatttagtccatacaaatcaattcgcacaaggagtcctaggtcagagtcaacatctctgtacagtctatgacaatccttcatggcattctatagtcctggagacattggatctggatctaatatataaaaatgttgataaggaatttgccaaagatgggcatgcagagggggaaaatatatacacggattatctagtaaaggagctgcttcgctacttcaaacaagattttttcaaatggtgcaataaaccagattgtaatcattgtggccagaacacttcagaaaatatgacacctctgggcagtcaagggcccaatggagaggaatctaaattcaattgcggaactgttgagatctataaatgcaaccgatgcggaaatatcactagatttcctcgttataacgatccaattaagttgctggaaactagaaagggaagatgcggtgaatggtgcaatttatttactttgattttgaagtcgtttgggttagatgttcgctacgtctggaatagagaagatcatgtttggtgtgaatatttttcaaattttttgaataggtgggttcatgtcgactcctgtgagcaatcattcgaccaaccatatatctattcaattaactggaacaagaaaatgagttactgtattgcgttcggtaaagatggcgttgttgacgttagtaaacgctatatcctccaaaacgagctgcccagagatcaaatcaaggaagaagatttaaaattcctttgtcaatttataacgaagaggttgaggtattcgttaaatgatgacgagatataccaacttgcatgtcgcgatgagcaggaacagatagagctgattagaggaaagacacaagaaacgaaatccgaaagcgtcagtgccgcttcgaaatcatctaatcgtggtagagaaagtggatcggcggattggaaagcacagcgtggggaggatggtaaatagagaaataaaagaacagattattatgtgtaaggaattttatctaagaacatatttataaaactaactcatcaaagctgcccaagaactcggcagcttgctttgttaaccaggaattactttcattgtcgagataagccaaatgtccacccaagtcagtctcgcataacaacacacaaggattttctctagcttgtttgtacggaattacgttttcacctgtaactggatcatccgttgcgttgattattaaagttgggattttgatattaggcaatctatttatcgaactggcctttctataatatgttaacccgtccggcaggcccatcgatggggcagtgaaaagattatcgaattctaatatgtctgtaaatttttcagccttttccaaattttctctggtatacgtataaaagactggtttctcaactgtcggtttgtgcgaaacctcaaaattctctggtacctgcaactcattcatattaaccttgacagtccttgttagaaattgtgttaaagttctagaaaaaatatggttggaccaccaatcatgagccaacttgtcccaagtgtgtacgaaatcccatgggtttgagagagcgactgcagcatttaatggacagttatctccttcttcacctaagtagttcgttagcatggctgctccaaatgatgttccgactgcatatatttttctttgcggaaatagagctttttggtggttcaaaaattctctcacatcacctgtgtgtaatgcggtaaagattctacgggtggtgactttagatcttgagcaacctctagcattaaggactaccacttggaatttaccgtcaccgacttttgatagatcttcagataatgccctgatgagaggctcatggcttccccctgcaagaccatgaagtactaccactaaagggtaagaataacccttagaatgacatttttcaagttcctcagaggatagatatctagttctcgggtgaagacgaggccaaccctttggatgggtggccttttcatcgttcgaaaattgtttctcgttaaaactagccttttcagcatttaatgaatatgtttgctcccattcaggcataacccaatctgcagtgcagacccctccatcagaaaattttataatctctcttccataaaatacctgaaattttttggaaaaatcaccggctgacaaataaagggtctgtaagtaacctgtgaaaagcaagctgtttaacctaaaatttgcaccatctttgagtgtaggcacgtgtttggttacgaattcatgaagaggaatttggcgcttagaatctctgaaagccaaagacttggttcctttctctcccagtacatgtttgacggtgccgttatagccccaatggctaggagtgacagttggatagtaacccgagcgaaacattaaaatgacaaatatgaaaatacttgatatcttgatctttttgctaatcttcaaaaataccgaaaactaagtaggcaaccagatgcagaacccttcttatataatcgattcctgtaagcaagtgtcagcaaatagcttctatatagagacctttcggtgaaagtatattaaagccggccggaaattgagtaataataaccgctaattatgcggtgtgtggattcagatttttgccaggagcgataaccttcaaatctaaaactactcactataagcgatgaagcaaccagatggtagcgctttggtgccggttctcttgaaggtttgtacatgtgcgagttcatgaggttacaatatagaaggtttatacagtagagctatacaggataatggaagttcagttttgttcggctttttcattgatggctttcttcttattgctttctctcttggcttgtttcttcttcattcttttcagtttctttttgtaactataagtatccttctcaccaaaaccgtaaagtggcttaaaactctctagtacaccgcaatcttcgaacaggttgggaaagatccagaacccaccaacatctttgtagacaattaatgacaaaacatataatatcaatctcaggatagcgacagcaaagaagcctgctaagatgccgaaggcacccagagacacataataggagccgcgtctcatggagcgcggccacaatgggtagcatacgagcgccaatatgatggacacgacaccaatgacgatcaagtaatccatgtaggttctagggttatagttccaaacaaagtattcatcggcttccaattgtgctttattcgaaacaatcaagtgcggaaagtccttgcttggcttcaatccatgctctttgcattcttgactatgcaattttttcactgggatcaccatttgtgcctttataagttgaataaagatttcacgtgacttaagctggtcttcgatcttgttagaaggtatagttggatatatctctggctgtcttgcagatttgttggcatactcctcagaatgcagtgccctaacaaatctcttgtaacggaagaagtctgtctgcttggcctggaataaaccctgcctttgcttcaactccttatggttgcgtaaaagagtagcaatggctgtagcagatccgccattgacactagcacctgcattgctacctggacctacggctgacatgttctcctgtgtttgctcggctaccatactgcattcaactgcaattataaaagcccactcttctccctcttgatttgtatgccagtattgggaaaacgacacgtctattccgtcgcacacgatcttcactttctttttttttttcaactgaacgaaaagttttttccgcagctcatcgcaaagaaaaattttcacctatgtactacctcatctaatacaatataaagaatacacttcagatttaggagttgcagcgtttataaaaaagtaagtgtaccctccaaaagcaaacacatctccctcctataccgaagatgcaactttcatggaaggatatccctactgtcgctccagcaaatgatttgctggatattgtcttgaacagaacccagagaaagacaccaactgtgatcagacctggtttcaagattacaagaatcagagcgttctatatgcgtaaagttaaatacacaggtgaaggtttcgtggaaaaatttgaggacattttaaagggttttcctaacatcaatgacgtgcatcctttccatagagatttgatggacaccctatacgaaaagaatcattacaagatatctttggcagctatatctcgtgcgaagtcccttgtggaacaagtcgccagagattatgtcagattgctaaaattcggtcaatctttatttcaatgtaaacaattgaaaagggccgctttaggtagaatggcaactatagtcaagaaattgagggacccattggcctatttggaacaagtcagacagcacattggtagattaccatcgatcgacccaaataccagaaccttgctgatctgtggttatccaaatgtcggtaagtcctcgtttttgagatgcattaccaaatcagacgtcgatgttcaaccatatgctttcacaaccaagagtttatacgttggtcattttgactacaaatacttgagatttcaagctattgacacccctggtatcctagatagacccactgaagaaatgaacaacattgaaatgcaatcgatttatgccattgcccatttacgttcttgtgttttgtacttcatggatctttccgaacaatgtggtttcaccatcgaagctcaagttaaactattccactccatcaagcctctattcgccaacaagtctgtcatggttgttatcaacaaaaccgacattatcagaccggaggatttagacgaagagcgtgcacaattactggaatctgttaaggaggttccaggtgttgaaatcatgacttcttcatgccaactggaagaaaacgttatggaagttagaaacaaagcatgtgaaaaactattggcttctagaattgagaataagttgaaatctcagtctagaatcaacaatgttctgaacaagattcatgttgctcaacctcaagcaagagatgatgtcaagagaacaccatttatcccagaatctgtcaagaatttgaagaaatacgaccctgaagatccaaacaggagaaagttggccagagacatcgaagctgaaaatggtggtgctggtgtcttcaatgttaacttgaaggacaagtacctattagaagatgatgagtggaagaatgacatcatgccagaaatcttggatggtaagaatgtttatgatttcttggaccctgaaatcgctgctaaactgcaggctcttgaagaagaagaagaaaaattggagaacgaagggttctacaattctgacgatgaggaagaaatctacgacggtttcgaagcatccgaagtagatgatatcaaggagaaagctgcatggattagaaatagacaaaagacgatgattgctgaagcaagaaataggaagtccttgaagaacaaagctatcatgccacgttctaaactaactaagtcctttggtaaaatggaagaacacatgtccactttgggccatgacatgtcagccttacaagataaacagaaccgtgctgctcgtaagaaccgttatgttgaaagaggttctgatgttgtttttggcgaccaagatgctttgacagcttccactgaaaacggtgtcaagttgagacaaaccgatagactgttggatggtgttgctgatggctccatgagatccaaggccgacaggatggccaagatggaaagaagagaaagaaatagacatgccaagcaaggtgaatctgatagacacaatgctgtttccttatcaaagcatttattcagtggtaagcgtggtgtcggtaagacagatttccgttgatttctctacttcttattctttcttttgcatgtactttaaaaaaaatatgaatataaaatgtggatgtacgtacacgacattctaatctttttgggctggtaggattaccatttacatttgattatctctctcactattagtggtttctttttctttctttctcactttttctgtatcttttttttaaaaaaattttatttaatctgtataataataataaaccgatttaaattatccaacaagccgacccctccatgttctactatttttttgtatgtcactggatgtatacaaataattaagcatgtggaaaaagaaggggtgggatagcgtcaagatgacacttctacttttttgtgacacatcatcatgcaacctatcgagtctcccacgaggttgacaaataagaaattgttatcgtttttgcagtgtatcgtataaggcaacaatagcgatgtctcccatcaattgactgataaattcctgcaaactatcattttttttttttcatccttgtgccgcgtctgtagccgaaaatctgagagtgcatgaatcttaaaaaacagaagactcatcgccgtctttggcacattggggttgtctttgacttcttttgcttatttttgctcactttgcttattttacctatttaactagaggttctaaaagaatagccaaccagcgtgtagttcttatttctaatccttgtcttgttaagttgaaacttgtgatattggctgaacaaattctccgcatttagacaacacacaaattacagctttcccctagtaacgattgttgattgagctcagacaatacgcgcaatttaaaaacgttttatagtgtaagagaagacaagtacaagaaaaaaatggttgccaattgggtacttgctcttacgaggcagtttgaccccttcatgtttatgatggtcatgggtgtcggcatttcatcgaatattctatatagcttcccatatcctgcaaggtggctaagaatatgctcctacatcatgtttgctatcgcttgccttattttcattgctgtgcaggcactacaaatattacatttgattgtctatattaaggagaaaagcttcagagaatattttaatgactttttcagaaatatgaagcacaatttattttggggtacttatcccatggggttagttacaattataaatttcttaggagcactctcgaaagcgaacacgacgaagagccccactaatgccagaaatttgatgatatttgtttacgtcttgtggtggtatgatctcgcagtctgtctagtaatagcgtggggtatctcgtttctcatctggcatgactattaccctttggaagggattgggaattatccttcatataatatcaaaatggcatccgaaaacatgaaaagtgtattgctactggatatcattccgctggttgtcgtcgcttcaagttgtggaacattcacaatgtcagaaatattcttccatgcgtttaatagaaacattcaactgataacgttggtcatatgtgccttaacgtggctgcatgccattatcttcgtcttcatactgattgcgatatacttctggagtctttatattaataagataccaccaatgacacaggttttcaccttattcctgcttttgggcccgatgggccaaggaagttttggagtcttattgcttacagataatataaaaaaatatgcgggcaaatattacccaacagataacattacaagagaacaagagatattgactattgcagttccatggtgtttcaaaattctaggcatggtttctgctatggcattgctcgctatgggctattttttcaccgtgatttctgtcgtttcaatcctgtcgtactacaataaaaaagagattgaaaacgagacaggaaaagtgaagagagtttataccttccacaaaggtttttgggggatgactttcccgatgggtactatgtctttaggaaacgaagagttatatgtgcagtataaccagtacgttcccttatatgcatttagagtcctaggaaccatatacggcggtgtttgcgtttgttggtcaattctatgccttttatgcacattgcatgagtattctaaaaagatgctgcatgctgcccgtaaatcttcattattttcagagtcaggtacggaaaagacgacagtttctccgtataacagcattgaaagcgtggaagaatcaaactcggctctagattttacgcgtttagcataaaattgttggttttatacgtacataattggcaagcatttcatgtaggagtctcaatagatagtttaattcatttgcacggcgctttgctgcttttgcttcttcacgttggttttcactatgcctgatattttttgacgtcacttagtaagcacgacccttgtcaatttttcgaggatttcggagctttccatttggaatctactattaaaatcagtctaaaaaagtataagaaacacttctggtttttctcatgcgcttctcactctcagtatattttgctgctttccttcatatgtatatatatctatttacatattagtttacagaactttatgctttctgcaaccaaacaaacatttagaagtctacagataagaactatgtccacgaacaccaagcattacgattacctcgtcatcgggggtggctcagggggtgttgcttccgcaagaagagctgcatcttatggtgcgaagacattactagttgaagctaaggctcttggtggtacctgtgttaacgtgggttgtgttccgaagaaagtcatgtggtatgcttctgacctcgctactagagtatcccatgcaaatgaatatggattatatcagaatcttccattagataaagagcatttgacttttaattggccagaatttaagcagaaaagggatgcttatgtccataggttgaacggtatataccagaagaatttagaaaaagaaaaagtggatgttgtatttggatgggctagattcaataaggacggtaatgttgaagttcagaaaagggataatactactgaagtttactccgctaaccatattttagttgcgaccggtggaaaggctattttccccgaaaacattccaggtttcgaattaggtactgattctgatgggttctttagattggaagaacaacctaagaaagttgttgttgttggcgctggttatattggtattgagctagcaggtgtgttccatgggctgggatccgaaacgcacttggtaattagaggtgaaactgtcttgagaaaatttgatgaatgcatccagaacactattactgaccattacgtaaaggaaggcatcaacgttcataaactatccaaaattgttaaggtggagaaaaatgtagaaactgacaaactgaaaatacatatgaatgactcaaagtccatcgatgacgttgacgaattaatttggacaattggacgtaaatcccatctaggtatgggttcagaaaatgtaggtataaagctgaactctcatgaccaaataattgctgatgaatatcagaacaccaatgttccaaacatttattctctaggtgacgttgttggaaaagttgaattgacacctgtcgctattgcagcgggcagaaagctgtctaatagactgtttggtccagagaaattccgtaatgacaaactagattacgagaacgtccccagcgtaattttctcacatcctgaagccggttccattggtatttctgagaaggaagccattgaaaagtacggtaaggagaatataaaggtctacaattccaaatttaccgccatgtactatgctatgttgagtgagaaatcacccacaagatataaaattgtttgtgcgggaccaaatgaaaaggttgtcggtctgcacattgttggtgattcctctgcagaaatcttgcaagggttcggtgttgctataaagatgggtgccactaaggctgatttcgataattgtgttgctattcatccgactagcgcagaagaattggttactatgagatgaagcaacgaaactagacgtccaatctgctgttgctatactggacttttgtactcttgtaaacaatcttatatagcatcctgaaatacgtagtaattttgtcatttctgttcaaggacaagggttcctttttttttcagactattagctactgtggactcgcttggatattcagttgaggatacattccgactctcgtttacaatacatatgattatttttctttttgttaattatataaaaaataaagttatttgattttaagcttaaaaatacacaaaatacagaataagaaaggagtttttgaacaaaagaatttatcttttactgctttctaactttaagccttcaaagaagaagctcttctctttctgatttcagccttctcagcctttctttcagacaatctcttagccaacaattgagcgtattcggcagcagcttctctttgagcttgagcgtttctgaccttcaaagctctttggtgtctctttctttgcaatctttgaggagtaaccaatctttggatctttggagccttggtgtaagtcttttcacccttggtgacttctcttctgatgacgaaatcacgaacgtcatcttccttggacaaaccgaagaactttctgatgttgttagctctctttggacccaatctctttggaacagtagtgtcagttagaccttccaattcttgctcacccttcttgacaatgaccaaagccaagacagccaaatctggaccaacaatggcacctctgacggactttctctttctttcaccatcacgtcttggtctgtaacaagaaacgttcttggtcaacaacaacttgattctagttggcaacaaaacaccttgcttcattgggaaaccttgtttgtcgttaccaccagagatcttgaagacgtaacccttgaattcgtcaccaacggcttcaccatcgacttcttgaccgattctcttgtcgaagaaaacacgaatacggtgttcatcatcaatttcgaaggtcttttgagacccgttaactgggtaagaaatgttcaactattttaaattttcaacaggttattaagaaaatttgttagtatactattgcaaaattaatgtttgaatagggtgaagtttattactctagagaaattattaagtggaagatgaaaaagcttgtcttttattgactatactccaagtatatgaactgcttcaatttcacggtttgtagtaacagtatatgtaaacccgctctgtttgtttaaaaataacgccacaaacgcatcaattagtatatggtagtcttcctgcttctttccataaaaaatttctaaaatctttacgacgtctggttctgtttagttctttctcactttcaaactttcatgccatttttccacatataaagttctctgttgcccctcaataatagtatcataaatcataccttcatgatgtatagtctgtcttcactcttttgtcacttctcttaagcaaatataaaaattcaatgacgaataagcattaaccactttatccttggtaacactgtatatgaaatttcaaagaaactgcagcatcatgatgttcctagacgtcggtactggaattcccacccagtagacttacctaggtagcggcattcctccaacgcttaccaggagagataactttcccgctagaatcgatagaggagcgtggaattacgccaatcttccaagtgggaacgggcagagtgtccagtggcttcctgcctacagaatgcacggccccagtgggattggtgcaatcgcgcacgttccaactttccgatgctccggcgcgtcgatgacaattttacacatgaaaaacgaactatgtaaaaatagttgaaatgtatgggttcaatgagaactcgaatgtacggatgttttctctgaatgaacctcttgtcttcttccggcttctgcttacatcaaactccaggccaggcggcaattcattttagttgctaatgcacaaaagagtacttaaatactatcattattcagaaaatgcaattgagtttttcgtttttcttccttgtttgggttattcactacgtaaatatgtgcatttacaataatataaatataaattttttaaatgaaaagaagtttcttatgcttggaatattcatactggtcaaattttttggtttatattttgcttgaatttttttctcctgaaatatcagtcgaaaaattaaagaatttagtgcctagtggtgtttgagcagtatttatgtatggagtcagcccggtatttccattatatgcggtggcagcagcatcatatgtacttgagttggactgattgttcgagtcaccatcggtagtatgttctgaaatagcagctccatttacgggtgcatcttcattattactatagtaactgttattgctattgttactgttattgtcgttgccgttgttgctgttgttgttgctgctgttgttgttgttattgttgttgttgttgttagtgttgttagtgctgctgatattgctggagttgccgttgtttacggccgtctgtacgggagggaaagtaccaggattgtttgtgtttcccggcttggcactgttgggtcccattgaccagtctggaaacatcgatatagaagaaacatttggagaattactcatcaaatcatgtacgaacttcgatggcagtgaaccagttggagggccattgctggtttcagggccggaaaaagttgaaggggggcgtccggttaatgttgtagttaatggtactgtttggctctgttttttgaaagacatttgttggtattgctgggtttgtctttgagctaaaaaagatgtattttgttggaaaggtccgccaggaatattcgatggttgcaagggagtggcaatgtatggctgtgttgcagaaaaaagaggtgaagacccacttccgaaaggataagggtgattgttattgttactgccattaccattgttagaaccgttaggcgcatttgcatttggcaattttattaccattctgccattattacctttttggagagttaaggggcctgaggcagatgcggatagtggagaaattttgctagacctacttgttttgttttctttcattatctgcgaagagcccatactattgccgttggccgatgtggaggaggcagaggagggttcacttggaatagcggaattactgctgaaattgttgttcggaattctcacacgaagtaccggtctggcggacaatttccttcttgctttgacagtctgctgaatagagtcttccaaagaattagatggtgactgagtgtagttgctgttgtcattattattgctgccactattgttaattttgtgctcctgtttaggggtccttgaggatgcatttgtaaatggcttactgaacttgttcggtgaaatggaaatgggtggaggacgaccattaaaggaagagttttgaaagcttggtaattttggaaaatccatcgtggaaggagaagatgaactggatgaaggctggttaagattgtacatgctactatggtatggtctcgatatattttgctgctgttgctgttgcggagttctacttatttgcaaaggatccggtttcaatcttttcaaatgttgtaaaggcggcagcgcgttctcaggatgacgtttattttgctcactaccatccatctttgaaatgagtgcggtcggggataacaacttcatgtgtgcactcggtatatttttatcagaggcttttttattcgaatgcatatttgaattcctctcaaaattgccatgatcatcgtcgtcctcatcattgttctcatcatcatcattttctgactggttcattcctttaacatttgatttcgaaggcttatttgacatagacgacctgagtaggtcttgatttatgttaacggatgcacttttgtgaaagtctccataatcggaaggatctttcacttcgtgaagcaagtttttgtcattttggtagtgatagattaaatcattcgtatccacagaggaaaactcatagaacgtgttattggaccccagtataatgacggctatgtctacttgacaaagaacggatagttcatgggccttcttaaaaaggccagctttacgttttataaacgtgacagccctatttctgtcatcagaaattctctggatttcaatcttccgtctacccatgttgtatctatagtatagttttgcgacactttaatatttaagtttttttcacgcttcagcctgtttgctccgggggatattaacctcacaacgtgatagaaaccttgaaaaaaaaaaagaataattctgcttgccagctttcaattactttaacgagtcaaaagttgagttggctatcaggagtaggcagttctaattgaatcagtcgttgaacactttagaacaggctcgcttctttcttacgtttctttttgtctgtcctttaattattattgttcagaggaagatcgagctgtttctattattagctttcatctcttccgttttatttttatcagaaatctgaagtaaatttttttctttctttctgcggcttggcattcatcacccggtgatgctgcgccgttaagagagcccaataatgataagacgatttctgcatttaatatacgactgagacagacttcgtcaccgtggaagtattttttgcgaacgtggaagtatttcacccacgtatggcaggcaagaacgcattttcaataacgttatttccacggaaaaatgtgattagtgtagtaggttaggaacgggagataactcggccgcttggtttgaatttgtttcccttcgattttgttttcattgcttgagtaaaagaagctaagctaacatctgccttattcttctcagccttttcgtatatatatatatatatatatatatattaggacccagagaacaaggtatcatatattaattgtcttgccaactatgtaatttggctgttacggaagacccacatcaggcggcagaaatggttttagttaagcaggtaagactcggtaactcaggtcttaagatatcaccgatagtgataggatgtatgtcatacgggtccaagaaatgggcggactgggtcatagaggacaagacccaaattttcaagattatgaagcattgttacgataaaggtcttcgtacttttgacacagcagatttttattctaatggtttgagtgaaagaataattaaggagtttctggagtactacagtataaagagagaaacggtggtgattatgaccaaaatttacttcccagttgatgaaacgcttgatttgcatcataacttcactttaaatgaatttgaagaattggacttgtccaaccagcggggtttatccagaaagcatataattgctggtgtcgagaactctgtgaaaagactgggcacatatatagaccttttacaaattcacagattagatcatgaaacgccaatgaaagagatcatgaaggcattgaatgatgttgttgaagcgggccacgttagatacattggggcttcgagtatgttggcaactgaatttgcagaactgcagttcacagccgataaatatggctggtttcagttcatttcttcgcagtcttactacaatttgctctatcgtgaagatgaacgcgaattgattccttttgccaaaagacacaatattggtttacttccatggtctcctaacgcacgaggcatgttgactcgtcctctgaaccaaagcacggacaggattaagagtgatccaactttcaagtcgttacatttggataatctcgaagaagaacaaaaggaaattataaatcgtgtggaaaaggtgtcgaaggacaaaaaagtctcgatggctatgctctccattgcatgggttttgcataaaggatgtcaccctattgtgggattgaacactacagcaagagtagacgaagcgattgccgcactacaagtaactctaacagaagaagagataaagtacctcgaggagccctacaaaccccagaggcaaagatgttaagttagattttcatgggcccactgatatatagaaggctaaataacgagaatcatatatactgtaacatgacacctgctgatttttactgatcgtagccattcggctcatattacttcatgtcccttttttaaatccctcgttcccggagagtggcatagcatgtccgatagcgtacgccaacctacagaatcaggggatcagatttcctgaaagcaacttatccatcagtttctttttataatgccataatgacaggtgtgcctttcttattttacttcgcttgctttctttctattgcatgcttcaatctttgaatatttgctaatagtgaaaaaaaaaaaggaaataactatctggtttatctgcattgttcttcgtttttcaattcaagaatttaagcaaaaggatatatcatagaacctagtgaatttttaagaaagtaagataaagaaaaaaatcaaatgctgttcagctggccttatccagaagccccgattgaaggttattggggcaagccaacttctctgattgattggtgcgaggagaattatgtcgtatccccctatattgcagaatggtcaaatactattaccaatagtatattcttaatgaccgccttctattctacatatagcgcttggcgtaataagttagaaacaaggtatatattgataggaatggggttctcgctggttggtattggttcgtggttatttcatatgactttacagtatcgttatcaattgctagacgaactaccaatgctgtatgcgaccatcatcccatcgtggagtatttttgcagaaactcaagaaatcttgattaaggatgagaagaaaaggaaggaaagctcatttagaatccaaatggtcatttcttttatcatgtgtggtatagtcaccattttaacctggatttacgttgtcgtccaaaagccagcaattttccaagtcctttatggtatattgacgcttctagttgtggttctttctggctggctgacctactatcacgttcatgattcatttgcaaagaaaaatctttttattactatggttatgggcatgattccttttgtcattgggttcatttgctggcaactagatattcacctgtgttctttttggatctatatccggagaacatatttggccctgccattaggtgttctattggaactgcatgcttggtggcatcttttgaccggtactggtgtctatatcttcgtcgtgtatttgcaatatttgagaatattaacccatggaaatccaaatgacttcttatttatatggaggtggggatttttccctgagctggtaagaaagggcttaccgattggtacttcttattcactggagtatctggggccaattgtaaatacacaggtagatgatgaaacaaaaaagaataactaaggagtgattttgtgccatccatttgaatcttcaaaatatatgtacgtatatgttatgtatgtatataaattgttgtacgtgcaattgaccgaacgtgtatatttgtatatagatatgtgacaaactaaagagcttacacttcgttccttcccttctgttcacctttttttattatgcctgactattctaaaatttatgtttatgtggcgtaaaatatctttcttctgaaaacacatgcagcagttactcccatcataaaaggaattaataaatgaatagtataaacaattatttacttaaatatatttaaatttctgcttggaaaaccggccatgtcggcggcacataaaagttctatttacctttaaattcttttcgacatgtatggaccgtctagttcatatcctagtttaccatagtaatttcttacaccaacaccagaaataacagaaattttctctgaaccatgctcttccttggcgattctttccgcttcttccatcaatagagtaccaaacccttgatgctggaatttacgaggatctcttgaatgaagtggaaccacagaaccataaacatgcaattctctaacaatagaagtcctctgggaggtgaattcttttctatatgtatatttctttgaagcctttctcaatctcagcaaaccaatcagtatatctttctttggatcttcatatgataaaaaggtttcccaaccaccatttgcatagtaatcccttctgataagctcgacctgatctggttgaactttatgatgcacttcttggatacccacttccctagtacgaacatccctacaagttgtacccaagtccttcattctagctaatgccaattctctcaagttaccattgtcaacacctgaggtaaccaagggcattggaatgtctctttggacacggtagattcttgtccatgggggcactagggccaagattctagcaactaagtccactaaggcgttggcactataagacttatacctgcccgttttccaaagttcgtataaacctgtacccctaatgactaaagttggatagattttcaacccatcagtcctaaaatcaggattttcaaaatactctttgaactgttcaatatctctttccatcccaacatttggtaaatctggcatcatgtgagaaacaaccttataaccagcatctttagacacagcaaaagtttcacaaacagacctaacggtgtgtcctctattagtatcacgagcaacgtcttcgtacaaggactgaacaccaatttctaatctggtacagccatattttaacatatcgtccaaatgtgtttgcgtacaataatcaggcctagtttcgattgttataccaacacacttcgttaaactttgttgcgaataaagaatagcttcatcaatatcattaccattgaacccagaaagtgcattatgcaatttcacaataaaatcttcacgatattcttttggtaatgacataaatgtaccacccatcagaacatattcgactttatcgatggagtgacctaactgtttcaattgttccaccctaccacgtgcttgttcataagggtcataacgagctctgatggcacgcattgaagttggttcatagcctgtgtaagattgtgtagaatactcaaaatctgaatctggaccacctggacaataaacacaaatattacctgtatatgcaatgtgaggacaacgatgtggtttacacataacggctaccactgcaatacccgatgctgttcttactggcttagccttcaatttgggtaataaatattttttgtattggtctggaatagaattaatgatatcggttaaccttggttgttgctttagtttatatttctttgaatatttagtaatcaaaccattcagattaatttctcttgttgttcccgaggttaaagaatctgttaactctaatgtgatatcagcacaacattgtataaacctttccttttcaggtgctagcttttttttgttagtttttgggccttttccatgacgagccatctttgtcagggtgttcttcgattttccttaggtgcttttaggacttgtttatttcaaaactttgcactggataatttgagatgagctaactaaatttcaaaattttttgaccattttttttttttcatgaggaagagccagtgacagtaaataataaaaggtgaaatgattaaacaatgaaagcggcagaaaaataaaatcaaacagtggcagtattgacttttgaaaatcagaagttcatcctaagttaagactttcttcttttaagtgctttctccttctctcactgtcttatcgctgtatatctcattgttgaataatataacacaacgttataagtgatcatcactttctgatccataatttcaaacctcaagcgaccgtacatgtggcattttccactataaacttacgagcaagagaaagatatacggaaaaggttaattggcaggttacacaagattttggtcattgaatatttgcagccctcctgcttgagaaactggacaacaactgttatcaatattcccttttcaaaatagtggtatttaactggccataaccaaggaaaccgttgtacctattattttgtatagtcttcatttaataacgtgttaagaatgacacctgaagccaagaaaaggaaaaaccaaaagaagaagttgaagcaaaagcaaaaaaaagctgctgagaaagctgctagccacagtgaagaaccacttgaattaccagaaagtacgattaacagcagcttcaacgacgactcggtgaaccgtacagaatctgacatagcttcaaaatctgatgttcctccggtctcatcatctaccaatatctctccggctaatgaaacacaactagaaatacctgatactcaagaattgcatcataaactgctcaacgactctgatcaacatgatattaccgcggactcaaatgatttgccagacaactcaatcgttgaacatgactctgttattacccaaacaaaaccagccatgtctcaagaatacgaagagactgccgctcacttatcttcgagaaatccatcgctcgatgtagtcgcgggagaacttcacaataataatgaacatacccagaaaattgccgtatccgctgtggaagaggattctttcaatgaagaagagggtgaaaatcacgacagcataataatttcatcattaaacgatgctaccccttctcaatataatcattttctcccatccgatggcaatcttctttctccagaattatcttctggtgatacgccaactcacaatgttcctctaggcacaaaagacaatgaaataaatgacgatgagtattgtaatgataaggaaattagtttgaacgcaaataatgtgcttcctgatgaactttcaaaggaagaagatgaaagattaaaactagaaacgcatgtatcaaccgaagaaaagaaacaggatatcgctgatcaggaaactgcagaaaacttatttacgtctagtacagaaccatctgagaataaaataagaaattctggtgatgatacctccatgttgtttcaagatgacgaaagtgatcagaaggttccatgggaggaagatgtgaagaaagattttcataatgagaacacaaataatactcaagaatcggcaccgaacacagatgatcgtgataagggttatgaaggaaacgaagctttgaaaaagtccgaaagttgtacagccgcggacgagaggtcgtactctgaagaaacttcagaagatatctttcacggacacgacaaacaggtagttgaaggccaaaatgatttcactgggaaaaatattgagaatgaaagccagaaattaatgggggaagggaatcataagttaccgttgtctgccgaagctgacattatagaacctggtaaggatattcaagatcaagccgaggatttgtttacgcagagcagcggagacttgggagaagttttgccatgggaatctactgataaaaacgctgatgtaacgagcaaatcccaagagaaacatgaagatttatttgctgcttctggaaacgatgagaaacttccttgggaagtttctgacggtgaagtatcatcgggaaagacggaaaacagcatgcagactagtactgagaaaatagctgagcaaaagttttcgtttttggaaaacgacgacgaccttttggacgacgacgacagctttttggcttcttctgaggaagaagacacagtacctaataccgataatacaacgaatttaacctcaaaaccagttgaagaaaaaaaggcttcaagatataaacctattatcgaggaggaagcaggaatgcgtcaagagcaagttcattttaccaatactactggcattgtaacaccgcagcagttccacggtttgactaaaactggactaggcacccccaaccaacaagtcagtgtaccaaatatagttagtcctaagcctcctgtggtaaaagacaatcgttcaaattttaagataaatgaggagaaaaagaagtctgatgcttacgattttccactggaaattatttcagaaagttccaagaagggtcacgcaaagccggttgccgttcctactcaaaggtttggctcagggaattcttttagttctttggacaaaccaattccacagagcaggaaaggctctaataactcaaataggccacccgtgatcccattggggacgcaggagcctcgatcttcgagaactaactcagcgatctcgcaatctcccgttaattatgctttccctaacccatacaaaattcaacaactacaacaggctcctatccaatcaggtatgcctttaccaaataccaacatacctcccccagcattaaaagtggaaaccaccgtttctgctcctccaattcgggcaagaggggtcagcaatgcctccgtgggaagttcagcgtcttttggtgctagacatgcaacacagtacggcctcaataacggggtacctccggtttcgccatatggtcaagctaccataaatttgccaactgcgaataagtatgcccccgtctctcctacagttcagcagaagcaatatccatcagttgtgcaaaaccttggcgcttcggccgtaaatacccccaattttgtaaagacccatagaggccatacaagctctattagttcgtatacaccaaaccagaatgaacacgcctctagatacgcacccaactatcaacaatcttatcaggtgccatatacctcacaacctgttggtcctgtagctgggaattcaagctatcaaagccaaacccgaagttcttatgcagttcctatgatgccccaggctcaaacttcagcaagtattcagcctcacgcgaacattcaaccgcctactggcattttacctttagcccccttacgacctctagaccccttacaagccgctacgaacttgcaaccccgtgcaagcaacataacggctgcaaattcactacctcttgcaaatttgccacttgctgaaaacatactgccagaaattatcacgcatcgagctacaagtagtgttgcaccaccacgacaggaaaataatccaattaaaatagacaacgaggctttattacgccgtcaatttccgatttttcattggagtgctgcaaacaaggtcgtgtacgcagtcccccctatccctgaccaatcgcagtacatgatttcatcaagcattgtacaggaaataaaagtgacaccaattgaccagataattaaaccgaacgatatgctcaaaagcttcccaggtcctttgggtagtgccaaattaaaaaaaaaggatttaaccaaatggatggaaaccactattaaatccatatctgaaaatgaatcatccactgatatgactatatggcaactattggaaatgaaactaaacgataaagttaactggaaaaatatttcaaaactactatacaattctgacgaacttttaatgtacctatctcagccctttccaaacggtgacatgattccaaatgcatatagactggatataaattgtcagatgagagtcctggcgttcttacaaacgggaaatcacgatgaggcacttcgcttagctttaagcaagagggattatgccattgcactattggttggcagtttaatgggtaaagacagatggtctgaagtcattcagaaatatttatatgaagggtttactgcggggccaaacgaccaaaaagaattggcacactttctgctccttatctttcaagtatttgttggtaactccaaaatggccataaaaagtttctacactaataatgagaccagtcaatgggcatccgaaaactggaagagtatcgttgcagctgttctgattaatatcccagaaaataatgaagatccactacttataccacctgttgtccttgaatttttgatagagttcggtatattcctcaccaaaaagggcttgacagccgcagctagtacattatttattattggtaacgtaccactttctaatgagccagtaatggcagattcagacgttatatttgaaagtattggaaacatgaatacttttgaaagcattctatgggatgaaatctacgagtatatattctcgtatgaccctaaattcaaaggattttcatctattttgccccagaagatataccatgcatctcttttacaagaacaaggtttgaacagcctggggacaaagtatactgattacctcagttcctcagttcgaaaactgcctaagaaagatattttaacaataaacctcactcgtgaattgagtgaggtggctagtaggctttccgagtctaatacaggatggcttgcaaaaccaaaactaagcagcgtatggggtcaattagataaatccttcaataaatatattggtggcgatgatattgatgcattgaataaaaaaaatgataaaaagaaagtttttgatgggttcacaccgggatcttctgccaattcgtcaactgtggatctcacccaaacattcacacctttccaagctcaagttacttcgcaaagctatgtggatactacagctcttttgcataatgcccataatgtaccaagccatagtgtgctgcattcaaagccttccaatgtgtcaaaggggttagttgaagcaaacttaccgtatacgcataggatcggtgatagtttgcagggatctcctcagcgcattcataatacacagttcgctgctgctgagcctcaaatggcttctttgagaagagttagaacagaccagcatacaaacgaaaaggctttgaagagtcagcagattttagagaaaaagtctacggcctacactccacaatttggacagaaccatagcgttccaatggaaaagtctaattcgaatgtgccatctttatttgccgacttccctgctccacccaaacttggaacagtgccgtctaattatgtgtctagtcctgacttagtaagaagggagtctatcatatctaccggatcagaatttcttcctcctcccaaaattggggtacctactaaagctaattcctcgcagggatcgcttatgtactcaccaagtgtggaagctttgcctatcgaccctgtcgtcccgcaagttcatgagacgggatacaatgattttggtaacaaacattctcaaaaaagtatgcctgaagatgaatctcacacatcacatgataatagcaatgctgatcaaaatacattaaaagactctgcagatgttacagatgaaacaatggatattgaaggacctggcttcaacgatgtgaagaatcttcttcctatggagcccaaccaccagcctacgtctacagtaaatcctatacaaactattagtgacgatatccaaccgattcttcaaactaacgtggaggtccggggtactgatgcatcgaaaatggaaaattcacttccctccattgaaaatgaaagaagtagcgaggagcagccagaaaacatttcaaaatcagcatcatcagcatatttaccatcaactggtggattgtcactcgaaaacagaccgctaactcaggatgaaaacagtatctcagagacagttcaatccacatacttgccagcaggaagtatttcaatggaagctaaaccaatttctcaagtgcaagatgttccaagaaatgttaataataaagcatccaaacttgtggagcaacatatggcaccaccaaagccaaaaagtactgacgcaaccaaaatgaactactcaccatacgtgcctcaatcaactgccgctagtgcagatggcgatgaatcaacgattctgaaaacatcgcctgctatatatgcaagaactcaccaagcacatgcatccaatccatcacaatactttcctttggtcaaccaagcaaatgaaactgcttcattcgaattatctgaatcaacatcccaggcacaaagtaatggaaatgttgcttcagaaaatagattcagcccaataaagaaagccgaagtcgtcgagaaagacacttttcaacctactattaggaaggcttcaactaaccaatacagggcttttaaaccgttggaatcagatgcggataaatacaatgacgttattgaagatgaatccgatgacgacaatatgtctactgatgaggcaaagaacagaaaggaagaaaaaaagaatgtgaatatgaaaaaggaaacaaaaccaagtaacaaggacatagatgacaagtctaatggttggtttggttggttgaagaaagatactggcgacaaaaaagtgtataaggccaagctaggtcataaaaacacactatactatgatgaaaaattgaaacgttgggtgaataaggacgcaaccgaagaggaaaaacaaaaaattattgaaagttcggcaccaccacctcctccaatcgtgaaacgtaaagatggcggcccaaagacaaagccacgttcaggccccatcaataattccctacctccagtacatgccacatcagttattccgaacaatccaatcactggtgagcctttgccgatcaaaacatccccttctcctacaggacccaatccaaacaattctccatcaccatcctctcccatatcaaggatttctggcgtaaacttgactagcaaaaaggcaaacggtttggatgatttattgagtttggcaggaggacccaaaccagcaagtacgagaaggaagaagaaaacagcgagaggctatgttaatgtaatggataacatacaataattatagtaatacgtttttctttcatggtacccttatgccttcccttttcttgatgtatattatatacttataaaaaccgtagtaaattttattaaaacaatgattacaggaatccgtatttaggttatgcatcgttgtcagtaagaaatcagatgaatgcgatctgaaactttgcttatactaatattattctatcatacctcattttcttgcttcgattaatgcaggacgccggttccgggttaggatcaccgagaaacagaaagcaagcaaggcttcagttacaattcgaagaagtactaagggggttgtcgtggaaaaatcttgaatcagaaagcggctgactggagcattactaggttcattactcactggttctactcatgaaaccttacttatttgacctaaagctaaaagacacagagaagctggattggaaaaaaggcctctcctcatatctcaagaaatcatacggctcctcacaatggagaacattttatgatgagaaagctacttcagaactggatcacttaaggaataatgcaaatggagaactagcaccttcttcattgtcggaacaaaatctaaaatattactcatttttggagcatctttattttcgcctgggtagcaaaggatcaagattaaaaatggatttcacttggtatgacgcagaatactcatcggcccagaaaggattgaaatacacgcaacatacgttagcatttgaaaagtcttgtactttgttcaacattgctgtaatctttacccaaattgcgagggagaatatcaatgaggactacaaaaactcaatcgcaaatttgacaaaagctttttcctgttttgaatatctatcagaaaattttttgaactcaccttcagtcgatcttcagtcagaaaacactaggtttctggctaatatttgccatgcagaagctcaagaattgtttgtcttgaaattattaaatgatcaaatatcatccaagcaatatacattaatcagtaaactttctagagccacgtgtaacctctttcagaaatgtcacgattttatgaaagaaatagatgacgatgtggccatttatggtgaacccaaatggaaaacgacagttacttgcaaactgcatttctacaaatcgttaagcgcttattatcacggtttacaccttgaagaagaaaatagagttggcgaagcaattgcttttctcgatttttctatgcaacaattgatttcatcccttccattcaaaacgtggttagtggaatttatagactttgatgggtttaaagaaactttagaaaagaaacaaaaggagttgattaaagataacgattttatatatcatgaaagcgttccagccgttgtgcaggttgattccattaaggcgctcgatgcaataaaatctccaacatgggagaagatattagaaccatatatgcaagatgttgcaaataaatgtgactctttgtacagaggaattattcccctagatgtctatgaaaaggaaagtatttactcagaagaaaaagcgacgctgttgagaaagcaagttgaagaaactgagacagcaaatttggaatattcttccttcatcgaatttacaaatctacccaggctcttgagtgatttggaaaaacaatttagtgacggaaatattttctcgaatacggatacacagggacaattgatgagggaccaaattcagacatggtgtaaatttatccaaacaaatgaatttagggatatagaagaacagatgaacaaaattgttttcaaaaggaaacaaattttagaaatcctttctgccttacccaatgatcaaaaagaaaatgttacaaaactaaaatcttctttagtagctgcttcaaactcagacgaaaaattgttcgcatgcgtaaaaccacatattgtcgagatcaatctattgaatgacaatggaaaaatatggaagaagtttgacgaatttaatcgcaatacgcctccacaacctagcctattggatatcgatgataccaaaaacgacaagatattagagttgttaaaacaagtaaagggccatgcggaagacttaagaacattgaaagaggaacgttcgagaaatttgtctgaactaagagacgaaatcaacaacgatgatatcacaaaattattaattattaataaggggaaatccgatgttgagctcaaagatttattcgaggtggaactggagaaattcgagcctttgagcacaagaatagaggcgacaatttacaaacaatcttcaatgatagatgacatcaaagccaagctagatgaaatttttcacctttcaaatttcaaggataaatcttctggggaagaaaaatttttagaagatcgtaagaatttttttgataagctgcaagaagcagtgaaatcattcagtatttttgcatccgacttgccaaaaggaatagagttctatgattcattattcaatatgagtagagacttagcagaaagagtgagagttgcaaagcagaccgaggattcaacagctaattctcccgctcctcccctccctccacttgattctaaagcgtctgtcgttgggggtcctccattactgccccaaaaaagtgcagcctttcagtcattatctagacaagggctcaatttaggggaccaatttcaaaatctcaaaataagtgccggcagtgatttacctcaaggacccggtattccaccaagaacttatgaagcttcgccatatgctgcaacgcctactatggcagccccaccagtaccaccgaaacaatcgcaagaggatatgtacgacttgagaagacgtaaagcagttgaaaacgaagaacgtgaactgcaagagaatcctacgtccttttacaatagaccctctgtttttgatgaaaatatgtactccaaatacagcagttaggtgcatttcttatttcttaattttattgtagcttttttttttcaactaatatgataattatatatataccggatttgttgaaagccagttttgcaaggataaagaaactgcgatttagcaaaagtccctttaatgcttcttccatctttgatctactttcttttgagtattaggtgtataccatacactttcagatccaaaatcagcctcggacatttttacaaacgaaataaggccattatccataatagcgataataaagctccgatatcccgtcttcaatctacgattttgctgtatgtgaggtgggtacgcctttctcttctttttcgtgctagactgtgcagtttttttttgaaaacttgctttcatagacgactcacttttttcagtttgagatttcgcgctcctcttatgaatatattcctttcgtgggatatcttcaacgtaggagtttgtctcccaatcgtcatcatcctcgatttcgcttaaaaattcgaatttataatcaagtgaggaaaacatagatcgcagctctttataggtaggaaaatgctgaagatcgtcatttttattgtaaacgaaaacttggaaatcaggaagaccggggtctcttttcttgaaattagaatggggtttccatactttaaatgtcaagggaatatcctttaccttttgaaattccctatcagattgtgcatccaatagctcttttttattctttggtacagccacggaacgaacaagcctatttaaaccctggtataactgtggtgaagtcgtatatttacgaaaaaaaaaattccacttagaatagaagaaaccactaaacagcgataactcttgtattttaaacaatgaaagtaatctccaagtgattgcttgtaaattacttcgttgctttttcaatgggaaaaaggaagtcttgactgctgcttcttgattgctgggttttagaataaaacccaacctttttaaatgagcaaacacaaaatattggtccatttcctgttgcgatgaaaacagcgaatacaaatcctccatactgagtaaaatctctgtttcgtgctttgagcttttgttagagcctgcttctaatctataataaggaagaatagtgcctctctctgccaaataaacaaactcatggaagtcaagccagagttcgcctgtgctatcagcccttcccatcgtttgcataaagctgcctttgggtttaagtagaacggcttgatgtttatggggaacatagtatcctcttacttcagattttactgttgtgcctcttattgagtctgatatggtatcaaacatggctttacttgcattatagagaagcagatcttgcaaattagtcccatctggttcatagtctttttcacccctctttggaagtgaaagagcagcatttttgctaacgagcgatgcgagttgcgaccaatcttgttgtagttcttcttcttcttcttcttcttcttcaaagcccggattagatgtggtcacttgatcagttttcttcccagcgaattgcatttaaattggcagaagaacagaggttttatgtatgtttatatccaaacgtttcgatagctcaaatgaataatttttcatactgagatgaagctctgcagagttcgactaaactgtttctagtttccctttggcgcaacttaactatgaaaaataataaaataaaaaaaaagtccaagccataatcaatagacagctaataacctgaattttaacaagagaatatgaaaacattatcaatactgatttgaatatacccgtaaattctataagactccattaatataccgtattatattacaagttgataatacataaatgcgttaaataaaacaaaaatgaccttgtatacgcgtcattccaatgcaagaatttgtttatcgtaaagttttgatgaaggtgtctaaattatactcctcctcgtattgagatgggtcccatagctctttcaattcaccgagggcctctttggctttgccagttaaaccagtctcgttggcaatatcttccatgcccttggctgcttgggaatcgccattattcttttcctcattgtcctgtgaggtaacgttatcggggtcgaagagatcaagcagctgatgtgtatccatggatgctaatccactgttttgctgattaacaactgtagaagctatattcattttgaatttctgcaaacccatgattttttcttcaagcgtacctttcgtaataattctgtaaacattaacaacctttttctgaccaattctatgtgctctgtccattgcctgtagatcattcattggattccagtcatgctctacaaaaatgacggtgtctgcaccagttaaattcagacccagccctccgaccttggtggtcaacagtaggcaatcaatagagggatcttcgttaaatttccgaacaactttttgtctgtctcttgggtcaatgcttccatctagcctcatataggttacggagggcatatactttttaaacaagtcattttcaaccatgtctagcatatcttttagttggcagaaaatcagggctctgtgttgtgatatgacattttgaataggaaaattctgatcttggcttgcttttttgtcgatatcttcttcacctataccacattcaaagagtaatgttctcaatgcgctcagttttggagcgttgataatatcgtgtaaatctagaccagtttgctttaaatagtcttgtacttgcgctaattgcgggtgatttggtgaaaggaccaaagctggatgattacacaattttctcatgtattgtaaagcttggaaaatatgttgcttgccatcagcaatctcagaattttcaatatctttctcaactacatttttttgttttttagtaaaatccatgtatagttgtttttgtaaatcacctaattcacagtagtaatcctgaataattttaggtggtaaatcagatagaacgtcttccttcaatcttctcagcatgaaaggtagaacttgcttatgtagtgcctccaaagccagtacacctgcttcctgctccttagatgatgttttactatttcttgacgcagcgattggctttgcgaacctttcctggaacatcttttccgttcccaaaaatcccggcattaagaagtcaaacagagaccacaattctaaaacgttgttttggatgggagttccggttaaaattaatctatggtttgcagtaatttctttaacagccttagcaagttttgattgagagtttttaattatatgtccttcatccaaaacacaataattatattcagttttgtttaggactgcgagatcatttctagctacgtcatatgatgttacaataatatcagcatcacttaactgtggtctcagagttaatctgacagttgggccaccggcatacacaacaacctttaaaaagggagcatactggtcaaactcgttttcccaatggccagttaaagatggggggcatattatgagagatggtaaggctctactttcaacagaacgcgttttttcataatcttccttcctcaaatattgatcgcttgcgataatgcagatggtttgtaatgttttacccaaacccatatcgtcacacaatattccatgtagatgatatttgttcaggaatgccaaccagttaacaccatcttgctgatattttcttaaagtcgccttgatggcaatgggtaatttaaatggcttagctttagaaggatccatcatttgttggataaaatcacgctccctctctctgcttgccactagttcttctgggagtccttttggatcggcgataccagcttctaaaggaactaatttgatgatagaagcaaatgttgttgtagctaaattcctcacatcttcgttcgaatcactcatgcgacccaaaagtggaactattaagaaaatgacgtaaggtagaacatcggtttccatagaaagtgataaatgataaataagctccgtggacccttgacgatcggatagagaaccagcgctattcattaaaggcaaaatctcacgtatggtgtaagccattacctccacggaggaaattttagccagatcagcaaaagttcttgcagctgaataacgaaaaacagataagtttgatcttaagaacgttaataaaacagggaaacgggtaaaaacctcactagaacgtagcgaatcagacataaatgggaatagagctcttagtacaccaaatgagtcgactattttttgaccttgctcgttgtcaactttacttgcttcctcattttcatgatcagataatgaatcaaataaaatcgatctaagctgaggtagtttctgtaatatagaaggcccaagaacttcaaatagtatttttaacgtaatcaacccacccttcctttttagttgagcctcttccgacatctttgcgagattaatgtcatcttgtgcggcaatcgaattagattcttttattaacgtcaatattttttctttatattctgcatttacggagaaatcaggaacttctgaagtatcaacgcataaaaatccgcagagatttttgactatcttaccagacacattaactttattattttctaacagttgctgaatcaaatgtacgaccgattctccggccatcgtttgtaacttttcattcctttcttctttaacactgtccattagcgacctgataatggggtttaatttaagaggtagaccatcaaataacaagatggatgatgcgtaattagcgagaatgctgcctgtacgaagttttgcggattctttggctgaattgattgccatcaacacgcgatgcttagaatcttctaatggcttcttggccaatagtttgtaagagttgttcatggatttgaacattttatcatagtattcgccgtacactttttctgctgtttcaacaccaaacgcatgtggaccggcttctgtttcgccttgaaccacaattgctacgttgggtagtttgtactgaggtaacatacctacatccacaaaggtagccagtaggctttgacattgagtcctcagagcttttaagctaggtactagctccctaaatacaggaaattcatcgcgattcagtaactgtttattcatcacaggactgaaaatctctgatacaaaagaaggtaatttttccccttctggatgcttttgtaaccacgaggagcaaaactgtgaaacaataatgcctgccaacatacgtggagttgagaatggcagctctaaacaacgaaccagaacgtttgtgaagaaggattgaagcgtggaatcttgaaacattgacaatgtcaaagcaaatgcctttgctcccattattctagtgttcaatattacgtccaatcctagcaaagtaatatctccagcaatcataggtgcatcgatattgatatgttcattattttttggtattggaatgtcagaatctgttgtggtttcagatatagaacgttttttttctggatgtaattgatagtgctgggaaggctttagaatatattgtgattccatggcataattctttcccttttcccctactggcgtatttagaagatgtagtattggctgcaaatgtttactgaaaacatgatctaaagttttttcggtatgcttaactttataatgctccaataacgcaacataaacatcaaaagacagttgcaatagttccgggttttgctccagtaaaatattctgaaaaactagacggaataccttgccgtttaaccagtttttagtagaatcatcctttattgataagaatgcaatcagtagattcaaaacagccctcctcacagaagaaatcgaatggcgtaaaaagggatacaatttcggtaccagtgacttgaatgaccactctgaaggatgctctaaagccttgttctttaaaatatctagtacttcttggtggtcgcacaactttgccaatagatccattatagaacctacgcttgaagatatatcatcatctaaacgagctagtaatgaccatatcgtggtcaccaaaatttctatggtagagttgtttaatttgacaaattcgctggttattggggttaaaattgaggctgctacgctttgaacgtcatcatcactttggtttaaaccatatagcactatacggacaacgttttctaaaaggccatgggcaaataggaaatttgtctttatgctgacgaagtaacgaatccctaaaagccctccatgggtagcttcccatattttgttcggtagacctgtttgtagtggatcttgtagaaccagttgttctaaacaattaaatattttaattgataaggtactgtctaggtgaattaataacgcagctagagtttgcgcaactgactctcgtacaggggccacaactgtatcataaacataatcaccaaatctatccaatgcaaatactgtaagtagacgggacgccaagtcttctaagcttctagaattcctcaggttgttctcctctcgggtattccccttaaccctgctgactccataagcatgtttttttaccaattctcgaagacccaacgcagctccatgccttatttcccaattttcgctcattagattatctaaaagtagttcataaatgccttggaattgccaaactaggccagcaacaatttcgtgttgttctagcaatggccttactgtggattctatcattagtttactttcatcggcttgttcagtaatctccagtttgggatttagctggttactggtgggagaagtggctagcgatgcagcagaattggtcatattttttccatttaataaagtcttggaaactgaactttccgttatatctacaggatgtttgggagtattcttagcactcattttcttttttcgccttgccatagcaagcatccttgctgacttcttgttagcattacttttattttcattcgccttatcagacgcatttagcatagatgtttcctgttttatatcatcagttttagcttgttttcttatattatcgtcagccttaccaagaacattgtaatcattcatactcgacgccaggagcactttacctgactttaaaatttcgttcaatttccaatcagacagagaactgaggtgatggtcctcctgtaagagattcaactgattgttctgagtagcctcttccaattttattttcatttcatgttccaacttcacctgagcattatccaatggagaaccttcatttgtaccacctaccaagtcagattcattcggatcccaagaaggagcatgggcaactatgccacccacagctcttgctgcagtaacacgcgtttcccatttcttcactagtaaaaaggggtaaactctggacagcaacgaaagaatgtcttcggggtgctgtttggccaagtctcccatttgatcggcagccatgttccggactacttgggtggaaccggtctctattaatattacctgccggtccagcctcgaaactcgtgacgtcatttgaggtgctgtgtgtgttgtgatacttttgttcgttaatattggaatacgatcgctacttatattttatgttctgaaggactctaaaagcaaatcaaaataaccgccgagctgtgtgttcagagctataatagcagaatggtggtttttttctgagcgcaatagaaaatggcgcgcaaaccgccaagggaacggaattggtggaaatcataagcttttatatcaagtgcagcggccggcgagtgggacgtgctttttttacttttgggtttttgcgatgaggcggtagacgcgttgtctttgcgcctggggcccgccgtccaacgtgcgggtaccgtaccctgcagtgttgcaatcgtgtacttgccttatagtgtcagctattgatcaaggccacatgcaaaatagggaaggggggcattggcacaaaagagtggttagacgctcacaggggtgactacggttacaagtctaaatattttaagcccatcattaccggcaatgccctctgtacaggagttataagaaagattattcaatttcgcgcttgcattatgaaagaggttgcattcttcaatatcaggtgaaatgtgtcttgcctagacaatctaaaaaaggctgcacacccatgcatcattctaaaaaaattattttttttcttttcatttacttttcgtttttttttttttttttttcagttcgatttcttggtcggacgcgatggcaaatttttcatcgagagattatcgttataaaggcctgttgattttcaaagagatagaaatcttctcttttaagtattctttttttaattaataaaaacacaagaaaactaatacagcaacagaaatacaaaagtatacaacatgccaagtacgtcgttaatcttctccttttaaggggttgagaatatttttattaaaaaatcatacttgctatgattttgaggatcgggtcctcataaatattttgaagagcctttgttgaatttttttcttttcgttttgttcaataatggacggttcttcatagaatactttttttttcggagaaaacctttacactgaactcccgacacttcaggtaaagcgttccgaagtaattcaacattagaagaggaacatttccccagttctgattatgtctgttgaagataactcaagtattctaggcttaatacagaaatgtgttaggtttgagaactccatcatggattatgcatattcgtcagtgacgtgcacaattcttttgaagataggaagaacaaaacttcaataattgctttaataatatttatgtagtgatcttgatcctcgcattcgtttgaaaaagagagcgctcactaacaatggttgtaattatcttgtaaaacaggagccccaagaacatattccaagacttactctaccccaaagagaccttacgaatcttctcgtttggacgcagaattgaagttggccggtgaattcggtttgaagaacaagaaggaaatttacagaatttccttccagttatctaagattcgtcgtgctgcaagagacttgttgacaagagacgaaaaggacccaaagagattgttcgaaggtaatgctttgattaggagactagttagagtcggtgttttatccgaagataagaagaagttagattatgttttagccttgaaggtcgaagatttcttggaaagaagattgcaaactcaagtctacaagctaggtttagccaagtctgtccaccatgcaagagttttaatcactcaaaggcacattgctgttggtaagcaaattgtcaacatcccctctttcatggtcagattggactctgagaagcacattgactttgctccaacatctccattcggtggtgctagaccaggcagagttgctagaagaaatgctgcaaggaaggcggaagcttctggtgaagctgctgatgaagctgatgaggccgatgaagaataattgtgctgatttttatttcttaattacgtgttgaaatcacgatactggcatccgataggggagttgtattcacaatactatcgattttgtaaaataggacgaagaactttttatatacgagcatttcctaattagtaggaagcggaaaataataatataagaaagtaaacgcaaaagataggctgactgccttcattcgactaggaggtgaggcgacatatttgtcaccattcaagttaccgagatggtagagaggtggatggctcgggtgagcttgattgtacactgcagcaacgatgctttttctacccattttatgaagtttaacatccgtacctttccacctccaaacattttttgtaacttcgtcctttgaaaaatcaagaagtaataggtgtgcagtatagggccgcttgagcgcgcaatatcggtgagtgaggtaagatccatccataccttagcaaatatggtagtgaggaggccaactgtattgcgttaaaggcaaaaggattggtatatacgaatgattggtaatttgaaaagtaggtttcgaatcaaagaaactgagacagtcaaggacactaaacaaaaatgggtaaatcgtatgtccatataacttcaaaatgaaaatatagcagttgaaacatatcaattaaatcattatacatctccaataaacatgtatgcaagaggaaagcgtaaatatcttcgatttcgacaatactttgctactgaactaaaaatgaaaatgaagttgaattctcaaaggaatgtgatgcaagttcgttaattaatatggtttttagtggaattatcatagtttgtgatagatacacacgaggagtagtgagcaaagcaagtgcaacagcaatgatatgttagcaggaaataatattataaattggatattgtgtgtttttttgatatatgtttgtcgaagctaatacagaatgattactaactggaatttaaaagcacaatcatgctcttggatgattgatctattaaaaaattataaaacagacatggttacagatctcgtacacgttacatgttccaacgtgacttcagaaagcatggtgccgttcacatgtccacctacttgaagatctacaaggttggtgacattgtcgacatcaaagccaatggttctatccaaaagggtatgccacacaagttctaccaaggtaagaccggtgtcgtctacaacgttaccaagtcttctgttggtgttatcatcaacaagatggtcggtaacagatacttggaaaagagattgaacttgagagttgaacacatcaagcactctaaatgtagacaagaatttttggaaagagttaaggccaatgctgctaagcgtgctgaagccaaggcccaaggtgttgctgtccaattgaagagacaaccagctcaaccaagagaatcccgtattgtctctactgaaggtaacgttcctcaaactttagctccagttccatacgaaaccttcatttaatctacctcgtttggtatatttatcgaagttatcacattcctatatattgtatcctttacataagaattgcgtatagatagatactataacaatttacatgatattatttgattaaggtgcatattaccatcttctcagcaggtattcaaacatatctgccaatgtatgaccttgacatatgtgaagagattactgtggagaagaatagatgtagcattgtgcgcacttattaaatctactacttaaaaaaatgtgtgaagtataaagtgaatctaagaatatttgtagtatttaaaacatcaatgtctgtacaagaagagatatataacctgagcatcctttttcagatagtgcacttcatcgttatcaaactgaactcataaggcgccatttttttaattttttgcctttccgtattgtttttcttttcctttccttttctttcattcttgtcgcagttactgttgtgattacttcaatttagaaagcaattgttcaatttcagatatagactgttgcaaaactttctcttggaattttggattacccaattctgactgaactctggagatgacagattttgctagttgcctttgttccaattgacgcaaggaagcttcatatctaacccacgaatctaagactgcctttgcttcgtgagctaattctaccttttgtttcaattcaaaggcttcgctttcaagttcaacagtttccttggaaacatcaaacaaaacctttgtagtttcagcaacattttgtagttgagagacagagtcgattctatctttaacagcttcgacatgcttgtttctcgaggcatttaaaacgtcggagactttcttcattcttgcatcggcaaaatctttatatgctggcgccaaatactttgccactaaaccagtgaaacccaaaaaagtcagcaataaaatactttcatcgttgataacgtacaattcattggaaatggcataaatgacagcggcagcagaagtccccaaaacccccgtctttgtcaaaatattattacctggaatggcattgatgatagagttagcctttgcttttggatctgtctgtttttctggagtggaagacatataacgggctccaatcaccatcgaaggacaacgaacaccttggctaaataatgttttagaaacggaccttaacgctaggccacggacacccatactcatgctcattttatctcttgcgcacttaggaggtactgaattctcgtcagtcttttaataaaatataacccttcctagcacagtataaacttgtcaacataaactgctaactgcaattataatcccttgctattttaattacccaaacctgtggtgaaggtccgaatgagcggtgaagagaaaaagcgtcgtgattggttcaatattgatgtcgattacccggccaatgaggctcgctcgatgggacacctctatgataatagttgtcgccacagccattctgaattatatttatcttttatctacgtatgtgccattgtcacagcacatttctaattctgtgtgaggaactaatttagccatggacagtttctcatgcgtggaagacctgttatgctgtatagtactgcgccgcgttaaaaaatattcatgcttgtagagtagaatattcctatctttaccggaccgtatttcatctgggagttgcagttgcgtcacaacacagtttatggctattttattttgaaaattaagcatatatgacataattagagcactcctatgtgggaattcttacacttttaatgtagaatctcttggtgattgttactatcagttgtgttttggccctactattgtaattcccttatagtgttcaccagctcttgaatgtactttccttcttcaggatcaacggttggtccatttggatttctaattgcgctgctactatgcatgttgttgcttgtagcttcatctccgacggattttcctgttggtgatggcgttctagtcatcatggcagcagcggttgcgaccgccacttcacgacgttgttcctcttctattttagcattgcggtccctcaagacttgaagtagtttactatgtgcttgccttaattgcatcagtttgttctcgaaccctggaggaaactgatcatacaattctgttgcctgcgcctgtcttttaacgtcatctagggcatctatttctctccacaaatagtcttgtctgtcgattataggccgtacttccagtctgttatgtgtctgtagcggtatatctacgctatttctccggaatttggcaactccgttatagctaacactatcggtatctattgtgtcattaccaactgtgttagcacttgaacggttataatagttattgaatagactccttgtcgaaggaatttgggaagaataagatggcctaaatcctgaatttctaatatagggatttacatttggtattgtcctgggaaggtcatggatgctgtcctccccataccgttcatcgtcttcattcgtgatttgccttcgtactgagctttttttctggagatctttcatgaagatagtgaattgtaaatttttggttaggtttttcaaaaacaatgtcaattacatgtcagcgaaggccaggtagtaggtgtccgtggctattgattatcttgatatccgaacttgagaccacttcgcggctactaaatttatgaactaaaaatgaaaatttcaactttccattacctcttcgctttaaaccaatttaaaggtacaatcacactttaagtattgttgttagacggtggtgaatataatcagaggcatccaaactttctgttgcaggtccattatcctctcaattttcgtatgaccttaaagagacttcatagtttatatttggttattttcaataggtacaatgacaagatctccctggaagcgcctactatggttgaaacaggagtacccagataattatacagatccaagttttattgagttgagagcaagacaaaaggctgagagtaaccagaagtctgatagaaaattatcagaagctgctcgcgctcaaattaggttggattttataagtttctaccaaaccatattgaacacttctttcatttacatcacttttacatatatttactattatggcttcgatcctattccgccaactattttcctttcatttataacattgattatatcaaggacgaaagtcgaccctctattgtcctcattcatggacgtaaagtcttcgctgattatcacatttgcaatgttgactctctctccagtcctcaaatctctttctaaaacaactgcatctgattccatatggacattgtctttttggctgaccctatggtacattttcgttatttcgtcaacaaagtccaaagataaaccctctaacctttccaccaatatacttgtcgcccttgttgctgtcctatcatcgaggctttcgaccacaatcgacgtattctgttttcttttaatttgtattcagttgaatatcattctacccacttatttatcggtgacgaataaggtagtaccaataatttcaaatattattgtatactcatttttgaatgttgctctaggttggatttatatgctgttgattttctttgcttcagtattttatattactgttttacctaagtggttcatctactggaaaatcaattatcataaacgggataacgatctactaagtacatgggatgcaagaacaccaatattggattagcgcaatcaagaacatgatttccttcggataagcaagggaggggtacgacttctgcccgcaggggcttattgcctgtcctcttcctcgaccccacggtatttcattatatatagagtcactgtaataataattatcatgaaacctgacaagcaaaggcgtcgggcaattaccaaagggcagttcggtcgattaagtttgcttcactacagattattcacatatcatacgacaactttaaaattgaacattcaggagatttttgaatgcattgatgggcccttgcaccttaaccgggtcccaatattagagaaacgcccccttaaactgaacacaagacaatactacctggccaatagggtacaatttgcggccgtgttaaacaggcgtttcagcgtctaccgctcctaatttaaagtcacttgtttcttggtagcagcagcttcctgttttcttctttttggcacttggttatgtgataatatcacccggatgagaaacctttaaaataagcgtttgggaggggaaaaagtgcagtaactgtcacaaatttaacaaacaatttgttcacaagttttgccttatcgttcatcacatgttatttttttcaatctagccaaagtatctaaagaagaattttcgtctctcttgtgccttctcataatgttcaattaagatgcagacggctttgacatgtcattaatttactgaatttctgacacttccccacgatatttatcattttttacgtaattaagatttaaactccgtacacccggcttccacaaatgtagaattttccggagcttcgaacttcttgtttcacgaattaaaagcatccaacgtagaaccacccaactcatcttcctaatgctgaagcttcatcggtaaacaaaccacagttaatagcgagaaagtcggcaagtgacaaacgacggttatatttaattggcctttgatatatattgaaaatggtatggtatgatcataacacgcattctgaaaatgttatctgggaggttttcgatgggtatggagttttccttgattctcacttattatcccttgtattgtaattgatccttcagtaatatttgcagcctttcacaactatcctttttttcattgcttattactattgaaccttttttaggagttgcctgcttatgcaatataatttgctgacaagtagtaaattaccagcacaatattaagattaaaaaagaaattagccaagagcttgatatattatcttatacacaaacctttccgacctacttgataaagccacatacctctacctcttctattagaaatagaaaagtacaaaaatagcaaaaggaaataatttctttaaaataacattgtgtgaggttccaactatggattattaatagagtaacgcaaacttaaggaaaggaagtgctttacaattaagtatttataagaacgaatttatcccccaaaaaaaagcacctatacttaataaaaggaggggaatagctatcaattgagtgttgtctgcgtctgtctgcgtacaagaggatgaattttctgactcaggctatgtcagaaacttttcaagggacaaataacaggataaaacgtaatgtcaggacacaaagtgtgccatcaacttcctataataatggcaaagaatcatatggaccaaatactaaccaattaaatgccctactttctcaattggaacagcaaacaagtgttgatagtaccagcacgagctcaaacttttattccattgcacaatatattttacaatcatacttcaaggtcaatgtagattctctaaactctctgaaattggtggatttgatagtggaccaaacttaccctgattctttgacgctgcgaaagctgaatgaaggagcaacgggacaaccatacgattatttcaatacagtttctcgtgatgctgatatctccaagtgtccaatttttgcgttgaccatattttttgttatacgatggagccacccaaaccctccaatttcaattgagaattttactacagtaccgttgctagattcaaactttatttctctaaattccaatcctttactatatattcaaaatcaaaacccaaacagcaattcaagtgttaaagtttcaaggtcacaaacgtttgaaccttctaaagagttgatcgatttggtatttccatggctgtcttatttgaagcaggatatgcttcttattgataggacgaattacaagctttattctctctgtgaactatttgaatttatgggcagggttgccattcaggatctccgatatctgagtcaacatcccttattactacccaatatcgtaacattcatttcaaaatttattcctgagttattccaaaacgaagagtttaaaggaatcggttcaattaaaaattcaaacaataatgccctgaacaatgttacaggaatagaaacccaatttttaaatccatctaccgaggaagtgagtcaaaaagttgattcttactttatggaattatcaaaaaaattaactacagaaaatatcaggttaagtcaagaaataacacaactaaaagcagatatgaactccgtaggcaatgtttgtaaccaaattttgctgttgcagagacaattgctttcaggaaatcaggcgatcggatcaaagtccgaaaatattgtgtcttccacaggtggggggatattaatactagataaaaatagcatcaattcgaacgtactgagtaatttggttcagtcgatagatcctaatcactccaagcccaacggacaagcccaaacacatcaaaggggtccgaaaggacaatcacatgcacaggttcaaagtactaatagccctgcgctagcgccaattaacatgttcccgagcttaagtaattctatacagccgatgcttggcaccttggctccgcaaccgcaagatatagtacagaagaggaagctaccgttaccaggttcaatagcctctgcagcaacaggcagtcctttttctccatcacccgttggtgagtctccctatagcaaacgctttaaactagacgataaaccaactccgtctcagacggctcttgattccttacttacaaaatccatttcaagccctagattacccctttcgacgttggctaacacagctgtcacggaatcttttcgctcacctcagcagtttcagcattctccagattttgtagttggtggtagctcaagttcaacaacggaaaataactctaagaaggtaaatgaagattctccatcatcttcttcaaaactagctgaacgacctcgtcttccaaacaacgactccactactagcatgcctgaaagtcccaccgaggtagctggtgatgatgttgatagggagaaaccgccagagtcaagtaagtcggagcccaatgataacagcccagaatcgaaagatcctgagaaaaatggtaaaaacagtaatccgcttggtacggatgctgacaaaccagtaccaatttctaatattcataattctactgaggctgcaaattcaagtggtacagtgacaaagacagctccatcatttccgcagagttcttctaagtttgaaattataaataaaaaggatacgaaggcggggccaaacgaggcaatcaaatacaagctgtccagagaaaataaaacaatatgggacctatatgcggagtggtatattggtctgaacggtaaatcttcaataaaaaaattgattgaaaattatggctggcgaaggtggaaggttagcgaagattcacatttttttcctactagaagaattattatggattatattgaaacggaatgtgatcgtggcataaaactcggcaggtttactaatcctcaacaaccgagggaggatatacggaagattttagtaggggacctagaaaagttcaggataaataacggtctgactctgaattctctatcattgtactttagaaatttaacgaaaaataacaaggaaatttgtatttttgaaaactttaaaaattggaacgttagatcaatgacagaagaagagaaattaaagtattgcaaaaggcgacataatacaccatcttaagtttattgaggttgtccgcgacaatagttccttcaacaaaataacgaagcgacgataacgagaaatgtcattaggttattactacctttatagaaaatatatatacttatttaatatttatatagatttatgtgtgtacatacctatgcggatgtatgcctatgtgggaattcctaaatgtctttccatcaacgactaaatatatattctcatgactgactatatgggttacgaaaacttaatttttttgtcaaagaccctggcgaattgagaaaacccgctggatagatgggctatccgaaattttgaaagatggaaaaaacattaatctcattagcaaaagaggtaagaccctgggtgaagaaaagtccgaggagggaacacaaaaaagtctaggataatggcacatgaaaagtttagtatacctgagaacttcacattagcgcagtctttgcaattgctttactctgttgtcaaaaatcaatataaaaacctagcagacctaataatcaatagcaaaggtaataaggacacagtaacgtatgggaaaatccacaaaaacttagacactttactggtatacgtcaatgaaggtctacgaaaaattgaaaagacttataccttaaagaaagggttaggaaatcttgtagttgatcatcctgaattgaggagcatcattgaggatttccaaattcttggccaggatataaggatcgcacgtcgtaaagcagaaacgcttatggccgaaggaaacggtagtccctctttgtcatcctcctcttccgttttgggccttgggacaggaaatggtttgcgttttccaaaactttggagaatgggttccaaaagagataaattgaaagaagctgacgaaaaggaggctaaaatcaacaaacaggctgataatatcagacgtgctaggaaattagaagaagagaaaaagttaggagcaaaacttcagtatgagagggacttagaacttcaaagggaaaaattgatcgagttaaaggttaaagaaaaggtcgaatttgaagtggcccaaaagttggaggaggagagagttaagagagaggaagaagaacgcaaacatagagaacaagcggagaaaaaacgtatatcaaccctgaaacatgagaggaaaacaaattacaaatcaagggctagcctcgacaacttctcttccagtagcaaatcttctggaaagattgacaactccctaattaaaagaagatcacttgacgttgtacggacttcaggcgaaagagtacgaacgccagtaagaaaatcaatggaggcagcagaaataggtatggctgcgcagttagcctggtctcagtatcaaaacggggcaaatcattcaaaagtgagtaacaacggatcgcattcaaatgaacttcagatacgttataagccaacaccacctttgaaaaaaaggtatgactacaaaaagccaacagttaatcgaccgattataaaatcacctactcttaacaggcaaaacagcaagtcttcacggaatatacccacaaatagcaagctgaaggctagtaaatccaatactaacaaagtttctcgtaggaatgagcaaaatttggagcctagttcaccagtactcgtttcagcgacagcggtacctgctgaatccaaacccatgcgttctaaaagtggtacacccgataaggaaagctctgctagttcatccctcgattccagaaaggaggatatattaaaatcagtgcagggagtagatcgaaacgcttgtgaacagatacttaatgaaattcttgttacggatgaaaaagtttattgggaggatatcgcaggcttacggaatgcgaagaattctttgaaagaagcagtggtttacccatttctgcggcctgacttattcaaagggctaagagaacctgttagaggtatgcttttgttcggcccaccaggtacaggtaagacaatgattgctaaggcggttgcgacagagtccaattccacattttttagtgtaagtgcatcttctttgctatcgaaatacctcggtgaatctgagaagctggttagagcattgttttacatggccaaaaaattgtcaccctcaattattttcatagatgagattgactctatgttaacagctcgctctgataatgaaaatgagtcctcgaggagaattaaaacagaacttcttattcagtggtcctccctatctagtgctactgcacaatcggaagaccgaaataatacgcttgacagcagagtacttgtcttaggagcaacgaatttgccatgggcgattgatgatgcagcaagaagacgattttcacggaaactatacattcctttaccagattatgaaactagactatatcatttgaagagattaatggccaagcagaaaaatagcctgcaagatttagactatgaattaataacagaaatgaccgaggggttttctggttctgatcttacgtcattagccaaagaagcggcaatggaacctattagagatttaggagataagttgatgtttgcggattttgataaaatcagaggaattgaaataaaagattttcagaatgctctgttgacaataaaaaagagcgtgtcgtcagaatctctacaaaaatatgaggagtggtctagtaaattcggtagtaatggttcctgaacgagagggagcgtcttaatggcaaagaaaggtatgagaaggaattttcccctttcaacttcttgcttctgatctaattttattacctatgtactttctatgtattatcaaagaaaaactaacttcggttcccttatgatttgatatttttctttcttatttacaattagttttctcagaacgatattcaatacagttctccggatttttgcttactatattggccccaaaaaaatgaaataaaaaaagaaaacaaaataatatacttgggtgaaataaaaaaaataaatcaatagcacccagttaacctagattcaaagtttcttcttcaatctcaatttatatacacgtttgagttaatgggaaagcaaagtccagctataaaacacttgaccgttagcgccataccctccaacaactaattggaccttctccttctgcccaaacagtatatgcaaggtacagcagttactacaagcacaatatgtcttggataaaaaatgtaacagaatctccgacttcactgattaaaaaagtttcatgtggtttgataattgctgcttctctatatgccattgcacccagcctaagtgcgctagtctttggggattctaagcagagtattgggaagtacacgacagtgggcttaattaatcgtgggaatgattgcttcataacatcatctttgcaaggcctggctggaatacctcgatttgtagaatatttgaaacggataagaacggtccttctagaattagaaactaagctgtcaaataatgcaaaaggcgacaatcctacagttgataacactacaaggcatagtcgacttgaaaactcgtctaattcacttgcccccttacacgaaagtcttaccagtttaattttggatttgatatctgtaaaagatcgtaagacgtcaatttctccgaaaatagtgataaacacattagagtccatctttaaatcaaagatctcatccaaacaaaatgatgcacatgaatttacattaatattactacaaacattacaggaagaacgatcaaaattgatcgattacagtaaacagatatgtaatttgaatataccaaagtttccatttgagggcgagacttccaagtttctagtatgccttaaatgcaagggtctatcagaaccatcatacaaacagactttcatccgcgaactgtccgtaccacaacaaacatcagagaatctatccaatattctagcacacgatgaaacagaaatcatagacgactattcatgcctgatctgccaaataagagcaatcttaaaccatgaagaatatagaaatttcaaggactgtaccccggatgaaattttaatgttggacagattgaaaaattatgccactaaagccccaattaacgaaaatttaccattcgaagtagaacagtacgtcaagcgttactcaaagggcaatttgcaggtatctaatataaagggaaaggtcatcaaaaaagatgtagtagtacaactgccagacatattaattgttcacttatcgagatccacattcaatggtattacatattctagaaatccctgcaatgtcaaatttggagaaagaataacactttctgaatatacattggctgagagtgggacaataacagaaaacaggcaagtcaaatataatttgaaaagtgttgtgaaacacaccggttctcattcgagtggacactatatgtgttacagacgcaagactgaaattcgtttcgggaaggaggatgaatcttccttcagaagagcaccagttgtcaacaatgaagttaacaagaatcgcgagcaaaacgttgcacataatgattacaaaaaaagcagatataaaaaagtcaaaaacgccctgcggtatccttattggcaaatatctgataccgccataaaggaatctaccgcttcaactgtcttgaatgaacagaaatatgcttatatgctatactacgaacgtgtaaataaataaccgccctgtacataggtatattataataatagtaagttacgcatccatatccacatcagtatccactgccatcatttcaacatcggtatcagcctctccatcataagtgtatttcgaagtcatttgattatggaaccacttccaccagcttagataagcaatttccttataatctacccattttattatttgtagccttttttctctcaaacgttcccatattttgtcataaaacaagtcattgtcgccgcgtttacttgtggaacacttgatgatctctttcaggaccttatcatcaatagcgtctgtgaatactatattgttatgaataagattgttatcatctgcatgtccgttcttgggccctttatcatttaaggataaattctctaaatctataattagtctttttcttttataattatcaattcctattgggtctggagaatgatttcttttcctaatgtggttgggattgccattacttcttgcaaaccgggaactcatggaatgaaaaagtcatttaaacgtgccactagttttactatctgctaatcgttctagacgtgtaatataaatcatatccgagcgccgttgttgaataatttaatgccttcgtattacatacattttgaaatttgctttcgtaaaagagcggttcccggataaaaaagtgtgcaaataaccgagccttatttgatttccagtaaagacccaaccaaacgcatcattgaagcaaaaatagattaaaacttactgttgttcgtctattgaattttgttcggattggtgtggtgtttaatatcttgggcagaaagagaattggctttatagacactcataaaatcatcattccccttagagcaaaaggtatttttagaagccaagaagaagagcagataaaaaagaagtacgccctctaacaataaaagtcaaatggctagacaattattcactcctccgataaccaatccaaggtttgaccctaatcaatccatcagggaatcatacaagaacacaactggcggcatgcaatttcaacaaaatctacatgaggatcaaaatgacaatgagagaagtagctgtgatggtgatgaaaactctacaacaggagaaaggctagaaaacaataagtctcctatattgacaaaacaagaaattgacgaagcgttgaacactgtcaccaatttacctccagaattatcaaaattaattgacatttttattgatgacctaaagcagccaaagtacgtacggccactatcagtactgcaattgtctagtcttttccaaagcttttacataaaatttgataaagcatcattccagcacgtcagttcagcgaataataatggctattatttttctggcgggggctctagttcattcttggctgccaaagaaacgttaagtagtggtcttagcggaatttttggcagaagtaggagtagtagtggaaattcacttatgaggccaagaagatcttcatcgcttttcagtaatgagtcaatatcaaattcaactaatgccacacaaatgttgtcacctgaagagataaaaaagcaattgaaaatcaacgaattaaacaacatgaaaatcgaaaaatatatggaactttgtgaaagagatgtttttaagaaaattcttatagtaggcacatccgtatcttcaccgaataaaatgaaaaccttcaaaccacaccaattacaaactttcaaggttggaaatctatttagaaacagtgttgaattcacagaatacaataagttgttgaatgaaaaaatcctctgtttgtccaaactctcaacaatgaataaaatcaatttgataaagtttctgagtcttaataatggcattgatccggaaccaaagtttgaagagatcaaagatattttatatgagtttacttatcattcgatttcaccatgtgaaaagataaaggccctactgaaactacatgaaatcatgacatattcccaagaaatgtctaatgatgattatctttcgttgctaatctactacattattacgattgttccacgggatattttcttgaatgccgaattcatcaggctgttcagatataagaaaaagctggtcgaaacagaatcctttgcattaaccaatctagaagctgcattagtttttgttgaaggcttaaccaaaaatgatttttcaaatgagctacaagataaattgactgtaaatgaaagtaaaattttagaaaattcaatcagcagtagagtctcattgccatcaaaaactgctataatgcataaaaacaacggtaataacggcagtaacctaggtgacatcgtgactcctactatccaaaggccagatgttacaagatcgaattcgtatgatggcttcaggaccgtttttgattcatcattaaaaaatatcatcggaaaaattaggtcatatactccaccacatcctaacaatactagcaataataaccttcacagtagcaacaacttaaacataccacgaagttcgtctcaattatccatggaattgagcaatagagatacaacagagatgtctagggatggctcacgatcaacttcatcatcttcacgatcttcagcatctttagagcacggaaatcgcgaatttaccggcgatttgacagtaaccgctagcattaacggtgctgataaaaaggagtttcagaaatcgtggaaaaaatataaaggctataaatttgaagatttgactatttgcgaactaagagatctttttgagatatatcaaaagatgatgcaatgaaacgtatatatgaaatcgtatgtatagatgcgaaagaggaggagagaaggctttatttctgactatcttcctccactaatttgattgatcaatttatttcacaattcggataagtggtctattatatataacaattcgtcatgtaaattggtggcggtgtcggaatgcgaagccaaatcaggtaaatacttattttcattatcattttttatcatattcactaattgattaataaaatttttggtgtaggccaatgaattggtgtcgaattccagtatttgaatcagctttagttttatatctttatcacttgtcctcaacaggagaattcttagaatttcattgtgttgctcagtttgacctttcgttttagtgaagttaagggcgtggacgatgggaaaagataacttcccctctgtaatgtcctcagcaaagcctttttcgctggacatttggaaatctttcaaattcaagtaatcatctctaatctgataaataatacccagaagatttatgaaaggaaccaacgaatggccgtggtgtgaggaaggagacagcgcttccatgagtctcaacgttaatctgaaaaggccgcctgttttattcataaccatattcaaatacatctcctgagtaggtatgatttcaggcagaaagtctctccagtatatatccaagccttgtcccctatgtagattgatcaattcttcgttgaaaatcgtaatcaaattatgatacaaaggctcttttgtggttagctgcgatacaagttgcatggctctgaaatacatataatttgcggtgtttatagtggagggtacaccgaagattaagtgagaagtggtctgtccccttctcaagggagcattatcttctatatcgtcgattaaaaggctggaattatgcaagagctcaacaatttgcgaaactatggccagctggtctttgggcaaattcataactctgttaatttgaactattaaatttagtctaaagttcttgccaggtttcaaaaggatgtgattataaggttttgaaatcaagctttcattttggctggaccaaacaggatcattattgatcagctcatctatcttggcctccattgattttccagactcgtaaacgctttgttctctttctattagtagcttctttgaaaatgagccttacatggttttgtaagcacatctgtcttgactttttttttgcttcaaaaaaacgtcaaagaaggcaaggcgaagcaaagaaaaatggtagtaagcatacaatgatcagcataacatatgcaaaaacacgtaatttctgctatgctggaagcggtgaacgttggataccactataataatagaagtttacctttcagtatgaaaatgcgggcttgtcctatatctatatgtaatattatggagtgagtagagatggcggctatacatcgttgtagagagttatatctgtattgttaattaaagattggccaggcgaaggttggttcctttttgctttaaatctgcttttatggggccataccagagaattatttctttctttcagtattggcttgtcaagctttttgataatgctattaagtgtcagcgaattcgccgtagtttgcaacgctgtgttgtttgtatggcaattgttattatatacttccaaattaatcaaatctaccaggttaatagaatgcaaattcgctatctcatggatgatgtcattgtggtaggcagtgccgctgtgactggggtggctaaatggaggtttcctctcagctagcatttttttcaatttgtctgagtgcgcttgagaggaggcctttaatttggaagtagtgactggtcttgtcttcgagtcactgtttaattgctcgaatgaatataataggtttacgatgttttgtaggagttttagatcattgggcagccttaacatttcgaaatttttcaagccggcgagagtcggcttatgtatatctttataaaataatctttgttgtcttttgatgagattggacaaatttttctgaacttccaatacagagatcttttcgggatcatcatcaggtgaagataggctggcgctattgtggaatttagggcgctgcagaggcttaggtattattatatttgaggtgcccagtgttgtggttgtggctcgaatagctggactaaccatgttttgtgcgactactttacgcttcttagggacaataatggatggtaccgctgccgttgtggttgaaggaggatcggacgtctgatttctccctgaatagtcaaccctttttcttttcctgagttgcatatgcatattatattgtatgtgcttgtgtaggtagaagcgtcttttatttatctactgtctcatcagctcatcgcatcattaataccagtatcggttatagtacataattaacaaatgtatgtagcattttggcatgctgaaaaaaaaaaaaaaaactttatcaggcaagtggctcgaaaccgtgtgaaaggatatcatcaacggtcgtttttacctgttccgcggaatagcgttcccgtgggaagaaaagcagcacgtgagcgtggaaaatccgggcaacactttgtagttccgggtagttgacaaaccaggccacgtgacccgagcttagaagtggacgcagtagcggctgtgcctgcaaaaatgcattcatgcgagcgcgggccgcttcgcgcacggccttatctggggaatgtactggcagggcaaccttggaccagagaacaaggtgtacaacaccaggctcgaagttatacgggaaatcgttggcacgcacagcatatagagtagaagaactaaaagccttcgcggcagcattttcgagctgcggttcgtctagcgaccagcctagtttttgcaaaacgtactggttcatgtccaggccagcagtccttttcttatgctcgtggtatttgtcagtcatctggcgacttcgtttcaaacgggcaagctcccccgattcaattatctctttgatttgttcccacttccacccttgggcctcctcctggtgatcgttgacgatatcttgttgcattgtaaacctaagctgttataagtaaatcaagtgcaatacaaatatatacagcatgctggcgtccttagcctcacgcctactaaacaagagcatcttactctcaccatccatttatatacatatataagtacgtaaaaatagatgtgtataagtcgttctatctataacgcgccccgaagttgtttagtataacaaaaacggaaaaaaaaagaaggaaaatggagattgccaaaagcgcgctagtttgacagaaagagtgaaatattagttcaatatttcagctgtcacggtcatcactgctccgacacttttttgtgggatgctttctgttcaccttggttttctatgggtatataacagctgataaagaatcgaagaagtgaaaatgacgcacccagttatatcactaaagccaagctacaattctgtaatacggggctgccccggtttacctgatacgttaccacgaatcgaatgccagttaagagtgcgctcaaacaactctttgccattcaaattggtaaagatcgaaattgttttaaagacaattgaaatatatttcaacaaaaacctttatagcagcaataacagctctttcaccccatttaatcgtccgtcggacccctctaatggccattctgacaccagtaaccagaacatcagcattcattataagaaaaacatcgtgttatcccaccctacccatgatggcgacgatctcaacaatgatcttattggcatagacatacctttgacgattgggctacctgacgacatcaaagaaacaaactataatccgaaattcggcaaaacgcagactttcctggattgtaccgtgttttatacagaggtcggcggaggaagctcaaataagaaaagaaattttctttacccagtaaacgtcgaaaggtatacatacctaccttcaccgtcatatttcaggccaataaacagatcaaacatcacttctcccgatcaaaagttcttaattagttattccattgagaatccctgtgtttctatgaataatgacacgttgaaactctccatatcaatcaggctgaacccatttccgaacaatgccacaactccctcttcgaatgactttgatgtgtccacgccgacacttttctccacaaagaaaaagtttaagtccaagctcaaattgaaatcaattacaacacagatactagaatacttggaaattctgaagaaccaatcagaattctcatccacgcaaacaacaaatattttgcaaacctctgtaagacaggttgatcaaatcatctccatgaattcaatgatttttcaattcaacctaaaaatattcactaaggacaaaattttacaaagctttagatcttctgagtcgagttgtcccgaaactaaagtattaatcaacaaaatcgacgacattcctctgcaatatcatagttcgataactacgataggtcaacattttaatgtttctcactatctttcaataaggttcaaattcaataaaagtctgaaaaacttcgaaattaatcaccccctaatcatatcgttttggtcagtaagtcaattgccgctaatcgagaacctaatattgcaagaaagacaaactgctaaatttgccaagaagttttataaaaattttggtcgaatcaagaacacgagcaacaacaataacagctcgaactgtctagagtatccctccttgccgccaataatttataattttaacgacccagaaacaaataatagatttaatatattatactcgcaaaaggaccctagtcgtacggatccttctaaattgagaagagtacctgtcatacaatgaggcagtgattggcatggttcatatattaaatcaacgcagatacgtagatctataaagcttttgaataatgctaatgtattatatatttatattcttcttgtcccgcactctggtcttttcaattttctacatgaagagaaaaaaagactatagcgtccggcaaaaaaaaaaaagttatggtttaacaatacaacggccccatgggtttaaaataagggcactttcataaagtcacttatcactcaaaagcacccatgcaaaaacacaatataaaattaaaccaaaaccaggatatttcccaattattccacgatgaagtacccttattcgacaactctataacttcaaaggataaagaagtcattgaaactttatctgaaatatattctatagtaatcacactagaccacgtagagaaagcctacctaaaagactccatagatgacacccaatacactaatactgttgacaaattactaaagcagttcaaggtctacctgaattctcagaataaagaagagataaacaagcatttccaatccatagaagcgttctgcgatacatacaacatcactgcttcgaacgcaataacaagactggagaggggcataccaattacagcagaacatgcgatatccactaccacatcggctccctctggtgataataaacaaagttcttctagcgacaaaaagtttaatgctaaatacgtcgctgaggccactggtaatttcatcactgtaatggatgctttgaaactaaactataatgcaaaagatcaattacatcccttattggctgaactgttaatcagcataaatcgcgtcaccagggatgattttgagaatagatcaaaactcattgactggattgtcagaataaataaactctcaattggtgacactttaactgaaacacaaattagagaacttctgtttgatctagaactagcctataaaagtttttatgctttactggattaagaaataaacaaatagaaattatgataacatatataagtacacaagcgtttctatttcactttagaatattcttgttttttattcgttcttgaaattttgacaacattgccaaagtttcccgctctcttttatccattggttcttccttgatgttttcttgactttccgtttctttagtggttgcctcatcaacattatcatgcaactccgtcttttccctaattagtgcctcttgtggctgatctaaggatgcgtctagtttaattccttcactgcgactatcatctttgatccatgctgggagaatcattctctttcttggcttaagcttttgaacatcaccatcatcatcctcttgctcatcttcataaaccatctttacttttgctgatttcacaagtttctttgccggctcttgttcttttttttcattatcttccagtcttctttttgatccaaagatgtcctcaaagaatggtatggtaatctcaacatccttcaaaactgcaggatacatgaatcgtttgacatcattgtcacgggaggaagcttcaatttcgccgcccaagatctctctaaagatgtaaatagatttcccaacaattttgccaaatacattacaatcgttcagtacgtgcttagaatccgccagcacagttataaaccatgtgttccttcgtctatcccatcccaagagtccatctctattgaagcgtatacgaggatttttttcctcagcaactgtacggtactcaccagtactatttgcattaaacattagccactgtgttggctttaactctttaaattctccattggtgaatgtgccatctgagagcatagataagaacctcttacatgtctcagggcattctttagcccataattcaatggcaatgttcccctttgttgtatacagtatacatttagctgttgtctgaggttctatattactggacatagcattcttactttggtttaaaactcatcatacatgtttcctgtaatacgctttgaataataaattattcaataaattattctcaggacattttgaacctttttttctcttcagacgctttacagcggaaaaggaaaaaaaaaaaattggaagttctttcagtaaagtgagatatattcagcaaacgaacataacgtcaggattaatcggaacggtaatttctagcatccactcaatttcgtgattagcttttggcgcataactgattttttgctttagcacatcacagctagaataaacttccaaaaatcacccgcttgcaatgctgtccattttaagaaattcggtgagactaaattcaagggctcttagggttgtgccatctgccgccaacaccttaacatcggttcaagcatccagaagacttttaacaagttattcaagttttttacaaaaagaaacaaaagacgacaagcctaaatccattcttacagatgatatgctgttcaaggccggtgttgacgtcgatgagaagggccaaggcaaaaacgaggaaacatcaggagaaggaggagaggacaagaatgaaccttcttccaaaagtgaaaaatctagaagaaaaagacaaacttctacagatattaaaagagaaaagtatgctaactggttttacattttttcgttgtctgcgttgacaggtactgcaatctacatggcaagggattgggagcctcaagagtctgaagaattgaagaaagacatcgataatggctacactttatcacttatgtataaaagattcaaggccaggttcaactcaatgttcacctacttccaagagccacctttccctgatttactacctccaccaccaccaccaccgtaccaaaggccattaactcttgttatcacattggaagattttttggttcattctgagtggtctcaaaagcatggttggagaacggccaaaagacctggtgctgactacttcttgggttacctatcgcagtattacgaaattgttttgttttcatccaactatatgatgtactctgacaaaatcgctgaaaaattagatccaatccatgcattcgtatcttataatttgttcaaggaacactgtgtttacaaagacggtgtgcacattaaggatctgtcaaaattgaatagagatttgagtaaagtaatcattattgacactgaccctaacagttacaaattgcaacctgaaaatgctattccaatggagccatggaatggtgaagctgatgacaaattagtaagattgattccatttttggagtaccttgccactcaacaaaccaaggatgttagaccaatcttgaacagctttgaagacaagaagaacctagcagaagaatttgatcatcgtgtgaaaaaattgaaggataaattttacggagatcataaatctggtggcaactgggcaatgacggcactaggtctcggaaattccctgggcggcagcaccaagttcccgctcgatttgattcatgaagaaggacaaaagaactatttaatgttcatgaagatgattgaggaagaaaaggaaaaaattagaatacagcaggagcaaatgggcgggcaaacatttacgctgaaagactatgttgaaggtaacttgccttcgccagaagaacaaatgaaaatacaattggagaagcagaaggaggtagacgccttatttgaagaggaaaagaaaaagaagaagattgctgaatccaaataattttcatgtaaaccctcttctcatgtatctacgtatctatgtgtgtatgtaaatgtacctgtacactccccacaccctcattttgttactgtcatgtgaataaaacttatgtatattgctaacttactaccactgcacctcctaacatcaccatactacgtacaaacacgcctatttattttttctatgttaaattttaacgatgtagacacacctaatgatctgatgcgctttgcatatctcatattccttcactagcataaaaatccaaaaaaaaagaatatttaggccgaatggaattattcgtaacgtcatacgaaaaaagtttcaattcgtacaatgcctggcatgttcattcgaatataaggccgccgccttccagtcagggtagccaaaagtataatcccgggtggaaactaaactaaaaaccgtactcacaactttccgcggacgctaacagacaaatagacacactatcaggtcaggaactgccgtcacatacgacactgcccctcacgtaagggcatgatagaattggattatgtaaaaggtgaagataccattgtagaagcaaccagcacgtcgccgtggctgatgaggtctcctcttgcccgggccgcagaaaagaggggcagtggcctgtttttcgacataaatgaggggcatggccagcaccgagacgtcattgttgcatatggcgtatccaagccgaaacggcgctcgcctcatccccacgggaataaggcagccgacaaaagaaaaacgaccgaaaaggaaccagaaagaaaaaagagggtgggcgcgccgcggacgtgtaaaaagatatgcatccagcttctatatcgctttaactttaccgttttgggcatcgggaacgtatgtaacattgatctcctcttgggaacggtgagtgcaacgaatgcgatatagcaccgaccatgtgggcaaattcgtaataaattcggggtgagggggattcaagacaagcaaccttgttagtcagctcaaacagcgatttaacggttgagtaacacatcaaaacaccgttcgaggtcaagcctggcgtgtttaacaagttcttgatatcatatataaatgtaataagaagtttggtaatattcaattcgaagtgttcagtcttttacttctcttgttttatagaagaaaaaacatcaagaaacatctttaacatacacaaacacatactatcagaatacaatgactaagctacactttgacactgctgaaccagtcaagatcacacttccaaatggtttgacatacgagcaaccaaccggtctattcattaacaacaagtttatgaaagctcaagacggtaagacctatcccgtcgaagatccttccactgaaaacaccgtttgtgaggtctcttctgccaccactgaagatgttgaatatgctatcgaatgtgccgaccgtgctttccacgacactgaatgggctacccaagacccaagagaaagaggccgtctactaagtaagttggctgacgaattggaaagccaaattgacttggtttcttccattgaagctttggacaatggtaaaactttggccttagcccgtggggatgttaccattgcaatcaactgtctaagagatgctgctgcctatgccgacaaagtcaacggtagaacaatcaacaccggtgacggctacatgaacttcaccaccttagagccaatcggtgtctgtggtcaaattattccatggaactttccaataatgatgttggcttggaagatcgccccagcattggccatgggtaacgtctgtatcttgaaacccgctgctgtcacacctttaaatgccctatactttgcttctttatgtaagaaggttggtattccagctggtgtcgtcaacatcgttccaggtcctggtagaactgttggtgctgctttgaccaacgacccaagaatcagaaagctggcttttaccggttctacagaagtcggtaagagtgttgctgtcgactcttctgaatctaacttgaagaaaatcactttggaactaggtggtaagtccgcccatttggtctttgacgatgctaacattaagaagactttaccaaatctagtaaacggtattttcaagaacgctggtcaaatttgttcctctggttctagaatttacgttcaagaaggtatttacgacgaactattggctgctttcaaggcttacttggaaaccgaaatcaaagttggtaatccatttgacaaggctaacttccaaggtgctatcactaaccgtcaacaattcgacacaattatgaactacatcgatatcggtaagaaagaaggcgccaagatcttaactggtggcgaaaaagttggtgacaagggttacttcatcagaccaaccgttttctacgatgttaatgaagacatgagaattgttaaggaagaaatttttggaccagttgtcactgtcgcaaagttcaagactttagaagaaggtgtcgaaatggctaacagctctgaattcggtctaggttctggtatcgaaacagaatctttgagcacaggtttgaaggtggccaagatgttgaaggccggtaccgtctggatcaacacatacaacgattttgactccagagttccattcggtggtgttaagcaatctggttacggtagagaaatgggtgaagaagtctaccatgcatacactgaagtaaaagctgtcagaattaagttgtaatgtaccaacctgcatttctttccgtcatatacacaaaatactttcatataaacttacttggtcttacgtcataaataaatatgtatacatataaattaaaaaatttggttttatatttttacaaaaagaatcgtttacttcatttctcccttttaagcgatacaatccatgaaaaaagagaaaaagagagaacaggcttgtgccttctttaaaacatcccacacaaaatcatattgaattgaattttacatcttaagctagtgtacaacaactgctatatccaaagaaaactaacgtggaccgcttttagagttgagaaaaaggtttgaaaaaaatagcaatacaaagacttgtttcatatataaaatacagggagcacattgagctaatataacataaacactgcgaaccaattccaatcaaaaggtacacatgagagcattcccccgagtactgccatttcgccatcagagatcatataataacatccttcttcgaacagtaaggctttttggttcatcactttcttcttttgatttctctaggcaaatgcctaaggtggaccctgacaataccgctgcaatgctactacagaaaaacttgatccaaagaaacaacatgctctatgggtatggatcagggacaatacgatgtactttgctagactcaactggacgagccaaatcaccattagtagagataaaacgtgaggatctagtatcaaaacatggcttgttgcccagagatctacgtaaaattgaaaaatcaaggaagaatgacttagtccctagtttgctcgtgcgagaaaattccatactaatcagtttacttactgtgaaagccctaattaagcctgatatggttattatcttcgattcagccggcagtggaataactttaaactcagaagctcacaaggattttattaacgatatgaaattgagactaaaaaatcaagaaacaagcgagctaaatagcgatccacttccttatgaattcagagctttagaaacgatcttcatttcggcattatctaaccttaccagtgaaatgaaggtgttgctaaccatatgcaagggggtgcttcaagatctagaatttagtataacaagagataaattaaggttcttactgggtcaaaacaaaaaattgagcagcttcaataaaaaggctgttctagttaaagatatgctggatgacttgctagagcaagacgatatgctttgtgatatgtacttaaccgacaaaaaggctggaaaaattagagttcaagatgatcatactgaaattgaaatgcttctggaaacatatcataactatgtcgatgaaatagttcagaaaagcgaaagcgccatatctgacgtgaaaaccacagaagaaatcatcaatataatcctagattctaacagaaacgaattaatgctgttagggataagatacgccataggaatgctttcgttgggaggcgctctattcctgggttctatctatggtatgaatctggaaagtttcatagaagaaagtaattatgcgtatttaactgtcaccattttggggttaatatctactgtttggctctatgcgaagggaatcagacatttgcataaattacaacgtatgacattattgagtaaaataaaaacagattccgttcacgaactgttgaagaaatagttatcacgaagagtcaatcaatctttttaatacgcattcaaatgaataagaacaactttcacttttttaagtatataaaaagccgtacaggcgaacgtatataattaaaattctttggaaaaaaagaaagctcgcactcaggatcgaactaaggaccaacagatttgcaatctgctgcgctaccactgcgccatacgagcttttgttgtatagttttaaggcaatagaataataacacttatccacgcaacagtaatgtggttaaataataacttcctgtcaggacttgtggttgattggtgaaaatcaaatatcatgctgactactagaaatattagcagtatattatcatatacggtgtaagaagatgagataaggattgagaaacagtcatcaagtttaatgaaagtgaaatgaaaggattgattatataataggataatgaatcacaaagtataaaaagaaggaagaaaaaatgatatcattgagaaattgatgaattttgagataattgttgagatttaattgttgataaaggcaataatattaggtatatagaatatactagaagttctcctcgaggatatagaaattttcaaaggggaatcgatttttctacaaataatattactattattcctccttccgttttatatgtttcattatcctgctatattatcaatcgttgcattaatcgttgaatttcaacttactcgaacttcgatgacagtttctcatcccttatgttatcttcttacactgtatgtgataatatactggtagtatgactactagttgatagacgatagttgaatttattccataaattatttatgtaaaactgccgaccccttttgtcgatttctatattctcgaagagaacttctaacattttctgtatacctgatattatagtctttaacaacaacggaatcctcacagttatctacgattcatctatttctcatcagtaacaaagatatttcagtagttattttatataattcatgcgtttcacacatagagatggtttcttaagtttagaatgacgtatttagctataataaaatgtttcattgtgggataaaaacttgtgggccatgacatgagcaaatttattatcaatgttgataattagaggtaaaaaattagtattaatgaagaagtgagtactgatcttcttatactaaataagagaggtatataaaacacacgccgattggtcatattaatcatgaccaatataatagtggttccggtagttactatacattgatgtgacgactcatattcctcatatatgtacctaccatatcatgttcaactaataggtctttaacacagcttcagtattgtctgagcttctcgtttaacattccttctgcaataggcgcaatcacacttaaacgtatacgagttgtacattaatatacgatgtaagcattagattgttaccatagcaactcatgtcactattaattactctcgttccaacatgctcccttaaagatatattattgtacttcaacagatattcattgtgtgtttagaacttcattaattaattatcaatagtctgttgaggccaaaatatcctgtgatgttattttattttttaatacttgtataaatcttttaaaatcagatgctgatactggttttgttagtaaatcagcaatattacctttgccggtaatttttaacagttttatactcttctctttaattttttcttttattatttcagtttttatccaagtgaatttctcttttggttgttgatagctgcgatttaatccttgaatggctggctttgagtcagtgatcatgacaatgtcattattgtctccttctcctagctcctttaatgttaccttcaacgtttctgagtctgcatagccttcataaatggcatgaagctctgcttctgttgatgatacacatctgtttgtgctcttgttagaataaacattaaaaatattcataccgtaccataatataactccaatccttgattgagcatcatattctgatccaactgatgcatcagttatagcaataaccttcttgtctttattacagtctcggtcatagtgtattccaatatctttataccgaaccaagtactggattattttgtaaatcatataaaagactctttcatgtgggtaatttactagtctagccactttcttaacagcaaaattaatgtcgtatctgcatttgtgtctgacatagtttagttcacctagtaattgttgtagctttagaacaccttgtctaaactcttcttctgacatttgcagtacgtctttcttaggatctattttataagttgacatatgcggaattgaactttttctaatctttttcaattcctcgttgtattttttatccattctatttatgaatgattttaatgttaaatcgatagtaccaagtcttttgttgtatactagatccattcctaatatatctgtatcgagtacatcatctattaatgttcctgtaattttcagttcaaaattacttttcaatttgtttatgaattcatccaatctctgttcattgcttgccgcaattacgcagtcatcaacatagactgcaatcattagatttttatcctcggtttggtataatcccggagtataagagttatctttcagtccaattccattcaagtattgtcttagatgatcattccattctttaggactctgttttagaccatataacgccttatttagcttgactacacatctcctatcatgcggatgtgggatgtatatttcttcttccaatttagcatataggaatgcatgattgatatccagggtcttcataaacatatttctgttgtttgcaatcattaagaatatcttaatatgattgtgatttaaagattctgtagttattacactgtaagtgtctggtgactgagtatcacctctgcagactatcctagccttataaatcccatttcttttctttgtgaatatcgtgttggtgggtactattaaattatcagggatttctgatctactgtacttcacatcgacatcaaataccttcatatcttttaaattctgtaattctttatgatatgcctgtttgtattcatgtttttctttgaggtcaggattttttgaaatagcttcattataatatatggctctaattttttgtgctgaaactgtttccatattatctggaattaatttcactcgattcctttttgaacgcttcttatctctttctaattcatagcttgttagactattgtttttatcgtgtcttttccgttttcttttcatgttcaaagaactgaattctttgtttaagaaggcacttttattaactgtttgtactggtgatccagatgcttcaatattttgttccaaccttggtgacacatttgttccattgtcagttggtacatttttatcggtgacttttaattcttttaagttattaccatcctgacagtttgattccatatcagtttgatcactcatatccacaatgtcctcaatcgggggcggatgatgattttccttctcaaacttttcaactttgtttgtggaataatcattactatggtgattgttaatgctttctaaagtttttattggtaaactcgtatcgcctgtttttaaagaaatctcattgtctgtatttcggaattttacattttgttccaatgctcccttctttaggaaacgaagtttcatgatttgttttattgaactgctcctgaattagttcgggttttgcgttgtgcattgactcatctttgttagtaatagattcatcggtgatatctacacatctactgagtccagtgtttaagatactcccaatatttttactacgaattctgtcggagattctgttttcgtcattgattttaatagtatttttacttcctaccagtttctcttgtataatcgatggaattctgtggactttttcatcatacttatcttcatcaatatgacttgtatttattaatcctttcttatcgatttcactgatggatatttcagtcgatgcaagttctgaattaaaatccttgtttgacaaaattttgtttttatcagttgagattgaagtatttgtcgttgaaagttcagattcaacgtcataatctccagattcctcaacatcagaaaatacgtaatccaagtccccttctaggttattactaggagatgggtattttgcgtttgagtctatttgagataactcttcctctgtgaacaaatcttccaggcgagtaattggtttattatcatcttcgtagttttccaaagcttcacataagtttgtgaccgtttcgatttgatcttcttcattatcattatgtgaactgaattgatgactcttgtaaatattctgagtatttcttactctaccgtccatcgtatagttgggaattgtataattatcagatgtgacaattttatttttggatggtataaagaatttgtatccataactatttggatctttgcatagaattatagaaggaagtccagatggtttcaattttttgtgattatgattccaaattattcctttttcgccaaatggtaagaatgacattaatctcactgtaacaggttgacgtgagattgccttcaatggtagtttacctgtacttttgtgttccaggcaatttcttatattggtagcagaagttactgcgtattcccaaaattttactcttaagttactttgtcttaggagtgttgttgcatcagttactattgttctgatgtatctttctgctcttccattagcagcatgatcttgtgtagaagtaagtatgtgatgtattccttttgaaataaaatattcttctatctgatcatttgtgaattcagtacctctgtctgaattaatttctctgactttcctgtcaaattgtgtttccacgtactgaatattctttctgatttgagctaaaatagtttcagcattcttattgaagtgtgtggaggtcatgcaatatctcgtgttgttatccaccataataagcatgtaccttttagtgtccgcgtttgaacttgatacagggccaaatatatccatgcaccatgatgatcctggttcatgatcagtactatgattattcatagacccggtataatgatttcttttcgtggctttagagattttacaggtttgacaccaaaattcatttggttctttgattaagtcaagggattcttcataatgattatgttttatggaattttcaatttgttgaattcctgtatggcccattcttttatgagcatcttccaaggtaatagaccttttatttagtttaaatccaggagaagaagtaggttttattgcatttatttttgaatcatcggaaggacgttcaattaactcgttcatttttacgtgaatgacaccattaactatcttggttttaatttttatgattttgtttcccaatctggtatattttcgacttaaaaccattttggttttcttggctaagtcataacagctgattatagtggattcttcttccggtacatagtaagtcaataaacacttattgtcagtattgttgtgaccattcttgatttttatatagccataccctttaacagacactgaactgtttttcccaataccaaaaaatcgtgtactgcgattactgtcttcgtaattatgcagtaaggttttgtcattggtaatgtttacgccggaaccggtatcaataattaccagttttttgctgttgtacactttgtttgactttttttgtgtcttgttccaagacttttgttcttttgcactggacttaagttgttgttgtctctgtgcaccttgtagataataggtttttgagaaattggtcgagtcaggcctaagttccctatttggtttctttttgcagttaattgagcaatggaaaacagatttgcaatacatgcagctattttctatttgatcgtctgcaattgggctcaaatcaattactgtttcaataacagtattgattagaaattcttcgtgattaattcctacgttatgtggaatgttgtacaaacgttgtttcacagaatttcttaaggattcatgtaaggttcccatgatagcttcttgtaggtaatcctttagattaggacaatcttggcagcatttagaaaaaatccatttttccattagtaccaacttttgaagtttattcattaacaatgcggaatttctacatgttgtatcaaccaaaaccttttcccaggctctaattctgacatctctaccatgtaaacttctatatttgttttttaaaccatcgattatcctaaaaatgtcagttgtatttgtgttcatgatatctaaactttcaccgagtccttctttgattatcttgcacaagatttcattttcacgaggatcgatttctatgatatcattttcaaagacatcatcaaattgatatttcttgatgaattttttaaaattgtttaagagaataggaatgttctcgacattattagtcctataatcaaaaacacaatccttagggtagaatcttttgttggttgaagttaacgtatcgaataaatagtaagtccctgtagcatctatatgttcatgtaatatattattgttctcgtttgtttccaataattgtatcttttcaactagatccacaatcctattctcaaccttgtcaatggtttctccgagttttaataatttttcagctagcatctgaatatcatcagtctcagaaagtttttcctcttctgcctttaaaccatttagtatggttttaaacctatttaagtttctttgatattgtttcacctgttcatctttaatagaaacttttcttaatgatgatggcgtctgtctgacagtatcatttgttttgactttcgattgaatccgcgcagaaatgttgtcgtcaataacatttcttgtttcatccctcactggggtcgccatgttgataattagaggtaaaaaattagtattaatgaagaagtgagtactgatcttcttatactaaataagagaggtatataaaacacacgccgattggtcatattaatcatgaccaatataatagtggttccggtagttactatacattgatgtgacgactcatattcctcatatatgtacctaccatatcatgttcaactaataggtctttaacacagcttcagtattgtctgagcttctcgtttaacattccttctgcaataggcgcaatcacacttaaacgtatacgagttgtacattaatatacgatgtaagcattagattgttaccatagcaactcatgtcactattaattactctcgttccaacaatcaaagaatattaaatgaacttcaaatattaagtaattctccttgttctgcttctacggctctaatccatattagcatacccgattaatataattgcctgcgatcgaatacccaatgtactggattttgttggaacaagtgatttatcacagttcacactgtcgtgaagtaatttgacggtatatatcatatataaacaatattcaatggtgaaatcagcagtttgcgttgaattaagaacatatactacttgaacataaactggggttcatgtaaatggaaaatatgagccatcgcattgagcatatggcagtcataagcagttttgattctgcttaagattcaattaaaagtaattgaaagagtaaaatgttttatagttcagttagtaacttcgagcaagctagtgcttgccatttaggccattgaataattcagtacgagtatatgcttattattatggataattgatgcactagaacacaaggagaacgagtattttaacaaattgagctattacaaaaggaatacttagatacggcattatctgacttaaggcttcttcattagtgattgattaaaagaaaaaatagaatgcaaaagctaaaggaattaagcgaaactaggttccagtaacacttaatttagtagccttatcaatattaagaaaggatggtaacctctaatatatcactgccatgtaatgaacttctatattttagggatttaggagggttctgatctgaatcacttatgtgttttatattttctacatacagcgcgactgctgttttctatccataattattttaagcatgcgctatcgtttctacctaatgacaaattgtggtaacagccagatttatctcaatatacattagtagtcaatatctcaaacgacatcgaatgccgcacatagccatttattataacagatgagaaccacatcactttttattacaaggtgtccattatgacgactgtagaagtatgcaaatcataagttagcccaaagaagacatttagattttcttacgacaatactaattaaggtaccacgaacaaagagagaacagtaggtatgttgtattgctacgccaacttttcttgtgatcaaaaagttcaatgcattcattcttctttataatatagtacaaactgttaatttactacatacggaatcatgagattctaaatttagtatacagagcttaatttattcaataaagcataactagtgccgtaaagagtctaaaccggtatttggcactgatctgagcttattggaaaaacgttacccgaccaaaataaatcacttctaggaagtaaaggtataaagtattgatgacaaatgcgttctagtcccaaagggacaagaagttgtattactcttttcacatatatcaaggccacaaaggtatctgtttactttttgactttagcaaaaatttgaggaaatcagacaatgtttctcccaaaattcaatcccataaggtcattttcccccatcctccgggctaagactcttcttcgttaccaaaatcggatgtatttgagcacagagataagaaaagctattgaagatgccatcgaatcggctccagtggttcttttcatgaaaggtactcctgaatttcccaagtgtggattttcaagagcaaccattggattattaggaaatcaaggcgttgacccggccaaatttgcggcttataatgttttagaagacccagagctacgtgaaggtatcaaagagttttcagaatggccaactattccacagttatatgtaaacaaagaattcattggtggatgtgatgttattacaagtatggcacgctctggtgaattggccgatttgctagaagaggcacaggcattggtacctgaagaagaagaagaaaccaaagatcgttgattttgttaccactggaagcaaaataggaactggtggccgaacactttaatactcgtgtgcataataggcctttacgatccatatttatatatgcatgtacatttgctatttttttaaagatttgtaatgtattctcatgcctttagacttgtaaataacagattctctacttacaaacccctctctttgctttgccaaatgaattgacgttataaaacaaagaagtgagaattatgaatatatttaatattccccgcatagacttgaatcaaaaaacgttagttttagaatgacagaagccatatcttcgttctgattcaacgtgcgaaagacgcgacagacatttgttggggttgtctttgttactctcttgattttcgatagattccgtactgttaccagtttgcttttcccccattttttttaacgtaaaaggattggaagataataggcgagctcaattttattgccctgcgaagctttcaaatatgttagtcaaaggatcaaacttccttttgaaggtgatagggatataatgaacacacaattgtgcctttaagccattactcacgagtgggatagaaatgaaattcttttcttttaaatggtattaataattaatatattaaataattatattgattctatacataaaacattagtgtgaaattttcggaaaataataatagaaagtaaaatcaaatgtaaaattaaaaaaatgatgttaaaggacgccaaaatttgtgaaaaaaaattgaaaataaaaattgtgtgttaaaccacgaaatacaaatatatttgcttgcttgtttatttcttcgtgattttattttcgtcacctggaactgtttggaaaatgttggtatctttttcatgtctttcctttcttggcccattaaaccatttcttgaaattcaaaacagacttcaaagaccacaccttaactcttacaacatagtaacaaatcaacatagcggcaatattgaagcaaatataagcccacatgaaaccaaagtttctccatctgtgatcccatttgacattgtatttagccacaacttgatcttgaacagtgtatgggcaatattgacagttttcggtggcagttggatttaccaaataaccggtattattgtccatataggtagataaaaactcaccacaagtttttccgcttggtgggtccatgatgttgtattcatgaggattacaaacgacctttttattgtgaactaatggtgtaaccaaagcttgaaccacgtaggtaaatggtgatacattatacatcaatcttctccagaaggcaggcattttctctcttggttgtaaaataccacagaacagtaacatagcagcaaacaaattggaattaatcatagaagctgagggaacatcaggagacatgtacaggatccatagaccatatgtgacaaaatataatgggaaaattaaaacatagaagaagaagaagaaacctgcatgagatgcacgtccactgaattgagctggccagtagtagcaaatgaaacacataaactgacaaagtgtggaccaaaagttttcaacagcagcatgacataataacaagacactccaatggaaagtgttagaagcggcttctctaacctcatataattccctactatcataagcgaagacgtgcagttgattgatcatagccagagcaatcaataatagcatgaaaatagacgaaaaggcctcaatggcaccaccaacagagtgatttacaccaacatatgataaaccgacgaacaaagcacatgcgacacattcaaagaatttggccctgatatagacaggcgatctccaaaattgaagagctgttctacgtaaaacacatttgatttgagtcatgtaactggcagcaaatcttgtagctaactcaggatcatcattaactgctctaccaggtaaagtacgatgtaattcttcaacttcagcccttgcagcggcacattctggggaagcaagccataagtcgtgccaatcagagttaacactagcagtggcaccggcaccaatacaattcaaaatatattcagctggattttcagaaacaccacacttcataccagattgacgttcaaaatacttcaacaaagtttcagaatttggaccaatgtcaccaaagtaaaccatcttaccacctttctttaacaacaacaatctgtcaaactgttcaaacaaggtagcagagggttgatgaatcgtacacaaaatggattgaccagaatcagctaaggctctcatgaattgaacaattgaccaagcagactgagagtccagaccagaggtaggctcatccaaaaacaataataatgatggtttagcaaccagttcaacaccaatagataacttctttctctgttcaacgttcaaacctctaccagtcttaccaactaaggcttcagcgtaattttgcatacctagcaatgtgataattttttcaacatattcatatttctcctctaacggaacggaactttgctgtcttaactcggctgcaaatctcagggattccctaacagataattcggccatatgattatcggcttgcgcaacataaccacatgatctgttgaaagaagcaggcaagggcttggcattgactaacatatcaccagtgatgacacccatattgattctttgtgctaaaacatttaacaaggtagttttaccagcaccggattcacccatcaaggcggtcatcttaccaggcttaacgtaaccaaagacatccgataataattttcttgtagctccgtcgtatggaatggtgtagtccagatggttccaggtgaaaacgtccttttctgcaatgaccttttctaaatcgacatttggaccattcagagcctccatcatttcctctctggaagcggttcttgcatctgcattttcggtacctaactccggcatatgacctctcttatataacagcaagtcacctcctccctcaacaggtttcaaatattctgataagatgacattgaacacaatataaccaaaagtccacacaatgttcacaccccaatttctccaagcatgcttatatgcgaaatgatattggtgtaagatgtaagagtcaccgctaacatacaagttacccttaaccgcaccagcagcatcacagacttggttagcaatagaaataccttcataaccaggaccagatgggactaaggcgctacacaacatttccctgtggtgaaattcagtggaaactaaactttcaaaagcataagttaaaggattaatgaaatgaagccatctaatccaatgatgcatttcaccaattggcaagacaaaaccagcataaacacaaagcatcaggacccataaaccaccgacggcatgggcatccacaccagatttactcatagtagcaacaaacttgaaaatgaaagaagtacattgttgcacagtcagtagatataaaatatactggaagaaagcaccagcttcatatttcataaatggaatccagtaagtaatcaaacatagtatcacaatagcgacaaatttagtagggaactcagtgataatctcttgtaacgattccgcagacaaatggtacatggaatatgatttgtgtttgacaataacaggtctactagaaaaagagttaccaatttcggccaaggaagtaacagaagcgaacaataaaacatagaataacataccaccacgagaataagcacctgccgtggtggattgacttttgtcatcaattttgtggaacatagaaccgataatcaaagctttgatcaaaaaagaacttaagtagaccttagtatacgttgaatcacccttaaccctttgaaaaccacgaatcatacaataataaacttgtgtccaataattgacaacatattgagaattttctctttggccttgttgcagtctttgcttcttggccacatccagtctatctctcgtttcattaacagggtgtctactttgataatcatcataagttcttaaaagttcctgataatcctcagagttcaaccagtattcctcaaactctgaactagattttggaactttatcttcatagccaggtttaatatccaatgtcctattttcaaaatcgaccgtgacggatgttaaaaattccgcagaggtcattctgtttggtttaacccaacccattctttggaaatatccaacagctttatcagcaggaccgaagtaaatctgtctaccgttatatagaacagtagttttatcaaataattcataaatattttcaccagcttggtaaatagcaacaatagcagagttgtttaccatatttgtagccgttctaatggcttgggcaaactctaaagcagtagaggcatccaaacctcttgtggcgttatcccaagagtagatggaggcattcattgcctgagcttcaaccaaggaaacacgcttacgttcaccaccagaaacacctcttacgaaatcgttaccgactttggtggcatatgtgtgtcttaaaccaaaaacggtacaccacatatctctgatgttatcaacgtattgctttctcgtcattttgtcaattctaacacgaggagtcttacattttagggcaaaatcgattgtttccttcacagtaatttttgggaaatggaaatcaagctcgggacagtaaataacgtaacctttatacttagacatcatttcgctttggtccagaccatcataggagaattcaccttgtacatcaactaattctgaagtttcaccagatagacactttaggaaagtggagcaacctgcacctggcctaccgacgacaaataacatttcaccagattcaacgacacccgtacaattttgaataatattccttaatgggacatcagatttcttggtaaatttacttatgagatgtgccggtatactagcaatatttctaaacatctcttcaacactaggcccatatgcagcagaggcatcaacaccgactgctgttaggtttttaaaggcaataccagaatcaccaggttcaattccctgttccaattgacgagacctcaaataatgtaatagtgagcgcaaatcaaaatctaagtcattaatttcaaaagagtccatttccttctttgtcttatgtgaaatgactctcgccatagactccaacctttcaataccttcttcattggaaagaatgtttgaaaggtgacgggatagctgagaagtggctgccaaatcctcattatcaacttggccttcggaggcagcgtaggattgtaccgaattagcataatcatcgtcatggttcgatctcgacgaaatgtctttctcaatatgttcgtcagtcgaagacatttttttattaataagaacaataacaataaatctgtaaaccttttttttaagtgaaaattagtaactgggaaaacagagagaaaaaaagcagaagaatatattgattgaagaataaaactgtttaacgttcccgtttatttttcagattatcctattgttatactattatcgttcttagtcttttctttatatgataaagagaaccccaaaaagagaactaccttgtaccatggttgttaataaaattggatttgttgatatatttatatgattaacatttcattcaggatagaattgcctaaaaggtaagaaataatcataagaaccgtcgagaaaatgtgataccgaatccctgcggtggacgtggctaaagaatagtgaagaaaaaccggctgtagtgtatgttttgtatgagccatagccgaaagatcgaaaaagtagcagatcccaaacactttacggaaaaaaatcgagaaattccggcgaatcggctcttaacggatgcagggtgtcagtctgatgagccataaaaagaaagatgcaccattgccaagctgccctgaggaagggttttggttaccctgtgagatggatgcggtaaaatgaccaagggaccggttggtaagggaccaggttaggaaccgtgagcggcgaaaaaagcgcgcatttgcacaattatattattaacaggtgcctgaattttaagaaccgtccaccatcacaggtgaaacaaatcaacagagtcctgccggctggtaaacaatccatctttggtttagaggccactatcgtcagaataatataaggtctattttcggcgcgaaagtcctgatgaggtaaatcgtagtcaggcgcctgaaagtctaaactaaacaattgaaagccgaaaccgaaacgcggaaaagtaaatggcactcttcgagcggctactagtcgagtaattacatttctaaattagtctgtgcaatagggaaaagagaacattcttactccgttgcgatgtttctgagcataaggcgcgcgcaaaagcacgcacgcattgaccggagcggcgcccacacacggttgttatcctagtttttgttgtgaggaagtgttcatattcttttaggttatatttatatatatatatataaaagttgaatgtaaaatgcaaaacaaagatatcgtagtatagagggtaatatcacagtaataaaacaggcctggtttgaagaatgattatgttgatgctggaggtcgtaaattgtaacatgaaatagggagcatgcgaaaaaaaaaaatgacgagcaaaaaaagcaaggtagacaggcgtgccaagcggagtagtatgtcgtaagaagcgagcaaatagtactccttgtcttgcaaagtagcgaagtacaagactggtcttcaggctgctagagatttgtatcaattttgtatttttttttcatcccatgcaattttccttcccatttcttttgctttttttgccgcgaattgaaatataaagtctgatatgaattgttggagtcataccattctcttacgagctgttatttcccagtgagtacttagaagaatcattcttttctaaatcgtaaacatcacttttccttgaagattttagtaacactatgtttgtattggaatctttcctcaatcgtttctgctgccttgccagcaaagtggcactggcagtatcactggtacttttactcaactttagtcttaagcctaatgaatttagaattgtgacaaatcttacttttatagcattaagtttccaatttttggttagattactgaaattcttggaacacaaccagcaatagaacgtgaattcaccatataggataaagaagccaaaaataaatccggtaacgacgcaggataagatgtggttttctagtgctttcatcaattttgcatcatctaaatgccatgaagagcctttagtaatggagaaaaatgaataactatgcatcttgtagtaagcaggttgtaggattcttactgtcccgttcttaggtatgcgccatcttttgtactgcttccaaataacacttaaaaacaacggaccagtagaccccataatagtcatgtaagggataaaccagtacttgtcatagtgtttcaaagactttaaagcctttaaaaagaagggatgtctaggcacagaacccatgacatcgtttgagacacctaaaggtgaagtctttcttaagaaggccgggaaagctaacaaaggatctagtttcctttcgcagccgtcatctaaatcgatgtatacaccaccataatgggacaggataaagtaacgaatggcatcggcacgttctatggggtatttgtagttctcaaaagtatcgagaaaccacgggtattcttcctttataaactcataggccatctcgtccgtccataggatgtacttgtaatctggatgtagatcgagacatttttgtctaccctctttccagtgctcagggatgtcttccgttttataagtctgatgtatgattttaggtattagttgaggctttggaggtgcatctggatttaagtcttcctcaagtatagcatctttaacagtatcgtcaatacacaacgttagcaaatcgaaagtgtagtatattatagataacaggaggagtatgttgaagcagataaggtattttaattcttttctcatcgtgagtgcaacagcggaaaatcagaaaaatagagtaaagcaaatatgcgaaaatgaaaagtgtcttccgatttattgtttgtttgtatgtgtttatttgaatccgatgatgaatattacaacaggttaaagaaaacaaaacatgcgaagcaaaatatgacgggaatgttggcaccttttatttaactatattagaaaagaaaaagcagaaaacgtaaaatatctgcgtaagcctcctccctgtgtcttcactcctctaaccattttttccaagtagaaaagtttatatataacaagaggggaaaaaaatgtggaaattggcagtggacgtgagaacaaaaaagcaccgctgaaaggcttggccaaggaagtttagaaaggcgataataacgaggtaagaagaaagaaaaaaaaagaaaaagatggcttagcaaaagattggtttttatcccgggggagttgttgtggccgggagcaagagaagagacgcagcaagcgtgggtcaatgataatgacgcagcgcgacgcgacgcgacgcgaattcaaaagtgtgagtttgctcggggatagtaataatgcgggggggaagacgaaacagaccgtgtgtggtgtgggtgggatttcgtgggagcacgtggcgagcagaggaagagcctcacacaatgctgcgttcttcataaaggggatcaaagcaaatagataatcgattccaaagacagatggctgacacgcactttcacagtttcgcagttttttcttttttcgtagtcgctttcctagtcgctttcctggctctttacctaatcgggcttaacctagcagtaccttttctcgattcatgaaatcaaaacgctagtcacttccttataatttcctttttcaatttccgccgcttgcgtttacgtagtttatctatttataggtacggtataccctactgcattaataacaatgagtccagcttttcttgggtcagttgaatatttaatgcatgcttgtcgcactggttatttaggagccgcaattctagctcattagaattgatttttaggtttagttcttccaaagcggaatcgatggaatcgctctctttgaaaacttccctcgccttttcacattcactttcggtgttgtttgtctttttcacatttttatcaaaatctgtcaagtaaataaagggggaatctttcatatctagtattcttttcttcttgacgacgctgctgctagagccgtcgctgttacttctattttctggtacgtgtactgggtaaccctttgcataatagccattcgatgggggaggcggtggtgtctcacggtggtggtaattattgtaagtatggctgctggaatatggataagcactgctgtgatatgatctattgttggttatagacgatactgaaggtggtggcggaagcccgttgctggtgctgctagtgctgctgttcccactactaccatttctgctgctggtgctgccaacgctcatcggttgttggcgtggatgatctgcctgcatgttccggtatctggacttgactcttttttcgtcattatcttcttgcgaggcgctcgtggtcctgccgttcgtatcttgactattgccacgttgcggtaggtggtacgaatttgtaccattgttgtacctgggggatggttgtgcttggtaatgcctgctattagctgaatagtacggccttgtatctgtgtatccgtttcgatagtatgctccggtttgtctcaagtctccctcttggggcggctgctcatagtcactgttgtatctcgcgccataagacgcattaccgcctctgtaatacgatccgcctgctccacctctacttcgtctcgcatggtgataaccccccctttgtctcggaggagtggatgagtatctgctataattatttcccgtgtatccgctcatactttactgcggttttttggtcacctcttctgcctcgtaataaatgtggtgttctttcctttcatcgcagttgattcattctctctgatgaaaataagagaaaaaaaagaacttcacagggtaatggcccgtacaaagtgtcttttttttcaattcggaacggcggaattccccgccactcttgccccgccccttaaaacgccaaggtgaaagggagctctactacaggcccgccacagtatgatgtgggataaaaaagatgataggaagaaaaggtgcagacaacatcctgtatggggtgcacggtgtggcagtgctagtaataaaatgatgtggagattaacatgttgtggtacggtattcttatcttcaaggtaccacagtataattctgcctttatcattttttatttgtattatgtattttcgtgcttatcttgtaatttttaagttttggatttcggtgcttcgtgtagttcttcccctatatctcaatctaaagtaaattattacaaaatatggtggtgatcttttaatctcaaagcttcttttactccgggcattataaaaacagaatctcttagcagttactcttttcccttttctcttgtgccgtcatattagagtaattataatttcttctttttcggcttccccttgtttctacaaaatctcgattttattatctaacactatcataactactactattactattactattattattattattataaatcttaaaactattatttgctaaaacaaaatggatgcttttgagaatatgtctgtatcaaatcatccgggcggtaacgcaagaagaaactcccaatcagcaaacgaaatgcttgcatcgcaaattcaggatttccagaatattccaaggtctttcaatgacagcaatgcaaatgtaaatttgtcaaaaaattgtactgtcggcaatcaactgcctttctcatcacgtcaacaaaaaattatcatggaacatttactgataacgaagaacaattctcaacagcagaaggactattcacacgtgccatgcaaattttttaagatgggcaattgccaagctggctcgtcttgtcccttttcccattccccagatattatcagttctgcgaataatttaccttgcaagtatttcgcaaagggtaactgtaaattcggtaacaagtgtgttaatgctcatgtgctgccaaatgggttcaagatgaacagtaaagaacctattgacatcactcccccttcacaaaacaactacttatcccatgctagatcagcttctttctctacctacacgtctcctcctctgtctgcacaaacggaattctctcactctgcttcgaatgcaaactacttttcctcgcaatacctaatgtattcgcctcagaaaagtccagaggccctatatactgaattcttttctcccccttcgtcttcttcttcgtacatcaactatagctataataactccaacattaatgcctattctccagtctcttcgtcttcatctaacatttggcaagagcaaggccaaactacgttatcgaatccgagtgtgaatcagaatttaaggtatcgtacaggccctgcaattcaagaagaatcagataatgaaattgaagatttacttattcacaatttcaattccagatactgtcatgaatgaagagccgccccatccatagtttttcctagttcaagcattaatataccggaccactctacatcttccgaaagccggaaaataagaacaaaaaataataaaaaaaagcacgtttaatataaaaaacatttcattgtatgagttggattcttttaattttattttaaaatacggttgcattttgcatagtaatatccaaccaattatttactgaaatttgaaatttgattaaaaaagtcaaaccaaaaaaactacgacaatacatgaagctctgaatcttctagcctagtcattttatatatatatattcacctcctctcgatacgttccatcataagttagttttgtttttctctttctcgcgatcctaattaaaaattaaataaaataaataaatacatatgtatatatattcatatgtagaagattattgttcttatacatcagtgttttgatttatggtaacctatcccaaccttctggcttatctttcttcataatgtcgaagtaatgtccgccacatgaaccacttctaaacgtgaaatcgttaccctggtcacagttacaattatattggttccatatatcatcgtttaggggacagttattgtacttgtcataatggaatcctatattttcgaaaaaatgtattttatcctttggcaacagcatcgataacccaattgtgtggatgatggaatcagaccatttccagtagaaaataccgccctcttcgtcgatgtaattaaaaaatttcctgtaagctggcgatctataaaagttcaaattaccaatttcaaaatttgatgtgaattcacagttgttaaaatcttcagagtccttttttgtaataaatgacttgaaattattctcggaaataaactttggaaaatcctttgcaaattttttcgtaacatcccaaatcttctcattggcttccttagcttcactcatactcaatgtgaaaccaaacactttgccttcatcttgcatccacctaaaaaggtcatgatcaatatcacagtacaatttaataccagggtctactctccagtaccaatcaaactcatccagaactggatgcctccaaaaaaaccctgcaaaatatctagcttgatatcttacagctctagaatcaccatccggtacatttgctaatgaaattagcgattctgctgctttattttcatcaatccattcagggtatacccattcgtctgcaggaatttcagcaaatttaatattaattaactcaggatcaccattcatagaatcagttatggcttgacgaatcatttcttgcttcattccgtcaagctccccctgactaataaaaacccaaggataagcaaaatttttgttaaacttcacctgcacttcatcaatagattgtaagatttgggtcatggaatccctttcagtaattagtgagacaaagcacgcctttggtggtgatcctctatgattgatatacgatggcaccatgaaccctagcgtcgtttcattaccaccataagatttgatcttttccttaatggcattcacggtggcatttctaatggcctctccctctaaagattgcttcaattcggcttcttcctgttcactttgtatacgcctttgttcctctgcactaatttttgcaataggttgcaaagatttcggaaggtatggtgtaacatactgttcagacatctgctttgtttttggatgatttattgtcaccattagcgcaagcacgaaaacaaacgaaatcaacagaaagcgtgctatttttttgctcagcagtacgtgcatcttaccttatcttatcttcactaaagggcacaaaaggttgggtgaacgcttagtatccctctagtcttgtatactcgtacacattataagtacatttaacaaatctcatccacatttctcgaataaatatcacatgtaacttgaaggttatttttatatttttttttcctgtgaaggaacaactcgtgtctcacgagagcgccacttaaaaaacgaaaagataatcggcgatgactatatatgtatgtgattgagaataaaaatatggaaagataaaagacctagtaacgttgtatttcaatagtgaggataacataaagaagtaaaaagatctttgaaaatgtatgaagtaatacagaaaaggaaaacaaaaataataaacgttttacagagtcctgaactcatgaggctcatagaggacccatcaaatctgggtatttctttacattttccagtaagttcactgctaaaaagtaataagtgcacaccaatgcctaaactttctacgtatagtttggctagtgggggatttaaggattggtgcgcgtgacatccctctagacgttccaccagagattgatatcatcgatttttactgggatgttattttatgcatggaatctcaattcatattagattacaatgttccgtcaaaaaataaggggaacaatcagaagtctgttgctaagctgttgaaaaataagcttgtaaacgatatgaaaactacgttaaaaagactaatttataatgaaaataccaagcaatataaaaataataatagccacgatggttacaattggagaaaactaggctcgcagtatttcatactgtatcttcccctatttacgcaggaactgatttggtgtaaacttaatgaaaactatttccatgttgtattaccatctttactgaatagtaggaacgttcatgataaccacagtacctatataaataaagattggttacttgcccttttagagctaacttccaacctgaaccaaaacttcaaattcgaatacatgaaattgagattgtatattttaagagatgatttaattaataatggtttggatcttttgaaaaatcttaactgggtcggtgggaaactgattaaaaatgaagatagagaagtcttgttgaactcgaccgatttagctacggattctatttctcatttattaggtgatgaaaactttgttattttagagtttgaatgctaagcagttatattcagttagaagcatatatcccaccattaaataagttaacatactactgcatttttattttatgtttaagagcagatacgtcaatgtagcttgcatatgtacgtatcctcccccacctcctattttctactttgaactttatgggagtgttagtataagaaatatgtttacacctttttcagacaaatgtaaacggaaaattaaaaaacgaattcagatcgatgtgttaatcaagtagatgaaggagaataaagcatataaagcgcaccgcacacatgtttcatttagtcaagggactttacaataattggaataaaaaggaacaatattcaattctaatattaggtctagacaatgcaggcaaaacgacgttcttggagacattgaaaaaggaatactctctggcgttcaaagccttggaaaagatacagcctacggtaggacaaaatgtggcgacaatacccgttgacagtaaacagatcttgaagttttgggatgtaggtggtcaagaatcactgagatcaatgtggtccgaatactattccctatgtcatggtataattttcattgtggatagttcagatagagaacgattagacgaatgttccacgaccctacagtcagttgtaatggatgaagaaattgaaggtgtacccatcttgatgctggccaataaacaagatagacaagatagaatggaagtacaagatataaaagaagtatttaataagattgcggaacatataagcgctagagatagtagggttttaccaataagcgcattgactggagaaggtgttaaagacgctatagaatggatgattgttagactagaaaggaataaaaagtcaagaccaccgatttataaatgataaagaagcaccaaaagaaataaaatgtgaatggtttattctcaagctcagaaattagttgttgtagcactttttattcggcattttttaatatacatgtgtaaattatatatatatatatatgaatatatatcttgttttgtttattttcaactaataatcgcaacaatattatctttcaataacgctatagcttctgtatgctttttgctcagttgctcaatggttctcttcctctatgtgataaaccaaatagtttggtaagccaaatacatcgtagtttaatctcttcgccatcttagcaaaaccttctgtttcaatcaagtgataaaatgggaaattagggaacatggcaccgtctctgtgaacttctgctttgaccaaagtacagcctccaccaacaccatccagcgccatctcttcacctggtacgccattagcatcgtagaaatgagccattaatggcctataagtggcaatttctgcataaccctcgacaataatctcgtcatcacccatctgagaggctatttctaaaccggtgtcactttcttgccagttgttgaaatcgtatggtctgattgatggttgcttcttctcttcatcgtaaaatctttgataaatgtttgcagctaagatagctttgttgtgtttggtcatgtcttgaattaaagatggtggtgtctctataatatcggcatctagccacagcacccaagaagtgtgaggtcctatggtggagaatagtaattcattgcgcgccaaagccattgctgcacgtctttccttttgaacatctaaagcgtgtctttccttctccatcaacttatcaaaactctgggaattctgtcgcaaaatagtaattttactaaatctttgagttttcttgtccgtttgaacctttttaatagcattctccaatttctttaaggccaagtcaccagtggctgttcttggtgtaatgaaccccaattcaatcaattcccgagggtaatttagctgcagcaaattgtcccagtattgttgatgaaatgtttgcattggagtcaatatcaaaatatgctccttattgacagctgcttctgacgtagagtgcaatttgttcaaatcataatgtgcaatatgaccttctgggataatatcttccacgtgatcgttgaacaaccagccgctttttttcttataagagtactttggcattttgtatttcttggtgaagggaaaataaaatgtgttttccttttcgtgtgcccatttgtgttgggaaatggactggccattaagtcccaacagagattgatctctctggaaaaaaattatatatattagaaatatggccaaaacaggtagaaaaatgttaacccacgggttctttcttaggcggtacgatacaagagaaagtgacattgtttcctaactttttattctagctcttttaaattcttctgtttgaaaaatactaaaattgatgctattctcttcttactttcacaaagtgcggaaggaaaaataggttcagaaataacgggtcccaagagcggctaacagaaaataataaaagcttttctaccaattgagaatccgcttggttgacgacttttcctcctttattattcttgatttggtgttctgttttacttatatcaaaatacttcaacgccaaatccgctacaacgatggaaaggaaaaaaaaaaaaaaaaaaaaaagacaaaccaatgctgtcgtgtctagtgacgataaaggctgtaactattaataaggtgaatactcaccctcatcttttagtttatcaaacttatataaaaattgtgtatgtactgaattgtccttggtgtgcgagtgagagtgtgtgtgtgagtgcgtgtgtgagtaggtgagtgtatgcgagtgtatgtaagtttataagtgcctgtgtggctactattttccggttctgtgatgtgatgatgatttttttgtcagctcctttgattcattccatactttattacatatgctcataaacattttcttgtctacattgctagagctcagggggaactcgaaggcaaaaatatgcgatgagagtcggatttcgccttgaagaagactaggtgattgctgctgcggctgcgaggtccgctggaacgtagtaaaagtgggagtggggaccgctccgtcctcgatggccaagtccgtaccctcttcttcgtctttattgggttctgcctcatgccatgaactcctgtcccggtttgtgcttgtgcttgtacttgtgcttgtgcttgcgcttctggctttcgtgttggccgagagtaatgcatcccgttcaaagtggtattcttcagcaggtatcatatctgctgggcgtagatccgcgcgctgttgcgtaggaccggcattcgcacttgatcctacgctagaatttcttgagccttcctcggatcgtctggttttcccagtggaagcggtgccactcaaaggcgaatcatatgagtcgttaaccctcttgtttctgtaattgctagcactatactcattttcttcgtagggcctagcgttgccaccttgcatagcataaggaatggaggtccgcggtcccattggatatggatacgacacgtagggtgtcattatgggcttgttcagcatgtgaggtggagggataccgtacggattataatatggtgacattatgtagcgattcatgggcatgtaagggttcatggcgctcatgatgcccgccgagggcatgtgtggtttcccataactattgctgctattattcacttgtatagattgtctagaactggcctttcccaagtattggacacggggctggaacttggaatgctgagtaacttgtgcgggcgcgcttttcacgttttgattagcaacaggaggaaaatgtgcagagttagacgaagccaagttgccgtccttaatattaccaccgtgtgtattagtgttgctatccgataaattcaaaggcgccgggactctgcccctcttcaatgatttcttcggattcttcaatggttgggctttcctcttcttcgcagtggctgtctcagaatcctcatgatctgcttccttgtcaccagagtcatcctcctcagggacatgctctagctccgactcctgaccaacgctgtttccgcctggcgaattcttaatgttgctatcgctgctgcccttagcatttgctacactgatttctgtatcaccaattggatcttgtgttgatttagcaatggatgtatcctcggcagtcgttctcaaacgggctgatacggccattctcactttctattttcttctttgagaaacaataccaaaatttgttactgatttgattctttttaagtgcgtttcttctgtataagctaaaaaaacgcaaagcacaaagcggaaaaactaaacctaataaacttcccccagcgagaaacagatgtaaagaacaaccgtatcaagtggcgaagcagctgcttataagtaaagcccaaggcccaccaacgcatacatgcaaggcctgtgcaagccgactgctgcttgtttcatcttccgctcgcggtgacccactcggggaatttctcacgcttgctgctgcaggtcgttgggcgttgattcctgtttttttctttcgttttttcaatccgcgggagtgagacatgattagtgtagtccttgtagagttccttatttatttttttattagttttcttgttttcgtttatcagcagggtttggttgtgttgcttggcagcccgcaaattggtcttccctccttgttattgtattttctgttattagagcatacagaacatagaaactcaagatcagatacagtttttgcacgccatgtctcaaggtactttatatgctaacttcagaattagaacttgggtcccaagaggtcttgtcaaggctttgaagctggacgttaaggttgttacgccagatgccgccgctgaacagttcgcaagggactttcccttgaagaaggttccggctttcgtgggtccaaagggttacaagctaaccgaggcaatggcgattaactattatttagtaaagctttcacaggacgacaagatgaagactcaacttttaggtgccgacgatgacttaaatgcccaagcgcaaatcatcagatggcaatctttggccaacagtgatctgtgcatccagattgccaacaccatcgttcccttgaagggcggcgccccctacaacaagaagagcgttgattctgcgatggacgctgttgacaagatcgtcgacatcttcgagaacagattgaaaaactacacctatttggctacggaaaacatctccttggccgacttggtggctgcctcgattttcaccagatactttgaaagcctgttcggtactgaatggagagctcaacatccagccatcgtgagatggttcaacaccgttagagcctcacccttcttgaaggatgaatacaaggatttcaagttcgctgacaagccattgagtccccctcaaaagaagaaggaaaagaaggccccagccgccgctcccgccgcttcgaagaagaaggaggaagccaagccagctgctaccgaaactgaaacttcttccaagaaaccaaagcacccattagaattattgggcaagtcaactttcgttttggatgactggaagagaaagtactccaatgaagacaccagaccagttgctttaccttggttttgggagcactacaacccagaagagtattccctgtggaaagtcacctacaagtacaacgatgaattgactttgactttcatgtccaacaacttggtcggtggtttcttcaacagattgtccgcctctaccaagtacatgttcggttgtctggtagtctacggtgaaaacaacaacaacggtattgttggtgcagttatggttaggggccaagattacgttccagctttcgatgtcgcaccagattgggaatcttacgactatgcaaagttggatccaactaacgacgacgacaaagaattcatcaataacatgtgggcctgggataagccagtttccgtcaatggcgaaccaaaggaaattgttgacggtaaggtcttaaaataatctcttcgtactatccttcatgtcgccttttattataaagtatgctaggtagttttatctatatcttatttatgacgcaatatagggtaacagagtttttctgctctgaaacttccgcagaaaaaaaatcaagttttccttttcgtatcttggattattgttatataatagatgcatgtattatatgtatagcagtgatttgcttattttcttgattctgaggaatcgaagaagtaacttagcgtttcttccgttgagcagagcagtataataatccttcaaattctttaggttacggggttttcctgttgcgatgaccgaagaaactattactatagattctatttcaaatgggatactgaataacctgttaaccacattgatccaggacattgtagctcgggaaaccactcaacaacaattgctgaagacaagatatccggatcttcgcagttattatttcgacccgaacggatctctcgatattaatggactacagaagcaacaagagtcctctcagtatattcactgtgagaattgtggcagggatgtgtccgcaaacagactagcagctcatttacagagatgtttgagtaggggtgctagacgttgacactaggtggtggtttatgggtaattgaaaaggcacagacagattttagcccatttcttgtgggcataggttcataaaaaaagcaagattcttacattttatgcggcatatctgcacatagaagttcatgtagttatgtggtaacatctcaaagagagaaggcgaaaactgttttagctattaactacatgtttttataatagcacctcccatatatgatgccaaatgataccttgcattccgttatgtggaagggttacacataagtacgctataacaatgcattcaattttctacatatcagagtaatatgctgcaacatcacacccatataatataattttttgaaagagttcctaactcttttttgtttttcctgtacctatatactcaaatagtccgccgcaagtagcagctctaacgacatttctgtcggtatttcaaactctggaatctcatcatcgtcctcgctaacgccgctgtacttcaaattataatttaaatattccacagccttttctagaatatgcgagtcaaactgcttgagctctattcggcctttgctttccctgaagggtccctcaatcatagcttttaacgtcggtgaaatcatcgcagcagatcgtgatatctcatattccttatcatcttttgatactaacgtaacgaaatcttgagacatttagttatggttttttattcataaatttctgacaaaagcaaacaataggaagagtttgttctacctttgtctgttttcgacttacttgtgcttcctttttttttttacttcttgattttccacttctttttttttgattttgggaacgtacaataaggcaccaaatagtaatatcgctattaaagtcagcgtaaataccaaacctatatccctaatgattataagcaatcgtctccatatcaatcaatagaggaaaaaaggagagaaaggaatagtacagacggataggcctcccttttgtttcgcactaataaaaatgaaaaaccctagcttcgactgggaaagattgaaagacgtattttatagaagcagagccattggcgaattaaaatggccaactcagtacgaggagttcaaatgtgccttgtcattaactgttatcgcggttgaaattcaagactttatacaagtatacaattattttgggcagctgttaggcaagataaatttgcaaagaattcatgaggatataataaagtttgagttcgataaagacgagaagctgatattggtcacgaaaagctccatcaaaattgtgaaaggttggtcgccactgacgatagaaagtgtcccattacaggacccaaccattgatactatctgggactatcacaatggaatcatgttgttagcaaaatctcgtgatatatacaagttaaacggaaatgaatgggaacttctttacgagaacaaagataaaaaatataatttattgacaaaaaaccactggagttgcaatgatgactccatcattttactggatgttgatcatgtatatcaagtaagcacctcgaacggggcactattgaagttaatcacagattcgtcgtggcacaaggtaacgatctcatctagaggatttatttgcctttataatatgaaggacaataaactgcagattttcagagatccagcaagaatactaatggaacacaacttggattctacaccagatgatatatgttggtgtggcaatgataccgttgcttgttctttcgaggacgaaatcaaattatacggcccagatggtttgtatgtaacattttggtacccttttactgtaactaacctaagggcagaggttgatgggttgaaggttattaccactgaaaagatttactttctatccagggtacaacctcagacttctaatatatttagaattggctcaaccgagcctggtgcaatgcttgttgactcatttagtttactggaggatcatgcacccaaagcaattgaaatattaaagaattttgtcttagagaagggtgtactggactgtattgctgctgcaatagacgaatttgaacctaaactacagaagatgttgttgaacgctgcatcttatggaaaagcttctttgcagtacaagtcatttgacgctagtatatttgtgaatgcgtgtaatacgataaaattattaaactgcttcagaagttttggtatttttttgactgtggaggaatacaggtgtatttctttgaaaggtgtcattgataggctgttgaagtatcacagatattatgagtgcatacagatatgcaaattggccaatgaacgatttctgttaggatacgtgtttactgagtgggcaaaggataaaatcaagggtagtcctgacatggaagatgatgagttactagacaaaatcaaatctcgactaagtgttatagatatgacggatacattacaaatggtagcagttgcgaaagttgcatatcttgaaggaaggttccagttatcccgtaatttagctttattagagaaaaacgaagaagctagaattgagcaactgtataatcttgatgatgatagtatagcgctaaaggagtgtatcaaagtacaaaattacagtctgacaatttcattactgattgcactttccaaaaagctgacaaactctcaactgacgaagcttttgatcattgatatgttcaacaatcccttatatctctattatatgagaatggataaagcatacttgtacgatttttaccgccaaactgaccgatttattgacttggctcacgtattactgcagcagggaaaagaacagcaatctttacacagctttttaccgcaaattaaggacctttatagccaagttcaaaacagtgaagtggtcaacaatacaatagaacaacttcaaagacaggaaaagttgtggatataccaagaatcattaggcaaaagatttgctatatcattcactaatatgactttagatcaaacgctttcgaagttaatagaaacagggcaagataaacaggtgaaagaaatagttaaaaagttcaaaataagcgaaaaaaagctgtatcacctgaaatgtaaaacgttagtcgaagctaagaagtttgacgaactactacagtttgctcagtcgcggaaatcaccaattggttacatgcctttctacacatacttaaaaagcagaggccatatggataaagctagtccttatgttaatatgatacctggcctttcgtatcaggaaaagaaaaagctttatgtggagtgcaggggttttcgtgatgcaattcaactagcaggaaaggaaaaagacattccaggcttaaaggagatatataatattataccacctaatgagccggaattaaaggcattagcaaatgaaactatgagcaggatatagaactcataatttatagacgttgtggatatctagccgcatatcaaataattaaatgctgccattacgtttgtgcggttatatatgttggctccctatagggttacccatggaacggcgaaggaaaaaaaaaataattttcactgaaaaatttcaagagtctatctcatctcatcgtttattctgaattaaatactacatacaaaatctttttattagtaaaatagtgagatttcttcgtgaactagtgaaaagctatcaatattaccaatctaccaaagtgagatggaagaaacaatagaaaatgttgaagtgccttctagtaatgtctcaaaacaaaatgacgacggcctagatatgaagactttgtttgtgaggtctataccccaggatgtcacagatgagcagctggcagatttcttttccaattttgctccgatcaagcatgcggtagttgttaaggacacgaataaaaggtccaggggcttcgggttcgttagttttgctgtagaggatgacacaaaagaagccctagctaaggccagaaagaccaaatttaacggacatatcttgagggtagacattgctaaaagaagagatcgttcaaagaaaacatcagaagtggttgaaaagagcacacctgagtcatctgagaaaataacgggccagaacaatgaagatgaggacgatgctgatggtgaagactccatgctaaaaggtaaaccgaaattaattatcagaaatatgccatggagttgtcgtgatccagttaaattgaaaaagatctttggtagatatggtaccgtcgtggaggctaccattccaaggaagcgtgatggtaaattgtgtggatttgcgtttgttactatgaagaaaatcagtaattgtagaattgctttggaaaacaccaaagacttgaaaattgatggtagaaaggtggctgttgattttgctgttcaaaaaaacagatgggaagattacaaaaaagcccagccagaaatgaatgacaaagatgataacgagtcaggaaatgaagatgctgaagaaaaccatgacgacgaagaagatgaaaatgaagaggaagatagacaagtagatcaagcttcaaaaaacaaagaatcgaaacgtaaagcacaaaacaaaagggaagatttttctgtttttgttcgtaacgtcccttatgatgccactgaagaatctttggctccgcacttcagtaaatttggcagcgttaaatacgcattacctgttatcgataagtctacggggttggctaaaggtacggcctttgtagccttcaaagaccaatatacatataacgagtgtatcaaaaatgcgcctgcggctggctctacctctttattgataggtgatgatgtcatgcctgagtatgtgtatgaaggtcgtgttctgtccattactccaacgttagtaagagaggatgctggaagaatggcagaaaagaacgccgccaaaagaaaggaggccctaggtaaagcgccaggcgaaaaagatagacgtaacttatatttgctgaatgaaggtagagttgttgaaggctcaaaaatggctgatttgttaaccaacactgacatggagatcagagaaaaatcttacaaattaagagtggagcaactgaaaaagaacccatctttgcatttgtcgatgactaggttggctatcagaaatcttcctagagcaatgaatgataaagcattaaaggcgttagctcgtaaagctgtcgtggaatttgctacagaagttaaaaataaggaaagacatccattgagtaaagaagagattatcagatctacaaaggaaaaatacaagttcatgggtccagatgagattgaagctcaaaaaaagaaagacaaaaaaagtggtgttgtcaagcaagcaaaagttataatggaagttaaaggatcaactgcgggaagaagtagaggttacggttttgtagaattcagagatcataaaaacgctttgatgggcttaaggtggttgaattgtcatgccgttacctccgatgaaattttagagggtttgaatgatgatgaaaagaaacaagtagacaatgacttaggcaaaggaagacgtctttgtgttgaatttgcgattgagaactctaacgtcgtaaagagaagaagggaacaattgaagcaagcaagaaccaagagaacaagaccagataatgaagatactggagatgtcggagaatccgagaataagaagccaaaaaaagaagaagcaacgacgcccaccaatcccgatgacaaaaagatgggcgatgatataaagagaataatcgggttcaagcgtaagagaaagcacgcaaaaaaatagaggtagaaccatatttataggaatttcgatttgtattctctttacgtatgtacattatttttcaaagagtagatagatgaatctctaacgtactcgaaagcttttatgtcgttattttagtactgttttacgagaagcgcgagaaactctctacatatactgtccagcatctcagtaaatcatactgaaaccttattaccagtatcgctcctagacgttccgtttgaagtaataggcaagacgagaattatttatttcccatgatatacataatggttataagtagaccgcaaataaaagtatgtaaaattagctatgtttctacattgtttgtgcaatgacttttaggttcggctggtcattaataactaggtgatgctgaattcacgtatcttattagatacatttagaattcatgacttctcctttgtatgagcgtgtccctccttttcttgatggtttcagcccttctacatactacacaatgtactttgttaaccgatgataactctactttatacgtagtttagactttgaacgggatgaactggttgtttcatccaatgttttcgtaaagtcattcttttttatggaaaatgtacaaagttgtttatattttttgctatggttattaacctgaataccattaacagatgtgttataatgggaacatattactattgccgataagttacgaacaaacctactactaccattatataaaaattaaggggggtacttgaagtcttttctttcttcttttttgggaatgcatgagatattcatatgttttaaagccccattagttgagatgaattatgacgaaattcgcatacatctgcggagaacagggttttagctcgacctaaaatcaacccattattttacctgaatgttgcagacttgcattcttagtgcctctaaagcgaaaaattgaaactgtatgccgatttaaatactataaagataaaaaaaagtttaatgaatataatagtgacagtgctgtggaatgaaaaattccaaatatatataaaaatagaagcctatcttctgtttttctttcgagatggctcatctgatgcattgtttcctgacaccgcagcagcggctgctgctgccgcggccagaattctacggttaacaccaagcccacctaacgcatttgcagcggcacctgcggtgattcctgaagcttgtgtattgtttttcgttcttgatccaagattcatgatgtcattatcgttcgtgtgaattcttcttgccgggtatttgtaagttagaccttcaaatacattttcactaacaggaatatcactttctgtgaagtacttatgttccaacgcattaaatgcatctattcttttaattggatcataatttaacaagtggtaaagtaagcttaaagcatgcttgtcccttcctcccgcggaatgataccatgtagcaaggttatccctatactttggaaacttcgtaatttgatcatattctggatacttctccaaataaggccaaattttttgatcgggagtgccaagaacttccaaaattctctgtagttgattcacttgaaatggaacagtctttttagagtctagtttagcttcttcacctttaaatatgggctgtaatcctatcagttctgcaaaaatgcagccaacggaccataaatcaaccgcaggggtatagtgccgtgctcccaatagcaactcaggtgcacggtaccatatagtgacaaccactttatccccagtatagagggtttgcagcatattatgaaattttctggccaaacctaaatcaccaattttaacacatccatctatggtcaccattatatttgcgggtttcaaatctcgatgaagcacccaattttgatgaagatacgatacgccgtctaaaagctgccacataatagaccgaaccattcttggtggtatcatccttttttcgggatgggaatggaagtggataatttgtagcagatcatgctccgcatattcgtataccatatggacacatttcctttccaaaaaaatttccactaatgtggttaaatgcttgttgtgcaattctcgacataatgccatttctctacaggcactctgagatattcccgtataatgcaattgttcgacgccatccttctctgtcttgaactttttaatggcataaaataccgtcagcggttttttaatgagggtttgtttttgggaattatagtgcggggatacatcttccctcgtagttcgtattcttccgggggtcactccttcatcctttaacaagtttcttcttaatgcgtttgtatttgcctgcatgtccattgaagagcttgattttggttgcgtgctgtcaaactgcggaattttcgcattggtaccattcagactagaaccattagcggaattggtaccggagttgatttgtcttttcgctttgtaaactttaccatatgtgcccgcagcaatgtagccaataacttcgtacttttctaagacagatacccgcattctatcttttcttgccctataaggtccaatagtaaaaacatcattattggccattagcatcggggcttttccatgcacacttccgattgtgtttttctttccaacgaacgattgagcttgctgttgtccttgtacctgcataggcctttggtacattggctgataggagttttgtgctctatccttgccattatacatttctctctcctcccgtcaaaactaggcggccttaattcaattgggaagcaaaattactaacttcagtatacccttccgccttttttctttcctataaacctttcttgtatcctttttgtcagcagtgattgtgggataactttcaagtattgaagcgggaaaatgaaacgcaacttaagccacaccacgtaattcttgaagacttttgatgtatgatatttatttcactgttaaaaaaagctataatttcctctaatcaaaactctctaaaacgaaatcaaaaatattcgtaacacatatataacgaagtacaatatattgggaatctataaatcatatgccgagtgcgcaacttcaactgaaaacaataatccgtctctgggccagaaaaaaaaaaggaaaaaaaagctttatttcttaataaggtgctttaatttttgaaagggaagaagcaaccatttcccaaaatatggtgctccccagatactaatgaaaatgcgtaccggatatagtaattttactgtaacgtaggctactgtgccagataaaatcaacttgtttttgttgaggcattcctgatatctcttaccaacaaatttctccatagctgtatgacagctatccattaggccatttaagaagtttgggagcttaaaatcatcagaaagatcgaggttataaagtaaccaccatagtagaaacagtggtagtatggcagttacctcatgcaagatgaagaatgatgtaagtgttggaaccgtgccggcctcactgaggcggtcgaaatagtgtgaaaatttaggattcttgtttaaccttgttaaaagtcgtgacttggaaaatattttacgtagtctatcctcccttcttttcactggatctaaatttcccgatatgaatctaatttgggttgatccgccgggcctggtgttcataaacgtggtcaattgcgttggccttttaagcatgagctccaacggtccagagcccatctgcagttgacagggcctgaagaaaagattcatgacagtcatgttcctggtgagggtgccttgggtgtaacacttatccttacacggtctctcaaaagcaatatttttacatttctcttctttgcttcctgttcgtataacgcgctgagagctggtaagaacaataggccgaggccctgcatcaaaatgtcagtaggggacctgttaggtacccactaataagtacaagagggtttttattttctaagagccaataattggcattctttatatacaggaaaggtacatgtcattcaagacatgagatgatccacagcttctttacatctgtcacacaatttatcctcttcggctgagttggccttccaacatctgggacagttgtgccttttgcttcgttcaaccaatatttgaacgtttattccgcttcccaattcaatagttggtagactgttattattatcgtccatttgcaatatatcaacagcagatgattgcaatatgtcgcaaagctcgtcagaactgaatgggaggtgatgcttggtgaaaatggtaacgtgactatgtgttgttttggtgacaccttcttctagacttaacctcttgaattcctcctggaactgttttagaatttttagttcaaagttttcaaaggaggtgacgatttccgtatttgagtccaaaaacggccattttccacgcatcggattaatgtctatatgttcttgtccttgtaaccatccttctggtatatacttccatacttcttggaccataacgggtaatattggtgcaagaattgccctatatgcatttagtatatggacaagcgttgtttggacctgccttcttgccaatgacgatatttggttggaatataaaatatcctttgagatatcaaaataaaacgccgatagctcgttatttaaatgatattgtagagtaatgagaaccttggaaaagttgtacttttggtagtgttctctcgtcgtttccagcagttcgtttatcttatacaaggtatattgatcaacacggcgtaattgttcaatcggcaaaaggttgaaatcttgggacttctgtaaattactcaataaatagcgaaaagttagtctaaccttttttagagcttctcctacatgtttcatcacagtcgggccagcaactatatcagttgtgaaattcgattgtgctatcagatacctcaagccatcaacacccaaagctggtaagcctaagttttcatcgcctcgaattattgcttcgggagaaattgtatttcccacagattttgacattttcagaccattctcatctagggtaaaaccatgagtaatcacttcttcatatggtgcaacagggacattacttgatgctacttttgttagcagtgaactttgaaaccatcctctatgttgatcagatccttctagacaaacttggtacaggggggatgggagttttgacaactttaagcttttttcataaaagtctttgatcacactccatgacgacccactatcaaaccacacatccatagtatcttgagaacgacagtattcatgcgctacgtcgtgatatttttctggcaaccattctttcatgtcattatctttatcgttaaaccatgcattaattcctttttgtttgattttttctatggcatgtgccaaaatttctgaattcatcaaaacagaatccggttcgctcttcttgtaaaagcttaatatagggataccccatgagcgttgcctagatatgcaccattcatttctgcttttcataaaggatgaaagtcttgaatagcctcttttaggacaaaacttgacgcggctgatgctttccagagccaagttttttacatcgtgtaaatctgcaaaccactgtggagtagctcttattatgacaggtttcttggatctccagtcgtacggataagaatgcgtgtattcgtgagatttgtaaagtaaattaaggtcgcttaacttacatagaatgattttcgcggtttcggcatccaatacttgcctaccttttgttaagtctccttcatctctcacgatggatctgacggactgaggaagttcatttaattggtagcggccctggtgatccacgggagaataaatttcaagaccattttgaataccaatgagatagtcatcctgtccatgccctggtgctgtatgaaccaatccagtccctgtaccgctggtaacgtgtgcaccatgtaataagggcctgccaaccttatcgtctactaagaggttttgataatatagcccatttagatgagttccttgaaactgtttgatagtctcaaatgagttagttgttaggcccaatttatcaatggagccggtctctacaaggataagttcactatttaagcgtaatagggagtaggaaaaatcctgattgaaacagattgctcgattagagagaagagtccatggagtactggtccaaatcaaacagtatataggcaagttattcgttattcctagttttttgcacagatccatctgggatttcttttcaagaggaaatttaacataagcagcgatggatttatggttttcattatattctaattcgccctctgctaacgctgttctagtttctgtaccccagtaaaccggtttgttctgtctcttaatcagtcctctttcgtacatttctttaaaaatatttagctgattaatttcatagtctttatccattgttaggtatggtgtttcccagtccgttaagatggcaaaatgttggaaagtttccctttgcctcttgattgccttttgtgcatgttttaaagccattgacctgatttttaaaggcgatattgactcgatctgttgcgcgcttaaatctttcaaagctttaatctcgatgggtagtccatgacaatcccagccaggcttataaaaaatgtacttcccctgtgaaagttgatatctgtttatgatatctttcagaattttatttagagcatgaccgagatggagctcgccgttggcatagggcggtccatcatgtaagatgaacaacttttctttaatgaactctaatttttcatcagtcgtattaagctttgaaaattcttcgaagaaatcacgtagctgctccttgtaaactaactgcgaagattttggtattaattccctcaatgtaatctctaagtttgatctattagggaatttggtcttgggcaagtttaatgttttttggtaggcatgtttggcgagatatcgcttgctaataatgctaaagatatgttgaggcacaagcctggagcgcttcataagtagctaaagatcgttcttagtatactgtgttccataacttctagccttggtcctttatatttgctgtttttctgcgtttcttaactcgcttgcggaaaaagaatcgacattttcagaacaggattttattgtttttaaagtacattatatggggcgacacatcatcgccatctatgttaaatatttaaagaatacggggtagaattattcacgctgggggatgctgaaagaggagtataatttgagcggtgctgataacatggcatctgctgagttgtcatttaaaaagcaaaaagtggtattgaaaaagttcatgatagcgcaagtgactaaggggattatgcagcggtatgcgagcctattagttaccatgcctagtgatgatgacaatgcaattattggcacaaatcatttgaaaacaaccaaatttttagaaataatcctacacagagccaaatcatcgcatttacagttcaaaaaggtctgttgcattgtcatcaagtttctagattgctgctcgaaggaaactaactacatgaagtttttaaagttcagcttacacaaactatttgtagctgctttcatcttaagtgtgccaaatgttgtaggcgatgaccgcgacaggattaccacgagggatgaaacctatcatctctattcccagataacaggcttgccactggaagaagtgataaattgttgttctattgtgaggcctgtacttattcggcggagtagacaacaacgcaggcaaatgttatctcgacgtgaacaacattcgtacttcctcagaagttcttttatgaactccaattcatcagcatcaccttttttctctaccaataggtcagctgatgatctacatgtacatacaagggcatactcgcttcatagccattccgatggggaaggccaagataggcggtcggaacatgaagaaacgcatagcatgggggctgatgccgatacatatcgacaaactacgtttatcccagacacaccaaatggtttgcattctagatcattaattgagtgtgggatcgaacccacccaagtaagtgactctggtgaatggtcgggtcaaagtaacggatatgttttggtgacagaattacaggagtttaacaaaatgggtaaaaagttagtacaagaagcttttaggatagtttaataaagtatggtttgtcgttttgttcatcattcaagggtcatttttatttccatttatgatttcttgagtacaaaaggcaaaaaaaacatgtataattatacacaagaaaaaaaaacaaaacaaaagaacactttcacacaagcaagtatatattatgagaattttttcgagtcttacagaaccatatcttgcctctaaattttagtctaaaaattttgctagcccatcaattttttttttgttctaatgcaaaatataacatgggtaagaaaaagaaaaagccgttcctcagtacgtaaagagatttgatcattaacaagttgggctcaatatacacagtcgatagtctatatgtgcatatgaaactggcgcaagacatgaatgtagatgaaatatttctcaaacaagcggcagaagctatagcggtaatctcatcaagtcccactcatacggaccccataatacgagagctactccacagaattcgacaatccagcccattgagcgcagttataccagcaccagaaaatgttttaaaggctggggagccggaaaatatggctagaggtcttataaggattccagaaacacaaacaaaaagaacaggaggtaacaaccatagcaaggaaggcgcacagctctacagctgtgcgaaatgtcagttgaaattcagcagaagttctgatctgagaagacatgaaaaggtacactcactcgtgctgccgcatatttgctcaaactgtggcaaagggtttgccaggaaggatgctctaaaaagacattctaacacactgacctgtcaaagaaacagaaagaaactaagtgaaggttcagacgttgatgtagatgagctcatcaaggatgcgataaagaatggtaccggcctgttgtaaggctagaggaaaacgtatttgtctccatcagcacacctacacatacatatatagatagatatatactttagccattgagataagtagaataaaaaaacgttgtaatattccgatacagttagtgacatgttctctacttttgccaattttttgcgcacaaagtggtgacgtacaagttcatcatttcacgtgtgcagcatagtgtggtatattgtttttttatattttattttttatttttttttttttgcagaaaacagtgtttgtattatatgctttagatatgctaaaaaaaatgaaaaaaaatggaacaaaatatgtgtttttttatttaacgttaaaattaaagattaagttatttattcgacgtcagcatcaaaagtttgaccttcaactaactctggaatagcttcatccttcttttcagcatcagctggagccttggcttcgtgcttttccatttgggcagccaattgagacaaggcttggatggcttcagggcccaattgagagataatacctgggaacaaatcttgcaagttcttttcctgtggtagaccgtagaatacagaagtgttgtgttgagcagcaacttggacaccgaccttgttgaagtgcatgaccttaccgtcgtccttgaaaaagttggcttcggcgacgttgtcaatggtgacagcgtgcaacttagctaattgactttgcaacttggtgtcatccttgttggcaccggcagaagagcctgccttcttgttaagctttcttctagtaccaccaactttgttgttagcagacaacttttgtagcttagctaatttttcttggtcaattggcattatgaattatgagtcgcgtctggtgtgagatgttctattcttaaacctccctagaaagaatattcgctctcttgtgacaaaggaggggttactacttaacaagcaattgcagctgtttccactacgaaatcttccaatgtcaacgaaaaaaattcaaaaattttctgctttttttttcaacatctgccgtactaaatgattccacaataatccatcatataccattaccctgattcccatcgaagaaaaggcggtgtccccttacccgtccgctcatgccaagagattaattcataaccgctcttccttggatcagaagtgaacatatgaagttgcaactactacatacttactaccgtagtccatcatcaaggacccaaacattcacgactccagcgcgccacgttcttcgccatactgcttaacattttggtacgagtgcgaattagggaagtcgatgataaaatagaatatgcgaaaaagaggaagagcagccgtgagaaaaaagaaaaaaaaaggcctaaggtattctctactccaaaatcgtcgagggagggcaaaagaaattttttttgtttaagggaattgcgaagtcaattgattgatgaagtagcttctctggaaaaatggcggacagacgctgctcaaataaccgtcgaagggggaaaggttatcggtggaaacatatttgtaagtacataatagtgaatttacttcttgtcggcgtcccctaaacgtaattggcggtgtgatggtacttcgttatataaaggtgtgtaatatcctcttttaccatctattatttcttccagcatttcttgctggataacctactgtatccaagctactgggcttttttaaacatacccataacttttttttttttcatttttcgttgctgtgtgctagtacaatttaagcaaaaggaaactgttttgcgttatgtcttccactgaagcaaagcaatacaaggagaaaccctcgaaagagtacctccatgccagtgatggcgatgaccctgcaaataattctgccgcttcttcgtcatcttcgtcttctacatcaacttccgcctcgtcatcggctgcagccgttccacggaaggccgcagccgcttctgccgctgatgattctgactcagatgaagatatagaccaattgattgatgaactacaatctaactacggtgagggtgatgaatctggtgaagaagaagtacgtactgatggggtgcacgctggccaaagggttgttcctgaaaaggacctttctacggaccctgcgtatggtttgacttcggatgaagtcgccaggagaagaaagaaatatgggttaaatcaaatggctgaggagaatgaatcgttgattgtgaagtttttgatgttcttcgtagggcctattcaattcgttatggaggctgctgctattttggctgccggtttgtctgattgggttgatgtcggtgtcatctgtgctttactgctattaaacgcatctgtcggatttattcaagaattccaggcaggttccatcgtagacgagctgaaaaagacgttggccaatactgcaacagttattagagatggccaattgatcgaaattccggctaatgaggtagttcctggtgagattttgcaattggaaagtggcacaattgctcccgcagatggtcgtattgtcactgaagactgttttttgcagatcgatcaatcggccatcactggtgaatccttagccgctgaaaagcattacggtgatgaggtgttctcctcatccactgtgaaaaccggcgaggcttttatggttgttactgccactggtgacaataccttcgtcggtagggctgccgccttagtggggcaggcttccggtgtagagggccatttcactgaagtattgaatggaattggtattatcttacttgttctagttatcgctactttgttgttggtctggaccgcatgtttctatagaacggtcggtattgtaagcattttgagatatactttgggtataaccatcattggtgtcccagtcggtttgccagcagttgttaccacgaccatggctgtcggtgcagcttacttggctaagaagcaagccattgttcaaaagttatctgctattgaatcccttgctggtgttgagattttatgttctgacaagactggtactttaaccaaaaacaagttatctttacacgaaccctacactgtcgaaggcgtttctccggacgacttgatgttgaccgcttgtttagctgcctctagaaagaagaaaggtttggatgctattgataaggcttttttgaagtcattgattgagtatccaaaagctaaagacgccctgaccaagtacaaagttttggaattccatccgttcgaccctgtctcaaaaaaggttaccgctgttgtagaatccccagaaggtgaaagaattgtttgtgtcaagggagccccattgtttgtcttgaagactgttgaagaagatcacccaattccggaagatgtgcatgaaaactacgaaaataaggttgctgaactagcttctagaggtttccgtgctttaggtgttgctagaaagagaggggaaggtcactgggaaatcttgggtgttatgccatgtatggacccccctagagatgacaccgctcaaacaatcaatgaggccagaaaccttggtttgagaatcaagatgttaaccggtgacgctgttggtatcgcgaaagaaacgtgtaggcaattaggacttggtacaaacatttataacgcagaaaggttaggtctgggaggtggaggtgatatgcctggttcagagttggctgattttgttgaaaatgccgatggtttcgcagaagttttcccacagcataaatacagagtcgttgaaatcttgcaaaacagaggttacttggttgctatgactggtgatggtgttaacgatgccccatctttgaagaaggctgatactggtattgctgtcgaaggtgctaccgatgctgccagatcagccgctgatattgttttcttggcccctggtctctctgctattattgatgccttaaagacttctagacagattttccacagaatgtactcctatgttgtttatcgtattgccctatccttacatttggagattttcctgggtttatggattgctattttaaacaactctttggatatcaatttgatcgtttttattgctattttcgcagacgttgccactttaactattgcttatgacaatgctccttatgctcctgaacctgtgaaatggaacctaccaagattatggggtatgtctattattttgggcatagttttagctataggttcttggattactttaaccaccatgttcttgcctaatggtggtattatccaaaattttggtgccatgaatggtgtcatgttcctgcagatttcactaactgaaaattggttaatttttgtcactagagctgctggcccattctggtcttccattccatcgtggcagttagccggtgccgttttcgccgttgatattattgctaccatgtttaccttatttggctggtggtctgaaaactggactgatattgtgtcagtcgttcgtgtctggatttggtccattggtattttttgtgtattgggaggattttactatattatgtccacgtctcaagcctttgataggttgatgaatggtaagtcattaaaggaaaagaagtctacaagaagtgtcgaagatttcatggctgctatgcaaagagtttctactcaacacgaaaaaagcagttagtaattttaaacatcatccatctgattttttttcttattgatctcctttttgttattcctcattttcatttcaatttgtcgataccaaggaagccaagacgttataaaagaacacggtcaacaaaaatcaaattaatgcctcttcaattgtgctctgtttgataccttcgatatgatgttacagttttaaagtttacacacaagtttttagactaagtggcatcatatctgtcaattttatcacacacacacacacacacacacacaaacaaacatatccacatatcagaagtaggccgatcttttgcttgattggatgcaaattcatatggaaaatttttttcatattatttcgtgttcttttgactattttcctctccaaaaaggaagaatcattccaataacaacacacgaattcccatccaacatggtgaaatgactaaatattttttttttcgaaacattaaatcaatctaattcttaatttttaataaacatataatgcacacttatttacatacaagcacattgcacgtattatatcagtttcttcttttatgttgatatatttttctaataatgttattatcatgtagtcgtgtatgtgcgcctctcccgcgagaagtccaacaccataagaaatcaaatgtcaagagaaataaagaattgtttcccatcatagataagactatatcagaaaagtgctcatcaaagctaaatctattatgagatgtcttaggcataacaaaaaagggagagcggtgcaagataaacataccgtcggataaaaagtactgtcattatcatcagtggcaagatgcaaggtacacacgggcaccaagagataatgcgcaaaataaaccgggttttatttacatctatacatacagtaacctctttgaatcatacatatctgaaaagacggtagatttaaaatggctatttattgatgagtcaatagttcggactaatggtaaaaagaagagacaatgggtagacagagactttattctatgtaagataggaatgaccactcgaaaaacagtagattcaagacttttagaatggcaaaccacatgcaagcatccagtgataaacttgactccagagaaagtcgataaattataccacttgaaattgaaaagtgaaagcaaaaatatcagttcaaacaggctattgcccatttcattatcaagcttacaaaaaaaaatggagaaacttttcatcaaagataaaagtcactcacacaagccttcccttccagatcctaaggtgccaaccctacgcacttataaagatggtggatttttcattagcggaaaaggttcaatgaaactaccagatatcgaaagcgctattcataaatttttatggaagaaatacgggaaaggattggtttactgttatgggtgtgatccaactggaaaaaagaggcatacagagtggttcaatgtgcctgtattggagctaccatcagtactaagacttattgattcttattgccttggaggagaatctcgttagacttaaaaaaaattttttggcctattctggccggtttattcaaattatttatcatcataaaaattgtagtgttacctttcttttccttgaattatttatagaaatatatgtgcttagcaattttatcactgttacttcgatttgtagtacccttaagtaaaagagcttttgaaaccagttatcaaaagaatatcaccaattgatcttttgctttcgagaattgtatcaccatatcttccctcaagtagacagtggacgagatgtttcgagatactcggggaaagtctcttccaatgtgcttcactttcaaaactgggtaaatatgcaatcagcgtttttacattcaaattactatctttcaatttaagctctgaggttattccatcgtggaaagagtttataccacatttcgatgtaataaaatgtgttcctgatttgcacggttttaacgtcaataccgatgatatgttgacaatatagaacccctttgctttttcttgagcttcagcttgaacctttggaaaaatgttactcaagcagaacttagttatcaatattacactttgtaaattatacctcacgattttctcgaattcatttaaagactcttcatcaagtctcaaaaatttgtcttctttgagaagagtcgattcgattccctcctgcatgttgttaatgagcactgtaggaattatttctaaattttgaaggtaaagcatggattcctcaagacattttatgtcactgaaatctttgcaagaaataaaagtatacagtttttcacttctccttgcgttttttccattaatactgtctatagtgtcaatatttataacctttgtatgataatcttctataaatgtctcgcagagctcgatgcctaactcatttgaagaaccgccaataattaatactgtatcgtggctaggatggaactttttacctaaaccgacatattgataaaaacttacgaggactttgtaaattgttttcttcatgtcagatttttgggctctattactagtggacctgtgcttcggacatacgcagtttttctgtggtttctttatacgtcacaaatctgtattattattgagtcactaattcaaatgcgtgtgacaatatagcgacggggccgtgcaaaaataagagatactgcacttgcgcggctgatagagatttctttctttctacgctgggatagttttcttagaaggttttagctattctaattaaaatgttgttcccaccagtatttattggcaccttggacaattttaaaaatcactgctaaaacggtgctatgacacgattttctggtactaaaacgtgttttatgaaattaacagtatatacaaaaagtaaaaggtatggatagttaaatatgtgtaaagctataatacaaagaaataacacaagatagttgagtttatttggtcaaactaaaaagaggaaataattatagtgaataattccagattttgttaaacaccaattcaaacaaactgaaaacagggagaaaccaacccaaaaaataaaatagattcagtgataacccaattctaccgcaaaaaaaaactaaaaaaataaataatagaaaattaacagatacaaaaacgaaaaaacaaactgtttacaaaacatttacatgcgtgttcattaagctgtcgaaggatattatttctttgatttatttttttttttgaataggccaaatctcttcttcttaccaccatttttctcctcattgtcaccattatcggtactaggcgaagccatattcgccatttgacttgatgaggacaaggttggagtgcttggggctgaaacagaggttgtaggagggggtgcaatatttttgggatcgtttatatccacagtgctacttgtattgttgtttgtatttgtaaattgcattgcgttatgaactaccgagttggtggaaatatcagggttgctactactgttattaactttgttgttattatttgtaacttctatcatggtactggagctaaattgcctttgtgtgggaacgtgattgtttaaactaggagcagggacttggttaaaagtattgtttgggttggtggcatgtggcatattcagtttgtttttcgattgttgtgatctcaatctattctggtttacgatgctatgcgttggcatggaatttaagcgagtttgacttgaattgttcggtggtctgccaaaatcactcatatttatactggaaggattaccaatattaggcatattactatttctattcttcctacttgtgggcttgatagagtgtgagtgaaaaggttgtacttgtaccgattgttgtggctgctgtaggggtaaggaaggaggttgttgcgggtcatatgcagcgatacttgaagaaattgggtctacaaaatttccggcggatgcaggttgagacatagcgccattggtgccatgcattcctctgctgttagaacgaacgtttgcagactgctgtaattgagggaaggaaggctttcttggaattgaattattgctattattaaatctttgttgctgtaatgctcttttctggaactccagttcacgttcttgtagctctaattcctttttacggagttgcaattcgcgttcttgtagtaatttgtcattcgtgccattattctctccgaaagtttgtgaatgtgaggataatggtgagttcatttgtggctgagagcttacaacaggtggtggagatctcactggagagtctccgtagtttacactatatagtgccatatcttcgatgtccctcaaattcggagttcctgttgctttatattcatttgtatcggattggtttgttgcttcagttggcgttagtgcttcaattgatgtttgagcttgagattgggcttgagcttgggcttgggcctgggcttttagagcgacttgatgtttctcctttaactcattagtttccatttcatgttgcttggcctgcataagcaactcttgtcttagtttactaatttgaccttgtaaggaggtaatttgagtctgtaaagcagattcatttttttgtgatttttgcaagctttgtaagatttgagttttttcatctgacctaataaaccatttagatttgccactattcaatctttcaaattgggacaaaacagagtataaaaattctaagtacggagttttgataccaaagtcatcggctaataaaatagtttgtaacaacaggatatcgatgttcaaaggcgttgtttgatgaatgaaatgataaaccaatgcaggtggcttattggttgaatgataagaattcttccatagagataaaagagagttttcattatcatgactactgtttagtctggctcccattgtttttgctacagtgatgatttcagttaccagacctgatattaaaggtttggcaatgatctgctggtctagatcacttgggttttcttgttcaaacatgattaacaacggatcaaaacaaattctggaaatcgccagcttccattgttgtgatagaaactcaattgatgagaaattgcacaaattgatttttatgttggaaaacaatttagcaaacagtttttcaaaagtggttaataatgttataacgcctgatgaatatttctcagtgctggacttactttcgccgaggtaaatcgtgttctcctttgcagtactaggaaagtgtttgaaatggtttggaccgatttgacgaatatccaaatcagtcaaaatactgaaaacgtttacatgcggagattccatcgataatttgacaaacggttccaattggatgaaaccactgctttctaagaaaattttggtgttcgaatcgattatggacgttaacttggacgctaacgaggataattcctgtaaagatggagcactcatgatgattatgtcgaagacggcttcacttgatttggagctcaaagcttcagtcaagtgctcgatagaggtgaaatgattttccaattcgaaccggtctttgccgtagtattcagtttcaatttcaaattgacatgattttgaatcgttgacgtggtagaggtctatattcttggccagttgaaaccttgaggtgtagaacaagatattcgggttgttcccaatagctaaaactcgaagtgaggaagacgacataactataacgtgtgtgagggcgagcaaagcaattaaacgaaattgatcttattggtgagcgtcagactgctggagttgtgtgttataaaatgaaagaaaaaaaaaaggaagtaaaaccagggaacgaaccgataactatttctcccctttctgtttgttcttggttttgcttgctttgttctgatcaagaccaaaaatagctgggtggctacgaataagaaggccaagattagaagtgtgttactctcactaattgactgtttaaaaataaataaacaaacaggttcaaagaaacgagaataaacaaacaacgaacgccaacggaaagaaccgacgttgtgtttgcgtttacgttctgctctctcacttgacacaacacgaagaccgaaaacagcttgggaagcattcaccgatcgttattcgagaggtttccagtttccttttttttttttttcactcgcggtataaacgaatgaaaaaaaataaaaaattttcatgtttttccgttccggaagacaaagcctgtccgcctttaaggcggtaaaagccgtcgtaaaggctgtcgtaagatgagactaaagtaatagtagtgtattatagatgattattatcattatatatacatggctacggtttttcgctgacgggctgcgttatgaagcgtggtggtagtactctgcaaaccaagggtgatgcagagcctgcttggcgctcagcctcatatccggattaagttgcaagagtccgtgtaagaaatccatgagattcccgtctagcggttctttggtgtgtggttgcaatacttgacgtaggtctcttggtggtcgttgctggatatttgggttgtatttgggtaactttgttacactgggccatagggactcattaggagtgcccatgatgtcgaagatcaatttcagttgttcttcgtcgttggtgccaggaaacaaaggcttacccgttatcatttccgcaagaatgcacccacacgaccatatatcaatggatgtggagtacgtcctagaacccattagcacatcaggagcacggtaccacaacgttacgacttcgcttgaaaatgtgttgaccggaataccgaaagcacgggccagaccgaaatcacccaatttcaactggcctctcttgttgattaataggttttgaggttttaaatcacggtggagaatcttgttttcatggcaaaaggccagcccttgcagtagttgccactggaagtatttaaccaagtttagttctagccctcttggtgtgttgcccacggtgcgggaatccatgtatttctttaaatcgttgtccatgaattcaaaaaccaaagtcaacttgttctctgtgtgaataacgtcataaagtctaacaatgttctcatgtttcaattctttcattagggagatctcacggatggccgtagagggtgtaccttcctctgaatccagttttacctctttcagggcaacatatacccctgtggttttgttcagtcccttgtacactgtggcatacgtaccattgccaagcttttctaactgcttaaatctgttcatagagctcgaggttgattttttctcgtatatatgttagtattcatcatttctagttctttactttccaatgatacttgactagaaaactacatactgtgaagaagaagacattggtattgctcaagtttgcccagtttgccgcgctatatatcccttatctgcaattatacgctatatggtaaaactggattccctttgttatctttcaattagaaagctacgggcttacgagtctacgtgtatggtgatttgtacggaaaatgaactgcacacagaggacaagcaaagggtctaggatagatagaagtagcgcatccggcctgtctatccctccgtgtctatcaattcatttaacgtgtctggacggactatggtaactactttttgcgtttttgcaccttcttcctgtttttttggttttagtagtgcacttattcttcacttttttgctctgcattgttaaaaatttcattttttgcattttggaaaacccgatgacattattctttgaaataaaccatatcatttagaaaatgcgatttccattacgcaagatagacaacgcatttggtccgattatattgctatcttgtgatacttctcctttctctcaacaatgactggcgacggtagtgcacatatttctaaaaacaatcaaaatcaacacaaagatcgcttcaagtttattgtgaatgataaaagtattctaggacctcaatggttaagcctttaccaaacggatgggaaagtaacattcgcaaagtcccacttcgagcaagcaatgatgaacgttattagagaaccaaatattaactctactgtcatattaagagcggatattttgaaagagatcaatcatgctgcagaagctgggtctgagccaaaatttgacgagtccgtattaaaaaagtttgagatcgataatggtaatgaaagcggtgaagaagatgtcaagaagataaatattgaagatttaaacataaggtcgtgtgaaacatctgagagtttaaaattgtcacccgttcatgaatttgtaagaaggatcattcctaggaatttttacaaagatgctatcataaaccaaacatgtttaatcctaaatagcaaagaccctaattttcaggagacctcattgattgtatatacgccgcacattaactctgagaaagactgtccgttttatattccaagaacgcaaagtgtaggcattttgttacaccagtcagttctttctgtacactacattcccttccccgaggataaaactgcctttacagatgaatctgagcgtgttgtaagaaccgcttataggttattacaaactgctaacaaacactcaaagggtgtgatgcagggttatgaaaagagggtcaatcacgatcaagtggtaaataaagtcaattttcagaacacatacattgttttgaagaaaaaatactccaagttcctggtggagaattgggcagagtctacagacccaaaaaaacatgtttttgaagacatagccattgccgctttcctgattgaattatggattaaagtgtacggtccagacttccgttcaaaaatgcaatttagagatttgggatgcggcaatggtgctctttgttatattttactgagtgaaagtattaaaggtctcggcatagatgcaaggaagcgcaaatcgtggtctatctacccgcctgaagtgcaatcatcgttaaaggagcaagttataataccttctatccttttaagaccccatcctgctttgaaaagacaagtacctcatttggaacacaatgggagatttttcccagtcaaggtgacgcacgaagtgattgcccccgcaaccgtcgtgtattcaagtgaggacttactaaaatctccgcaggtcaatacagcagagttcccaccagatacttttattataggtaaccactcagatgagttgacttgctggatcccattactaggtcatccttatatggttataccttgttgctctcataatttttctggccagagagttcgttttaacgtaaggaaacgttcgcctaggtcaaatgaaatcaaaaaccagaataacagtaagagcacctactctggtttggttgatcacgttgaatatatttcatctcgtgtaggctggaaagtagagaaagagatgttaaggataccaagcacaagaaatgcagccatcataggtgtagaaaatgcaaccttaaagcattttccaacgcaagcagtgtacgatatgatttgggaagacggtggagctgaagggtggattcagaacacaatgtccttattgaaaagaaacccaagaaaccattaaatagatgtatcatctattatttgtatgtgcgttcatttatagactaattagaatatcatacgtacatataagactatacaatttatctaattttttcatttttacttaaaaattgatggtccatcgtaaacagcgttaataatttcttcgcccgatgcatagacaatgagaagccaaaatgcagaaacttgatactttcaaagaaagaggttcaactatgaaaagaaagaagatttaagtgccgatagagtatactagcatggcacttgtcaaatacagcacagttttttttccactccgatcattgcgactgtttgtgtccatcaagaaagcatattaccacagcgagccgcatagcatcgatctatttcatgataaggattggattgtgaaaagacctaaattcctaaatttacccaaaaatgaacattcaaaattagatatattccagtttaattttaacaagtccgaaagcaataatgtgtatttacaggattcatcatttaaagataaccttgataaagcgatgcaatttatctataacgataaattgtcatccttggatgccaagcaagtaccaataaagaatcttgcttggttgaaattaagagattacatatatcaacaactaaaagatccgaaactgcaagccaaaacctatgtaccttcggtaagtgagatcatacatccttcatctcctggcaatttgatttcgttgctgataaattgcaataaaatcagcaatttagtctggaaatctgttctcaaatatagcctgagtaacaatataactacattggataaatttatccacgtcctgcaacagaccttcgaccatgtgtacgagcaggagatactacccatgatgacgaatacagatgatacagatggcgctcacaacgttgacataacaaatccagcagagtggtttccggaggcaagaaagattagaagacatataatcatgcacattgggcccacgaattcaggcaaaacttatagagcgttacagaaattgaaatccgtggaccgtgggtactacgcagggccgttaagactgctagcaagggaagtgtacgatagatttcatgcagaaaagataagatgcaatttactgactggagaggaagttattcgtgatttggatgatagaggaaattcagcagggctgacatcaggcacagtagaaatggtgccaataaatcaaaaatttgacgttgttgttcttgatgaaattcaaatgatgtctgatggggatcgtggctgggcttggacgaacgcgcttttaggtgtcgtttccaaggaggtccatctttgtggtgaaaagagtgttctacctttggttaagagcattgttaaaatgactggcgataaattaacgattaatgaatatgagaggttaggaaagttaagtgttgaagaaaaacctatcaaagatggcatcaaaggtttgcgcaaaggagattgcgtcgttgcgttttcaaagaagaaaatattggatctcaagctaaagatagagaaagacaccaatttgaaagttgctgtaatttatggctctttgccgcctgaaacacgtgttcaacaagccgccctattcaacaatggagagtatgacataatggtagcatcagacgctattggtatgggtttaaacctgtctattgacagagttgtattcacgacaaatatgaaatataatggtgaagaactaatggaaatgacttcttctcaaatcaaacaaataggtggtcgtgcgggaaggttcaaatctagatctgcctccgggggtgttcctcagggttttatcaccagtttcgaatcaaaagttttgaaaagtgtaagaaaagctattgaagcacctgtggagtatttaaaaactgcggttacatggcctacagatgaaatatgtgctcaactaatgacacaattcccaccaggaacgccgaccagtgtcctgctgcagactatttcagatgagctagagaaaagttctgacaacctgttcacgttatctgatttaaagagcaaactgaaagttattggcttattcgagcacatggaagatatcccatttttcgacaagctgaaactaagcaatgcgcccgtgaaggacatgcctatggtcacaaaggcgttcaccaaattttgcgaaacaatagcaaaaaggcatacaagaggcctactgtcataccgattaccttttaacctactggactacaattgcataccgaatgagagttattcattagaggtttatgagtcattgtacaacatcattactctatacttctggctcagcaacaggtacccaaactacttcattgacatggaatctgctaaagatttgaagtatttctgtgagatgattattttcgagaaacttgatcgattaaagaagaatccttacgcacataagccctttggttctacaagaggtcacctctcatcttcgagaagaagattgcgtacataatctacgatatatcctgtaaatagaaacagctacactgcttgaaagccttaacatgatacatttctggtatgatgccattgttgtgccctgccgggtttatcgtttcctaacaggcacgtcacttataacgaggtgcctgtcgtttaccgcccaagccggttttttcgctggagagtacggtactactagcccaccacacgttcgtggccaggttgataggccaccgttgagcaaagggcagtaaaatatataaaagaggaacaagcgcttccattaagagcactgctaagcctactcgttttctagttctctgaaaaaaggtagcctaaaacaagcgccatatcatatatatttatacagattagacgtactcaaaatgtctcagaacgtttacattgtatcgactgccagaaccccaattggttcattccagggttctctatcctccaagacagcagtggaattgggtgctgttgctttaaaaggcgccttggctaaggttccagaattggatgcatccaaggattttgacgaaattatttttggtaacgttctttctgccaatttgggccaagctccggccagacaagttgctttggctgccggtttgagtaatcatatcgttgcaagcacagttaacaaggtctgtgcatccgctatgaaggcaatcattttgggtgctcaatccatcaaatgtggtaatgctgatgttgtcgtagctggtggttgtgaatctatgactaacgcaccatactacatgccagcagcccgtgcgggtgccaaatttggccaaactgttcttgttgatggtgtcgaaagagatgggttgaacgatgcgtacgatggtctagccatgggtgtacacgcagaaaagtgtgcccgtgattgggatattactagagaacaacaagacaattttgccatcgaatcctaccaaaaatctcaaaaatctcaaaaggaaggtaaattcgacaatgaaattgtacctgttaccattaagggatttagaggtaagcctgatactcaagtcacgaaggacgaggaacctgctagattacacgttgaaaaattgagatctgcaaggactgttttccaaaaagaaaacggtactgttactgccgctaacgcttctccaatcaacgatggtgctgcagccgtcatcttggtttccgaaaaagttttgaaggaaaagaatttgaagcctttggctattatcaaaggttggggtgaggccgctcatcaaccagctgattttacatgggctccatctcttgcagttccaaaggctttgaaacatgctggcatcgaagacatcaattctgttgattactttgaattcaatgaagccttttcggttgtcggtttggtgaacactaagattttgaagctagacccatctaaggttaatgtatatggtggtgctgttgctctaggtcacccattgggttgttctggtgctagagtggttgttacactgctatccatcttacagcaagaaggaggtaagatcggtgttgccgccatttgtaatggtggtggtggtgcttcctctattgtcattgaaaagatatgattacgttctgcgattttctcatgatctttttcataaaatacataaatatataaatggctttatgtataacaggcataatttaaagttttatttgcgattcatcgtttttcaggtactcaaacgctgaggtgtgccttttgacttacttttccgccttggcaagctggccgggtgatacttgcacaagttccactaattactgacatttgtggtattaactcgtttgactgctctacaattgtaggatgttaatcaatgtcttggctgccttcattctcttcaggctctattaattttaaccgttataagttccttttctcccttggaagcaaacatcaactgccttaaaatctggtggcgaggaaagaggaaatggcatgtactaatgatggtcctaataaatatcccgaaattgtgagtgttaagcacctgttccaacattcgggatccaagcatgaatttagtgctggtaaacgattttcaaaatccattggtaaaatattcaaacgaaactctgctttgaaaacttctagaactgaaacggcaaatcataaaatggaattgaaaaaaagagagggtgttaccttattgccacctgtcccagaatcattattacataaactcaattcttggttggaaactttttcttccaccaagaacatgaaaatcgaagaaaacaaaattgttattaatgaaaaagagattcgggattcagtctcttactaccctgataagaatggaggaagtgctgtattttgttacttgcccgaccttgtgctatattataagccgcctataaaagtcacaggcaagcaatgtccaataaagagaagtccttgggaatcgatggaaatccaatatcaaaagtttatgtaccccttagaaaggttggaaagacagtttgaggaagttccatttaggccctggtattttgcaatgcgattaaaggaactttacagatgctgtgaaaggtcttttactaacgcggcaaatagaggaaaggcaaggttattgcgggggaagcaaaggacgaaaaaatcgtatcataagactgtcaacctggtatcagcgaagatttccacccattcaaatgcgccgtcgccgggctgagaaacaaaaaaagtgactaagttctgtcattctatcattattgtaattagttatgtaggacatatatatccatagtgatctccttttgatcaaagaagacactgaaaagtcgtaagttcgtaaaaaaagtatgaaaatcgttccagccattgcttatagccatcctagtaggatactagaaaaaaaacaaacctcaaagataaaaagaaaaggtgaagctattaccgaattagaacataagataatacagtgagtataaaggtgagacctgctcaataatctggtaaccatttctcgtttggaccgtctgttaaagtagaaaaattcatttgtaagcataatagcctatttcttaatgtatcttgttggaatttgcaatctttggaagcactaacgtcatcgatatcagattggtaaggtgtactgtccattgaggaagttaaaaaggtactattattgtggttgttagtgtattcatacttttccatacttccgtcactattatacgttgatggaatatcactctccggttcagcatcttcctcttcttgctgctgttgtgcttgttcctggttttgtatttgttcttgtttttgttcctgttcttgttcttggacttgctgttgttgttgttgctgttgttgttgttgttcttggtctgcagaaaaatgtgataaatcgctcaaaaataggttttcattccttataatatgcgtcatgtaaacttcgctcgataggattggaacttgagacaagggcccttccctggtgaaagaagtaagagaggaaacttcggacatcaaagttttcatgtctattcttgtgtatggatttagttgtagaattttcgtcaacactgtgaacagctcatctgatataggaaggattttcttcaggacattattatcgttagcaaaatgttgaaatgtgttatcctccttctggtgagcttttaaccatgggtttcttatgcaagttaaattaattaggatgatgcctagagaccatatatctcctgtatccgtagggaggctcgaacagcattcgtcgacgtgtatgccgttggtggtggtattcaaacaatacaatattctttctggagccatataatatgaactgccaacgcacacatttggagctagatatttagatttagtggaaagcccgaaatcgcaaagataagcgttgtcattgcgatccagtaggacattttcaggtttgatatcacaatgatatataccgagacgatgacagtgatctaatgcggagcaaagctgcagaaaaactttcttaatcaaaataccatgatttacaaaatgcttatcgtcaactatcgaggtgaaaaggtccctgtcgtaataatccatcactataaaagtggcaatagaagattctaaaacttggtgaatcttcacgatattgccgtgagactgcactcttagttggaaggcaatctccctgtagtgtggtagcctatttagttcattctcagtcaactgtaatatcgagtctagatcaacggaaggtaagaacaattttttttggaaacttttgaaaaaatgatacagttgcgtttgcagaagagtggttcgcgccacttgagagttgttgttcaaaccgttcttattataaaactcatccatcgaggaggatttgaagaccgttttcactgcatattcacggctcgtcagtatatccaccacatggaacactagtccatacgcacccgaccctatttgagccgttattctgaaattgttcagcaagcagtctgacagcatttgtacacaaaatttcttgtctgtgttcttatttgatgttttcttttaaagagttttgtttccgctagggcgatttaagtcaataagtaaatttaacaatttactaaatatattttgtataatatataagaatatacgccttaagaatgtcctctcatgcgaaaaaggtagcaagagcataaaaaggaaaaagaaaacgctatagtcatttgtaggctcttgtctttcttcgtcttcgtcccgtgagtgcggactcagaaaacaccgcaatgatgtgggtccggaatatctattgcacagttttagtagggtcaccgatatcgttaaggtttgtggtaggaacagaaggtactgccggccctgtatactgcccttttgttccgaccatttcttttttgcatttgtcccaagattctctctccccacaaaatctgctcaagtatctgtccaacgcgctttcttcggctgatagataagttccgatttcgtgggaagcaaaaaaaaaaaaaaaaagaaaaaaagagtctgtccgagaaatgtcccggaaaacgtgggtgtgcggtgaggagattgtacttccatcccacattcctcgtgtttgattggctgcaagccacttgatgcctagaaaagaaacaccgcgtggtgcatctatgtccatatcacgcgcgctaaaacagcatgtagagagcgcgagggcggcgtactgcaccattctaataggaaatccgggatgaatgccctctccggaaatacctccactaagcctcaatggaaagttgttccgctcacgcgaacaggtttttccggggagtcgagaactacagtgacgtaaatacgacgacatcgctagagccagcagaagcctccatacattcagactaattagttgacgggcttgagccaactagacatattatgtaggcacatatgctccaaccaatacatatgtgtacatagagtacagctcttcccagcgcatccgctatcgtcctcttgacaggtccggctatttattatccgcggcatccgcggcccagcgcacaataatagattactttgcaatgcaagcggtcttggctgtttgctctgagggtccatcttcgtttatttctttatttactaaattaattatgatactgcactcaggacgggccaagaaagcatgtagcgtgaagagaaactaattattaagaaaaaagaaaaaaaaaaaaaaaaaaaaaaagaaaaggaaaaaggaaaaagataaaccaatcatacaatctttacagaaagggagtactgagaagaaggccaaaatactgcagagcatacatactaccgagtggatggaatgtctttttcatctatcttatcacaggatatcacagatgacattacaccaccagcgtattccgccaccttggggtcgagagaacagattgttttcagagcttaccaaaatgaaccttggttggctggtactgcttcgaatcttatcttagataaaaaacttgttattgtagacagagaactgttgttccaggtgttgatggtagagaatatcaccaaatccaagctaacacagatcgatgatataaaaaccaagctggatccgaaaaaacagaaagtggatagactacgatcaggcgcgcaaggaaatggcgctaagaagtacgaggtcatcactcaagtggacatggaagatgacgggaatgtggcggataacaactgcgccaaggaaaataatagcaacaataatagcagtgccgccaagaataaagcagtgtttaaattgacactacaaagtaagtcgggcgacgttttttttgctatcaactcgactccaatatcttggagctcttgcatgctgggttctaaaattgtgatactgccgggaactgtgttcaataggggcgttttcatattgaaggactcacaagtcatttttctcggcggcattaatagagtttggaatgaaaatagagatcagaaattttgtgattatttggaatctaaattacaacgtgacaaacaacttgtaaatggcggctccaagaaaaggaaagccaatgattagcatatgcctcttcttcttagaagggcgttctgcccgttatgtatacgttaaatattacattattttcgcatttttgtatttatattcagtgaaatattaggcttggtcgagtaacatttcccatagctcgtcggtttctttgaagtcgtgatgaacaattgagacaagacagtagtctttatgcactagtcttagaagaatattggctggggtgttccttggaaataacttggcccactcggaccagatactaaacgcttcatctctccatgccttgaatgactcttcttcaatgattgtagtctgtttgaccggactgttgggaaaaacaccccatgttacaacgctagagctgtgcgggtctaggttcgtttcaaatgaaccagatgaatcgcccgcgtaataactgaatttccgacgcccgtaatggtctagcttgggtttcaaagttgtttcccattgctgtctatgaataaacatttctacgaatgccttctgatacaacctccctttcgcgggcccccagccgaatattttatcactactcaatgtagcatttgtggcaggttgcgatgccaaagtcaaatatccgcgatagtttagttggattagttcttcttgtattaacgccgtttcagctgataaacccaggtcagaccagggaatcgcatccgttgaaccttccaaatattttataaaaatatcttttaaatcgccaattgtctttggtataccccatagttcaagcgctttgcttttgcttaccttgatggatggcccataaccgtctatttcaccatatgcgggagacctggagtcaccaaatctaccattggggaactcatcccaagtggcatcacgacccaaagttccgtgacctttagaaatagatattaaagcctttttagatggcatggaaccattctcattattatagcgtaagcctttttcagtgacgatagccctattgaaaatcaacttggccgaatcaagacttgaatgccttctccttttccggtttgctacagtttcttcattcgaatcatccaacacaatatccccgtcagcatcttctattggcacattttctatgcttcctatttcgccactggtttcatcttctccctcttcttcgctagattcatttacgatatgggataagacgggagattgcgagacaatttgagcaatagccttttccaaatttaatgtatagaaatgaaaccctttaattctaccagatgttctttgatatatttcctgaatcaattcgataagaatgtccacaccaatggacttcacggcattatcatccgattggatttctggggggaacctactcagtattgcaggtggaatagatgcatgtgataactttgctgctctgtggaaaagcagataggagttaataggcatcaacccagggaaaaggggcaaatcttgcgaaatccgttcccgaaatagcatttcaaaagttaagaatttttcaacgtcgtaaaacagttgtgttatcacaaaatcggccccagcttcaactttttcttttaaatataccaaatccttcaatgggtcttgctcgtgaccttctgcttcaccttcacaatgaccttctggatatgctgcaacaccgacgcagaacttgtctccgtagctttgcttgatataacgaactaaatcaaccgcatatttaaaaggtgattcgttcgattgagaatctagccaatcttccccaataggtgggtcacctcgaagagccaaaatattcctgattcctgcattataacatctatccagcgcatcatcaatgatggctttttctgtgtttgtacaggtcaaatgcatacaaactggtatatttagtgtctgctgtgccaaggaagctaatgtcagagtcttttccgcagtagtaccacctgctccccaagtaaccgtgataaacagtggatctaaagcagtcatacgatgcatacgttccatcaaatttctcgtccctaattcagtctttggagggaagaattctaacgatataaaaggggaagccctcgcatgatataaatctctgatggacatgtttaaaaaatgtaatcaacctgtcccgtccaacacgcttcaaaaaatgtacgaacttgaaacaaaatagatgatgtgagagcttaagtccctcttccaatgtaaccaacaacctgaagtgttctctgtttgcctttattttgcgacttttcttcatcattgaagttagaaaaagctttactcgcttatctcctggagtaagctatagccacagtcaatatcgcgtctaatgaaaaaaaaaagtcgggacgagtaaacttttgtctgcgtggcgcataggagaggagagagcacaggtgtactggagggttcaggacgttggtagagcatttgctaaatgtgtaaaaataatattgcactatcctgttgaaaatatctttccagatgtctcagttattttatcagggcgactctgatgatgagctccaggaggaacttacgaggcagacaactcaagcatctcaaagttctaaaattaaaaatgaagatgaacccgacgactccaatcatcttaatgaggtggaaaatgaagatagcaaagttttagatgacgatgcagtgttataccctcttatacctaatgagccagatgacatagaaacgtctaagcccaatattaacgatattaggccagttgatattcaattgactttaccattgccgtttcagcaaaaagtggtagagaattcattaattactgaagatgcattaatcataatggggaaaggactaggattgcttgatattgtggccaatttattgcatgttttagctacaccaacatccattaacggacaactaaagcgagcgctcgtcctagtgttgaatgcaaaacctatagataatgtaagaatcaaggaggccttagaagagctgtcgtggttctctaatactgggaaggacgacgacgatactgctgtcgagagcgatgatgaactttttgaaaggccttttaacgtagttaccgcggactcgctgagcattgaaaagagaagaaagctatatatttctggcggaatcttgagcattacttctagaattctcattgtggatctcttatccggcattgttcacccaaatagggttacgggtatgctggtattgaatgcagactcacttcgacataattcgaatgaatcgtttatattagagatttacaggtctaaaaatacttggggttttattaaagccttttctgaagcaccagagacgtttgtcatggaattttcacccctcaggacgaaaatgaaagaattacggctaaagaacgttttgctatggccgaggttcagggtagaggtctcttcctgtttgaatgccactaataagacgtcacacaataaagtcattgaagtcaaggtctccttaacaaattccatgtctcagatacagtttggcttgatggaatgtttgaaaaaatgtattgctgagttaagcagaaaaaatcctgaactagctctggactggtggaatatggaaaatgtcctggatataaactttatcaggtcaattgactcggtgatggtgccgaactggcaccgaatttcttatgaatcaaaacaactggttaaggatataagattcctacgccaccttttaaagatgctcgtaacttcagacgcagttgacttttttggagagattcaattaagtttggatgccaataaaccgtcagtatcccgaaaatacagcgaatcaccgtggctattggtcgatgaggcacaattagtcatatcgtatgcgaagaaaagaatattttacaaaaatgaatatactttagaagaaaatccaaaatgggaacaacttattcatatattacatgatatttcacatgagagaatgaccaatcaccttcaggggcctactttagttgcctgttccgacaaccttacatgtttagaactagcaaaggtcttgaatgcctcaaacaaaaaaagaggagtacgtcaagtgcttctgaataaattgaaatggtacagaaaacagagggaggaaacgaaaaaattggtcaaagaagtgcaaagtcaggacacttttccagagaatgcaacattaaatgtaagctcgacattttccaaagaacaagtgaccacgaaaagaagaaggacaagaggtgcttcacaagttgcggccgttgaaaagctaaggaatgcaggtaccaatgtagatatggaggtggtttttgaggatcataagttatctgaagaaattaagaagggaagcggtgatgatttggatgacggtcaggaagaaaatgccgcaaacgattcaaagatttttgaaatacaagaacaggaaaatgaaatccttatcgatgatggggatgctgaatttgacaacggagaattagagtatgtgggcgaccttccgcagcacatcacaacccatttcaataaggatttatgggcagaacattgcaacgagtatgaatatgttgatcgtcaggacgaaattttaatctctacgtttaaaagtctcaatgacaattgctcattgcaggagatgatgccctcttacattataatgtttgaaccagatatatcgtttatcaggcagattgaagtttataaggccatagtgaaggatttgcaaccaaaagtatacttcatgtactacggtgaaagtattgaagagcaaagtcatttgactgctatcaagagagagaaagatgctttcacaaagttgattagagagaatgcaaatctgtcccatcactttgaaacgaatgaagatctttctcactacaaaaatttagctgaaaggaagttgaagctttcaaaattacgaaaatctaataccagaaatgcgggtgggcagcagggattccataatcttactcaggatgtcgtcattgtggatacacgtgagtttaatgcctcattaccaggcttactctaccgatatggcataagggttattccttgtatgttgacagtcggcgattatgtgataactcctgatatttgtctcgaaagaaaatcgatttctgacttaattgggtcattacagaataacagattagccaaccaatgtaaaaaaatgttaaaatactatgcatatccgacactattgattgagtttgatgaaggacagtcgttttctttagaaccttttagtgaacgtagaaattataagaataaagacatatcaactgttcatcctatatcaagcaagttatcccaggatgaaattcagctaaaactagccaaattagtattgcggtttcccactttaaagattatatggtcttcctcacccctgcaaactgtaaatataatcctagagttgaaattaggacgtgagcaacctgaccctagtaatgcagttatattgggaacgaataaagttagatcggattttaatagcactgcaaagggcctgaaggatggtgataacgagtctaaattcaagagactgttgaatgttcctggagtgtcaaaaattgattatttcaatctccgcaaaaagatcaagagcttcaataagcttcaaaagctttcatggaatgagattaatgaacttattaatgacgaagatttgacggatagaatatactacttcttgagaacagaaaaagaagaacaagaacaagagtcaacagatgaaaatcttgaatctcctggtaagaccactgatgataacgctttacatgatcatcataatgatgttcctgaagcacctgtgtaaaatattgtttaatttaacgaaccctgttaaaacatcagtataaaatgcgattaactatagtgaaaataacaatattcatttggtgacttcgaccgtatatgttataagttagacatgctctttgaatcttttactttgatattttattccgcatatatattctttttttcgcgttcatagtttattcactcaaatttttcatatcatccgcaattcatcttccactttttagcagtaaaaatgaccaaatgaagttcatttatttttgattttttaaccgtatttggtggaatctgagcgtggcattagtgaatcattttaagccaaattacccgtgagtttttcttagaagcgcacaatcatattcattattaataaatgcttcaaattcatcctcttgaataaggtccagaaataattttgtctcttttccattacctatgtgggtaaaaattttcttttgcgactaagattcaagagaccaagtttcttttccacaacgatatataataaaccaaatggtacaaagtaggaaacaacaaataaggaaagctttttcttaagtagatttgtatatttatccaagaatgaacgatgtgtctcgtaaacagtaattccttttaaattttatatttcttctattttctgaacttttttacttaagaaaaaatttggaaatcattacctgtaggatggcttagctctgataatcaacctaccaaagtagtttgcagttatgtgcacttttcccttcatgttaacattattcgggccggtctattgttaaataattaagggtccattttaggcacggcggattcacagaaaaccacgcagtgctcaacgtcatataccacaaaatccgttttcgtattaaaagtgaatgtgtcagtaaaaggcattctttttagcgttcattatttcctttaatatgatgtaccaatctgtccactgcctatgtaaacttaaaagggaggcatttatgacttgagatttggttaaattaccaatatctcaagggtaacaatatttgctatactggtcatctagaataaaaatactgcgttgtagtgctgagtgatagaacttttaaatcatattatgttatataacaaagagcagggaacaagcggcgctagtagctctggtcgtagaacgaaattccacttcgatcgttttgtacaaatggttctgttcattgccgctaatcccaattattgctgttcagtagccagtatcccgaaatctggtgtcacgccagatttaaaaagagcagatattcttgaacagaagatcaaaagcttaaatagtgcgctgagtccaaaattgaaggaagaaagtcgtcttggtgggcctttgcataacccctctattctaccagccccatctttttcatcactaccaatatcatccaatggaaagaaatctttagcaggatatagacctaaaagtaggaagaaacaaactatactccccaacggtcaaccaaaagagtgcgccacttgtggtgacacctggacttctcagtggagaagtggacctaatggaaatgttgagctatgtagtcgatgtggcatagcatataggaaaaaaatggagaaaaaaatacgatcgcaacaatcctccgatgatggtactaaaaattttatatttaaaaataaatagttaagtagtttgtaaagatggtatattcagcggattcttcctctatttttatgttttttgagatatttcgagctttctatttttttaaaatgcctgaatttccatcttcaaaaaaaacataaaaaaggtactttaccaccaaataaatgataaccacaatttactttacttatcctccactatcaagtatcttcctaccaggaaaaatgaatttcaaatgattcgaaatttacggaggctcaatatagagatagtgtgacgatgttcataagggctttaccgcttagcacgtatctacagttttcactcaataatatattctctaggaatgattgccaatagattgatatccaagagaaggttcaattaaggaatttcatttcgttctaatcttttgttgaaaataaaaatttttacttatatgttaaagcttaagattccacataaggtcgaagacaatcgtcactaatgtgtggttctgcctgctcatctctaaaatatattactttttgtacagacatctaaattgagctggtgcttatgctattcttatgatttattttcaagtggtttattgaactttattccatatccaatgatctgaatatttctacttatgtataataattgtatattataaaagaataactattttaaagcgtcggttaaaatcaaatgggcaataaatcttctcatcctaatcgcatctttataatcaaaatccaatggcgcatctgcacttccatagagagtattcatacaaacatatattccacagtcgtagccatttggttgctgcggacaatctaaatgaatcaaatcaaagtcttctcctattgtatgcttactttcctccataacatatttttgcaagtcagtcagtatagcgaaactcatagcatttggaccattcgataatgaatctacgtaacctatagttttcttttttaaatcaattatgcccaacgcccagtgggattggttcaaatttattggtgtaaagattttatcaagtttatcaatttgtgtcttctttctcttcatccacctccggacgccttgataacccctttctgataaattggtatagaaaaatgaattaaacgccactgtattaggggtagatttttcaatgtatttcataaaaaactcaatgatagtgtcatttagccatcttcgtggtgccaaggtcttaaaatcacgtactgttatctctatattatctctattcattaactgagtattttctctagatgccaaagctttttgtacttggtcatcgtctttttcatttaattcaggaacaagtttcttcttggccaattgttctttcttttttttaagatcttcttgaatcttctttctttcatttaaaatttcgttatatcttttgaagtctttctcaaactctaatatagatctatcaaacttcaacttttgatttaagtaatccttatgtttcctttccaaagaagatatctttttttctttaacaaatactaaatcatcatcattttcatttcttgtctgtagtctgttcttgttgttctcaattaaaattgttttgatcttttcagttaagtcgattatagacttttttaagccagtgtctttttccttatccatatccattaattttaactgtctttctctttcttcttttaatatttttggaactttatattctccgttgaatatttgtcgtaaatatgttacttcctcagattgtgctctcgacaccagtttagtattgttaatgttctgttttgcaacttttttctttctaataaaggctgtcccatactgtcgcctgtcgtagctatttttctgatcagaagtgttattttctgagttagaaccaatagcacttgttttccacttattccaaccaaaaggatctctcgaaaaagttatgctattgtcactatcacaattgcttttttgagaagccaaagagctgattggtgaggttgaaggtgtccccacaccttcactttcgattcttctccttttatttggtaaggcccacgtcgacgtatcgaatttgtgttttcttgtatccgaggaataattttcacgtagaccatatggtacgtcactgctcctacttccagaacttctgctctcaacgtcgctgttaccacttgcttctacttcagaaccatcaaaattgcgaggttcgtttttcacaaatgtgtgccataagtacttacctgagttccaaagagtttctcttatgcctcctataaaaccagctttactagctctatctgacccatctttcattgattcttccattgataaaacacggcggtcgtttaaataattgaatcttgacgtattggttctttttttataaataccactaaaactggctgatcttctagactcggagggattgttcaatacccgaggataacacctatatgtagaaattggggagaataaaggggagtaagggttctttttatgatactgtagtgtgttccggtgcttatctacttcaactgacattattatgatatccaaaggtcagaggaagaagaggaaaaaaactgaaacagaagtagatattgatgaataattttaattagcaatatagatttgcggagctgaaacgaacgtttcagctattttttgatctgggtttaactatcacacacatcttctcattatgtgcattttgaattttgaaaataaaaagaggcggcgccggcacctgctgaaagctgtttaatatgatttaatacggaagagcaaatatgtataaatagagaacaattaattaattatgatagtaactggtacttgtgtaatatatgtgtatataaaaaatatacatgttcttattccccaaccaaattgaagataaaatcttgaattggttttagtgtacggggtaacgaaggctgggaggaaacgtttactaatcctctttccctcctagcggcctctttaaaagccacactaaagttaacaaccaaggtaacgattaatacaactgcaaccaaaataggtcccacaggtgcatccaaatgcttaccacttctacctttaataagagttaatctttttaagtaggttctataagcccatactccgcaaaacaaagtcaaaaagaaatatacataggccaacagatcagctagttgtggaaattcggctttttgcactgaattatagatagaaaaggtcaatacactcagcaatgtggttacacttaaccatctattgaatgtacgttcattggcgagccaaacttttgcctcaactttgacaggaccggcatttttcaaaaggtgaactggttttttaactcccggaggtaattggaaagaagaggcactgtctgtatcgtcggagtatggatcatttccattttctgaaatattttttccagcaagaattttcaagaaagctgcattcgttttgaatttcttcccttttttgactgcagatttcttgggcaatgcagtaccttcttcatctgatgattcgtgatcttctaaatctgcaataacgtggcgagtattctgatctttttgcccttgtctttcagtggtctttccatctggtacagagattttggataaccttctcatattatcaagtttatcatgaatgctcttttgtttttgtaaagttttcttctcttcttcgtaagcctcctgagggttctttctgatgtcggtttctaaatcgggcaaccagaatggcaaaatgttgacatatttatcgtcttcaccaaacagtgaagccacaccttgcaagtacaaagaaaattttggaacttcgttaactaaatgtgaattagttaaatctttaatccactcataattaggcatttgagaattatcttggtttataaccttaatctccattacagaataggggaacttcgaatattctcctgctcttaaaaacctcaatgggttgggaatattggaatcaatatcgtcacggtgccaattctcagggttcctaatgggcctatttttgtccaaagaatcctctctaatgtacatgatattggaatcgatagtgactctaatactttgatctccaggaatttggaaagcagttctattataggtagctctcaaaactggctgcaacttctcctcaacaataaagttttggatgttatcaaagtctctagaaagtttttccagttcctccttttgagtacccctttctcttagttgattaattaaatagtttttgtaactgggatcatttttaaaaataaaattgttgatgaatttggctttcatttgcaatctgatttcttcaaaacttgaattaccagtttcggtattttctgtaaaagttctcttttccaaaaatatgtcaggtttgtctagcagtttaccgatccatcttaatctcagcgtaggtgcaccgctgattttcaacaatctgttattgtacaaatcaaaaaaatcgttgtcgaaatataatgtagtgattgttggatcatatgactgtgggaaaataacgctctttgattttccaatttcaacatcttggttgctattaccatcactagaaaggctgttactctttgaaccaatattcaagcgcgcttcaggttgtacgcggacatctgattctagattatcgacgaaatcgtcattttcatttggaaccgacgcataaaccaaagcaggtagatgccttaagattctagccttaacctccattatattatcatcatgaacccaaaacttgtagcttttaaaacttgcgtcttcaaggttagaaaaatgtgataatttagaagtacttgctaatgatttagacaccgtatttggatgatcataatttgatctcaagaactcgtacagatatgagatcctatacaacaagggagaatactcttctgaattgttgaaaggaagttctttcaatctgacttgtaaaagagactttacagaaggatagtttggatgtaatttatcgtgtttcttcacaatcttgataaacccagtaaaatttaacctgtcaaagttatccaatctttgagcctcatctagacattcttctaaggtgtttttgaactgctcagaatttattttttggattttttcagctgatttagtgttttcctctaaatcatctaattttcgcaagacagcattatatttggaaatttgaaatgtgtaaaccttttctagttctttatccaaggcctccacaaaatcagattcattcctttcggaccaactatccacggaactacggccatcatgtatgacgctttcctttagtaatttcttcaacctttcatagtcgatatatgaatccttccagggaggatatacgtcgttagccagtttaataccaaatagcattttcaaactctgaaaaccaaggacaaattctgctgttcgctctaatagccaaatgacctatagtgataataaaaaaagcgctaaggaggtactacttggattagatcactcttatgcgtattattacccgccaatgggccctctcgatattgagaagatgaagtaagttcgagaaaagatgtctgatgtaagccgctctctggcctctatttaaaagttcttcctggatgaaacccactcgaaagttgggtgtgtgcgtgtgtgtatgtttccacgtttctgccttgtgctttcaaaatcgcatgcacgtgcttgcgactgcactgtgttgtattaagccacgtgggccctcgcacattgaaaaaaagaaaagctgtacagggaaaaatgtgccaagaagtccaaataccaatagctgtgcaagttactcattaacatccaaaccgtgaaggtcacggcatatatactctggcgttctactatgtggccggtaatgtaaccggtaatggtgactatctaatagttggagtccgccgaaaaatcagaaacgcgtaatttagacttatataaacagctatataccttggagctagtgtgatcttgttgatactaggtcggcaaagaacgcaaatatggattttacgtctgatacgacgaattcgcacgacacatcgaattcgcatttaagtctggaagacgctgtgggtacacatcatgctggtgaagcagatgtaaacattgatggggacgagaagcaacaactatcgctattagatgatgatcaggtacgcgcactgaagctacaggaggagaaggatgcgctgttgacaaggagaaatactcttttacaagagatccagacgtaccaaaatatcttgatgaaggaaaataacagtaagactaaaaatggtgatatcctccaaaacgatatcacacaggattttcttaatctaatctcgatctcatcctctaatcctaattcggcgataagtgaccgcaagcgggtcgagaggatcaatgggctaactaacttgcagaaggaactagtaacaaaatacgacacgttacctttgttaaatatgaatctacggctaagttatttgagagaccacacatacccgcatcttcaagtttctgtgcaatcaagagacagagtacataacgatgggattgaagttttggtggtcaattataaattctgcagaaacacgatgaatccttttgaaattcagttcaaaatgttctataaatttgaagattccacactgctgaagtgggaaatcttgcgaatttccacaaacgttagactgaaggccaagcaattactggcaacacgtaacttccagaagtgtctattaagcctttatgagtttgataagatcaagtccaaaaaaactggaattttccaaaatttgattaatttattgaaaaggaaaaccaggtgttatctaatgaataatagtgactcattaattgtggaaagagttattagagaaggaagactcacgacgataaaattgcagataaatttcatcattacaatgcccggtgagagaggcaaacctcgtaactgttttctgcccatgagtaaaatttcaatagcgctatggaaggggggagaaagatttaaccagatagatttggacgagatatgctacggacttatcaaggaatatggtgtgaaaaccgggttaaaggagatctgcaacgtttgcctattcccggacatgtacgccaggtgatgttccatttgccattgccaactggacggcttgcttaaacgattccgataagctcggatgagggaacggtactttacagacatcatgggcggtaaggccaagcgacaccgccatcgatgcttgcgacagcaattcatttgcatcgtcgtttatcatatgaacgcctagtattttcatgtcacgagaatctatcagaactttaatgaaaggagaaactgtagtattctcttcccgtggtaataacgtgttatatctaacgttctgtgagaacaaaaccctgcctttttgatatgggatgcgagcctttgccaacccctcctcagtgtatccgacccagccaatctgaggctgacagtacagcacatttggtgggaagccacaattcgaggttccgtcggagcctgtacagcctattgattgaatggcccttatagcttgttcttccgctttcagcgccagcatggggcccaatgtaacgtctcctatgggtttaatatgagggtactttagcagactttgggtttgtacgtcaacattttctacaaaatcccgttcgtctagaccaatgctggaaatatctaaaccttttagcaggggacgtctaccaatagaaaccatcaagacgtcgcaatgatgtacatatgttttctttgacaccttgttaagcaaggtgatgttcagctgaccggcagcatcggcttccgcgagctgcactctagtgtctaaaagaaaagctataccctgacactgcaagagggtcttcgtggcagaagccaactcattgtccatattttgacagatctcgctttgagattcaacgatagtaacccgagagcccaaattattgaatatgcatgcgatttctagtccaattgtacctcctcccatgatagtaaaacgtgaaggtatataatccagtgacaatgccttatcagatgaaattatcttgtcattatctattgcaacaccaggacactgaataaccgcagatccggtcgccacaacaatatatttcgcctctacgatgaacggtttcatgccgcgctgcgcaatctcaacgtggtgaggatctttgaaagcagccgtgcctttatacacagtaacattatttttagatagctcacgtttatacacattgcccaactcttctatattatgtttgagtgcactctgggccgcctgcatatcgaattttgcaggaaacagccgcgtgccacgttgctcgataagttcttgctgttgtagcagccgataaagataagactcatataacaaggtcttggacgggactgccccgtctacaaggtaggcgccccccagcgaggcacgctggtcaacacatgctgtgagcaggcctgcttgcgaagcctgcatcgctgcagtaaagccaccaggcccgcaaccaattaccaggacatcgtaaactgccgcaaaatcctccatcgtgcttaatatttcgtcttcacctcccattaccaaaaatgctcaccgttaattatatcatacttctcttctcctctcgtaaaatcgtgcgcatgttaaatagccgccgaaacagcagatgcatgcctgcaggtctgggtgtaccccctgcctgagtgttccacccaggcctcgcgcaggaaaatgccaccgcactcaagttcgcacagaaactaccgcataaatttattctaacccggaactgacgtttatcgtgatatgaactttgggtatctccgattacgaaacgacgccacccctccttccccaaagcaccgagaaaagattttttttaaaactgaacgctgattgactttacgtattattaccactatgcattattgttgtttctgttgtggttgttgccagttgtaatcatattcacattgcgttttagtcataaccacttccggtattcatcattcgtattgaataacaatatttataccgcaaaacactatacggcaaggcaactgattacactttgtttaccttatttttttattatttatttttctagaaagtattgttgtgtggctctatccttattacaccatctctgctttggcatttcgcgtttgtttcctctcacggattgcagattattgttcaccaggtaataatcactgactggcggctattttcctattacactcattattcttaaaattttctttttctatctctattttctttcttttcgtgtcttataataataataataataataataataaaaatagtaataataaaaatagtaataaataaagatggatttctttaatttgaataataataataataataataatactactactactactactactaccaataacaataatactaataataataatactaataataataataatcctgctaataataccaataacaacaatagcacaggccatagtagtaatactaataacaatactaataacaacaatacgaataccggagccagtggtgtagacgattttcagaattttttcgacccaaaaccttttgaccagaatttggattccaacaataacaacagtaatagtaataacaatgataacaataacagtaacacggtagcctccagcacgaactttacttctccaacagcagtcgttaataatgccgctcctgctaatgttaccggtggaaaagctgctaatttcattcagaaccagtctccccaattcaattctccatatgactcaaacaattccaacacaaatttaaacagcctgtctcctcaggctattttagccaagaattcaatcattgattcttccaatttacctcttcaagctcaacaacagctatatggcggtaacaataataataatagcaccggaattgcgaacgataatgtaataacaccccattttatcaccaatgttcaatccatcagtcaaaattcctcatcttctactccgaacacaaactctaactctactccgaatgcaaatcaacaatttttgccattcaataacagtgcttccaataatggtaatttgacgtctaaccagcttatttctaattacgctgcttcaaattcaatggacagatcatcctctgcaagcaatgaatttgttccgaacacaagtgacaacaacaacaacagtaataaccataatatgcgtaataacagcaataataaaacgagcaataacaataatgtcactgccgtgcctgctgcaactcccgctaataccaataattcaacttcaaacgcaaatacagtgttctctgaaagagctgcaatgtttgccgctttgcagcaaaagcagcagcaacgttttcaggctctacagcagcagcagcagcagcaacaaaatcaacaacagcaaaatcaacaaccacaacagcaacaacagcaacaacagaatcccaaatttttgcagagtcaacggcagcaacaacaaagatctattttacaaagtctgaacccggcattacaagagaaaatatctactgaattgaataacaaacaatatgaactttttatgaaatctttgattgaaaactgtaaaaaaagaaatatgccgttacaatcaataccagaaatcggcaacagaaaaataaatcttttttatctttatatgttggttcaaaaattcggtggtgcagatcaagtaacaaggacccaacagtggtctatggtggcccaaaggctgcaaatttccgattaccaacaattagaatcaatctattttagaattttattaccttacgaaagacacatgatttcccaagaaggtataaaggaaactcaagcgaaaagaatattcttgcaacagttcttacaagaactattgaagaaagttcaacaacagcagcaggccgctgcattggccaatgccaacaataacattaatagtgcatcgtcagcaccaacccccgcggctcctggcgcgtccgttcctgctacagcagcaccaggaacagaagcagggatcgttccggtttcagcaaacactccaaaaagcttgaatagcaatattaatatcaacgtaaataataacaatattggccaacagcaagttaagaagccaagaaagcaaagagtgaaaaaaaagaccaaaaaggaattggaactagaacgtaaagaaagggaggattttcagaaacgacaacaaaaacttttagaggatcaacaaaggcaacagaaattgctattagagacaaaattacgtcaacaatatgaaatcgaactaaaaaaattgcctaaagtctacaagagatcaattgttaggaactacaaacccctaatcaaccgcctcaagcattacaatggttacgatatcaattacatctctaaaataggagagaaaatagattccaacaagccaatttttctcttcgcgccagagttaggtgcaattaatttacatgctttatcaatgtccctccaatcgaagaatcttggagaaataaacaccgccttgaacaccttgttggtcacaagcgctgactcgaacttaaaaatatctctggtcaaataccctgaattattagactccttggcaatactcggcatgaatttactgtcaaatttgtcacaaaatgttgttccataccatcgaaacacttctgactattattatgaggatgctggatcaaatcaatactatgttacccaacacgataaaatggttgataaaatttttgaaaaggtaaacaacaacgctacacttacaccgaatgattctaacgatgaaaaagtcactatcctggtagattctttaacaggtaatcaattgcccacccctactcctactgaaatggagcctgatctcgacactgaatgttttataagtatgcagtcgacatctcccgcagttaaacagtgggacttattgcctgaaccaataagattcctccctaaccaatttcctctgaaaattcacagaactccttatttgacttctttgaaaaaaatcaaggatgaaattgatgatccatttacaaaaataaataccagaggggcagaggatcccaaagttctgattaacgatcaactgtctaccatctcgatgattttgaggaatatttcattctccgataacaactccagaatcatgtcgagaaatttttacctaaagagatttatatctgatctactttggttagtcttaatccatccagaaaactttacatgcaataggaaaatactaaatttcaagaaggatttggttattgttttatcaaatatttctcatttattagagatcgcttcgtccattgattgcttgttaattcttattctagtcataagttttggtcaaccaaaactcaatccaatggcgtcttcgtcatcatttggctctgaatctttgaccttcaacgaattccagttgcaatggggaaaatatcaaactttcggtgtagatattttggccaaattattttcattggaaaaaccgaacctaaattatttcaaatcaatccttctgaacaaaaacacaggtaacaacctctatgatcgcaacagtaacaacaaccacaaggacaaaaagttgttacgaagacttttgaatttatacaatgataacaataaaaataataacaataggcacaacttgctaaatgatgtggtttcgtttttattttctgccataccgctgcagcaagtgttatcgcaatcagctgatccaagtttgctgatcgaccaattttctccggtaatttctcagagtctaactagcatcttagtcattgtacaaaaaatattgccgttatccaatgaagtatttgaaatcagtgagaataattcagacagtaacagtaacaataacggcaacaaagattctagcttcaatttcaacaagaatttaccatttgtgtggttgagctctgaagaaaatattggatctggactattgaagttaagtgagataatattgaatattaacaattccacaagtaagaatactttgttacagcaacaaaattattcaaaggtgctcctaccgtcaattaacatatcctgtgttcagttaatcaaatgtttggttgaaaaaagtatttgttttgaaaactgcctaaacaacgacccggaaatattaaaaaaaatagcatcgattccaaatttgttccccacggatttagaaattttccagttattcactaatccatcagttgatattcaaataataaaccagtatcaattactttacaatttaaaaaatgatatcctaaccaatttggaatgatgcgatttttttaaacaatattcttttactgcttatttcttccttgcgcactattttctttttataaacctatataaaatgttgtaactaatataatagaccttatggaaacaatacagtcggaagagcgcctttagtgccaaaagcccaaatgaacgtatagctgccatgaagtcacatcttgggcggctcaactaaacaatggttttagtaacttcccactggtcccgtcgcggctacaaaaattccttgaaattgtataaaggagtttatgactccatttcaggcagtaaatacaattcatacacaccacacatacattcagagttaacgttcgctataataaaacggtagagagtcagatgtggagtcagcgtggggggtggggtaacactccacctttgaaaacggtgtgacttcgccctttcgatgggaggaggtaaagctcaaataggacagaatcatccaagaaaatttcaagctgcccacaaagtcaagatcgcttcagaagctgttcggcgcagtattgagatgaattggctgcattgacggttcgggaacccattctacttatctatatattctgagtacttatccagaaagagaaaaaagtcagctggcgccgtattttttatcaaacctaattggctaaagtagaattgcacgtcagagcttacaaatttttcgatatctataagggggtggggggaaagaatatgtatgcaatgtcaaacgcgtaggaaagccaagctcaattacgcgtctcttttatttttaaactatcaaattgccgcgcatgctagatgaataaggaaaaaaaaagggggacggaaaacattgcaaccaacacattattctttagcggctttttgtgaagaagaggagttgcttgctccatcttcatcgctgtcatggccattgagacgctgtagcttcttatccttcttgtctgcactctcatgttcagattgatccaaactcaaattctctaaatcatgtacaatttcaagtaattgctctttagagttatcccccattccaccttgggccgtaagtatcttttcgaaatcttcttgccaacctaattcttcaacgagttgctcggcaaactcatccgagtactgatgaactattaaatctgtaggcctcttgttagctttaaaatcgcccaccgtttccaaattgcacagaactctttttacctttcgaggaatttcttcgggcagagacgcaaagggataaacggctagtgaggtgccaacgacgatgacaagaggctgctgaggatgttttccagatgtcgtgattttttcacgaagccactctgaatcgtttaaccaagtttccgaaaaggaatccggtagatcttcgccaaaaaaaactattgccggctttaccagttcaccgcacacatcacacttgacaaaatcctttataggatgctctgccagcttggatttgaaaacctgtgggggataaactttaccacatccgatacaatgacagtgagcaaaactgccatgggcctcgatgatcagatcatccttaacaccggcctgtctttctaaagtgtctatattctgggtatatactctcttcaaaacgtctttgtcttgaaacaatttcaaaagatagtgaaacttagaaggtctgaaatttccgggatacaactctttagccaaagtgtaaaatggcaaaggatccgattggaaaaaatcgacatcgaacactgcttcagggtacggcaacttcaacctggccaagttatggtacaggccagttcccggagatcggaagtctggtatcccacaagaagtggatatcccggcacccaccataaagattactttagcgttggggttgcttttcatatgagcagcgatcttcctaaccgacatctctgtagaggcggtagaaacagacatcgaaacacggagagatcgcggtacgtctggttggtagctcagtgacgggcacagatagcgacatttactgatacagagacagttacgaaagatggaaacacatgcagagaatgtggtctattccttattcttaagatcggcgaagctaacagagttaatgctgggccatagctggacggcagaaagcacgcaggcagggggcctctgcgtagggcgggagacgcctccgtaaggaaaacggcgcgggaagggcggcttcttactacatttttttgccactccggaactcgcgcagggggaagacatatgcccactttgggaaatagaaatggtcattttaagctcaagtgaagcgaaaaaaggaggtatactcctttacgcgtcacccaatctggataggcacgtcaaactcattaggtctcatcaagaactagtgtagaaatgacgcttgaactccgaactttaaacaaagttctgtttttgtttctgtttctgtttcctgttgctgtctctgtttctatttttttcgtatagctctatttcccttgtagataaacatatataagaatgctattatagaagcgtgtattttcctccccctagcttcaacctgtaattcccttcttagtaaagcgaactagaaccagtttaataggatatagaatgctgctggaaagattgcacaagagattacacgccggctcttctaggcgatctcaagaaaataaggacaagaattgcaagcccgaagacgcgttgcccatccaaccagaagctcaacatcaaactcaggaccctcagccgttgttaaattgtgattacgatgacatgattgcatttgacagaaacttgtccactcccgttttcactccggtaatgactcctataaataatagcagctccaatcaggcgaaaagctcggatgcctcgtattttccaccttacctcaatgctaatagaaccagacagaatagcgcctcttcgctggcgagttccgtttccgatttcgctcagaatttcaaacaacataccttttacaacaataacgctcaattcacttcgttcacaccgcagtttgtcggccttctattagaagtttaccaaaacacgtgcagcgatcctacgataactccgtttgatactacaaaccctccctcaggaatattgaatagagttgccaaagcggctatacagcaatctgagcttcaacaattggatatcggatgtgacagaaatagctggcttttaacattggtaagacagcgcttgttgcaagaggtcagaaaagacggctatctttctcgtaacacttctttaacttctttacccccaccacccccaccacagttttctgaaatgcttagagttccctccccgtttgttaacgcagatattaccgatccaatccccttatcaaacacaaactcgaatccgaatgtaagctctactaccagcctgaccaacacgttgaactggtattccttacaaagatccaacgtctcaatgaagaatagaaatggctcgtcccagtatatttcagaattacaaccacaacctatcttagcccgcacaaattctaacaatagtgttagcaacagtaatgccttttctttactcacgccaacgcctacaacagattccgcatttaattttaacatagctctgctatcgagacaacgtagcaatatcatatcgtcccccttagctagtactcgtttacctacagcaaacgtgtccactgaagaatcctctattttaccaaatgaatcattgaagctaaaaagagatttattgcgtcttaaaaggtaaatagtgccgaacagtcaggagcacacaatacatgacctataatgacactatcttaatgaaattctattacactttctcttttcttcacattcgattaagaatttaatttattccatttcaagtctcattctccattttctggttggccatagatgtattatttacaagtctgatagatataaaagcgccaagtaaaacatatatacaacatatacatatacacctcgcatcaattaaaacacgttcctttgctttcctttctttttctttttttttttttttccgatctttttcactccaatgtttccattctttcaaatacaactttcctattcacattgctgttcttactagtggcccatgcatcatttaatataccagcctttcgtaatagtttagtaactgtttcgctaggttgtgctcccacaccaatccaatattttgttctatcaaaatcaagcttcacgtctttaataggtacaacgcccctcttcaattctctcttggtcactgggctgggtaccggcacgtaggttcctagtacctcgatcggtttagcatccctcgccttacgggaattagccactacgatattatagaccggactattttttcttccaaatctagctaaccttattcgtactagaccacaggtcatacttgataaactctattacaatttcttaacggaataccagtcagaactcctccgttacttaagtcgtgtatatattccccttccttttttcttacaactgttcttggtgtactatttcattttttccgtcctgaatgatagatgatcataattagtgaaaatttttcttttcgctgcagtgtttaaaattttaattatatcatctcatctcatcgcgcaattagaacttcctcggtcgcagttaattctctcagagaagagttttagtttgaaaaggttcaacttatttttttactgattgaattcaaccaggtaatttctagattttgaacagcatctcgcgaattgaatcagcaaatctcagagttcatcatggatcaagacaaagttgcttttcttttagagctggaggacaagctggctaaaattcgttcccaagtaaactctaaattggagaatcaaaagcatattgctataatattaactgccgttgaggaaaatattgcaggtcaagctacaaatgatgtttcaaaaaacattgtaaattatatcatttcctttatgtcactattggatcaagcagtagacccatctactcatgaaataaaagatattcaattggcttcctcatctacatatcttctagatctgatatttcattattcgcctaaggtattattaagatcgaagttttctgaaatcctaacgaaaattgccccatgtatcactgcagaaaaggctaatgcccctctaattagagctgctattggttgtttagaatctcttcttattgctcaagatgcacaagcctggaacaatacttatgatctaaacgtcactccaaaaagaggtttgcagggtatacttgaactttctttagatgtaagaccaaaagttagaaagagagcgctagatgcagttcatgcggtcttattaaaccctcctgttgcaccaactgcagagcatgtagcggcagtttttgtagcagatttctgtgacaagcagttagcaggtattttaaatgatctctcgaatttatcaaataaacaattgaaagcacagaaaacaaaggaagacattaacgctagtgtcatgcgctctctaaggttgattacttcagtcgtctctactggacagtggccatcttcacagattgagcctctttgtgatgtactattgggagtcaccaaaagctcagagcaatatctcgtttctgcatcatttgaatgttttgaaagcatgttcaaaacaatggcagaaactaccatttcttctggattggctgaaaataagtacctaagagtcttggataccatttttgcattaaaaccctcaaatgtcgatacattattaaccaagtcctggattgctgtggtcattaagggtatgtccacttacgcaacacatcaaccactgaaagcgctacgtaaaattcctggtgtatttcacattatgtgcacatatttagctagtgaaactccagaagtgtaccaagctgcctctcaatgtcttatctcaatcctttctgagtctgttaaagatgatttgttattgtatacaccaagtgtggatgagaaagttttcaaaaacgtagatgaaatcatctctcaaattgcgaaaacatttatcgactttttatccattagatattcccattgttccagagaaattcttaagattttggtggcagcattcaacaaattcagatatagatctaatcctcactttttaaaatcactgaaaatagtcgatacatggagagtaaatgaagaacagtttatggatttgagaaatgaaatcgaattagtaatcggagcctccatttctgctatgggccctgaaatgatactcgcagaagcacccctgaatttagacaatccatcttccgaaagacctggcagggcttggttgttaccgcttattagagattatacgaaaaatgcgaaccttgcaacttttcaaaacgaattggcaccatacattaaaagttttcaatctaagttcgataaagtcccggaagaatctattcaattgagagtttttcaaactattgttgaccaaatctggtctacacttccacggttttgtgaactcccaatggacttgagggaatccttcactgacgaatttgcctcagaactatcttctttattatacagcgaggttgagttaagaactacaatttgtcatgctttaaaggtcttggcagaaagcaatgtttcatatgccgaagagtcctcttctcacaacgttttattgttgcaacgtttccccatttctgaagctcaaaagaatatagaatacctttcaaccaaatcaacgaatcttctagcagttttgttcaatgtttatactcaaaccactccaaatgcaaggagttatattttggaaacgattgatcaatatttaaagattacttcaaaggaagatttggagaaaactttcaacaacgtatgtggtcttttgaagaattctatgaatgaagaaagtagcggaaatgtgaacaaagaaaagaaaaagcctcaattgacagcgacactattggacttaatcatatgtatgataacatacttacctgtctcgtcttattctgctttattctcaatgtttagcctcaccgtaaattctgctgacgcgctaattcaaaaaagagcttatagaattattacaaagctttctgagttgaaatcgggatcaacagctgtcgcccaattcatttcggatattgagaatgtcatggtagatagcgcctcctctgttcaaacatctgctaaagctgcaagattaacagcaattaaaaccatagtagaattattacctttagatcatcttgatttcattgttagaaccgtcgctgaggttattttgagtacaaaggatgtgaatgaaaaatctagagagaccgcttttgatactttaatttgtatgggaagaaaaatgaatgagccaaatggtattatcaaattattccaaataccaggttatgatcctaccactccagatcaatcgtcgtcaatatcagagttttttaagatcatttctgccggtcttattggtgaatctcaacatatggttagtagttcaattacgggttatgcttgtttagtttttgaattcaaaaatgaactcgattccggtatactaatggatatatatgacaccattgaattgtacttaacttctaactctagggaaattgtaaaaagcgccattgggtttaccaaggtttgtgttttggggcttccagaagaactgatgaggccaaaggtgccagagttacttctaaagttattaagatggtctcacgaacacactggtcatttcaaagccaaagtcaagcatattattgaaagattaataaggagatttggatatgactacattgaagccaacttccctgaagaagataggagattattaacaaatataagaaagatgcgcaataggaataagcgtaaagatgaagaagttactactggagttagtgatgtagctgccacaaagggttcaagatttatgtctgcattcgatgaagctgtttatgggtctgatgaagaaaatgataatggatcagatcaggaggaaaatgttgctggtggcaaaatgaagaatggggcaaagcaatttattgtagaatccggtgacaacccactagatttgttagattctcaaacactagctcatatatcatctaccagaccaaagaaattcaataagaatcaaaatagagcaaggtttaatgatgatgcgtttaactttgactcagaaggaaaactcgttgtcaaggggcaacctaaaccctctactaatgtagacgatccattgagtgctgtgacaagcggaatcaatgcgtatctagaggctgtgaaaagtggtcctgtaagaggtcaaagaaacaagctgaaattcaggaaaaatggaaaggactctgatgaatttggcgatgatgatgatggtgaaaaggatagtaggctaatgagaggaagagtaaatcaaggtaacaagattggcaaacataataagaaaggtccaaagttcaaatctagaaaaaaattatagaagattgaaactgagcaatatggctaattacacacctggagaaaaaatcagatatgtatatataagaatattataatactgtatattaaaaatgattaaaataaagaaaaaaatgaatcgggcgtttaattgcttattatcttgaagaagcgaaagtacactatatagtaataatgtgaggttaattaaatatggatgagataatgacgaaagaaaatgcagaaatgtcgttttaaaagtaacccccataatctagtgaggttcgacgttgaaatgtgctgtccatatcttcctgctctgcccatttagtatcaacatttgagtcgaattgaaacattgatatgtcacggtcatcaccatgaggagactctgttaaacttttattgttctctttaaaactttcctcattgttattttcttgagacttttggttagggccttccacttcgccaagtgattcaagctcctcatcctcaaatgaaagagttatattttctaacctattttcttttctcattatcggcagtttgctagttacaaatggattttcttggatctctgttaaggcatcctcatctcttggggtcatcgccgaaggcatcctatcttcgtttgttatggtagtgtggtgatggcggcttagaatggaagatttatagcctgcaatatgtggtaaagccggtacattttgagattcttttttggaagctctttcaatcatgtttatacgttgtctagcaatgactaatttgatccaatcatctaatccattattatttattagatcttctatcaactctgtttttctattctttgtttctaatttctgtttcgcacccttgttttgcagtaattgattgagatagtcaggtattgctgacaaaggatcagattctttttcctcactttgtagtaattctactgtgggtaaggcagttattcgcgcgtcggtcaattgagtactataaatacaccagtccttgaacttttccattcctcgtgaacttgataattcggagttttcatcatagacatccagaacgttcgtaggcttaacaatacctagattttccagagccagagttatatcttgtaaagcaattgtatcgtcctgatcacatcttgcctgagcgatagaactgacctctgatgctaacaaactcaagaattttgcatagagatcggtcatgacatccaccagactgggccttgccctgtcaaatccttgtgccttcaataattggagaatagatatgcgtagtagagcaaaatagaagtcattatttgtagtcatagcagaggaactctattgacccaaagatatcgctgttttccgctagtaggtgatttggaattgctcaggaagctacttcaagtgttatattagcataccttcatcatgcaatatgaaattactgaaaaaaaaaactaaagcatcgcgagcttacccgtttcgccacttctgtcaagtgaaaaaacacgtttgcattgtttaggctacaaggtgtggaatatcgaagttattgctagacagaagttctttaggcatttaggttttgtttgtgagctggcttgctaattttgagtactgtgcatcattgttccaggatgtcttctttatcgctatatactgttcaggctgttttaatactagatcagcaaggagaacgaatttatgcaaagtattatcaacctcctcatagatctgatgaaggacaccaattgctcttcaattcggtgaagaagcaaaaagagtttgagaaacaactataccgtaagactcacaagcaagattcggagattttaatcttcgaggatcatttagtcctttacaaagaatacattgatatcacgatatatttagttgcttcgctggaagagaatgaaattgttcttcagcaaggattttcagcaatcagaggagctttggatttgattttgaactcaggaatggacaaaaaaaacatccaagaaaactatgatatggttttattagctattgatgaaaccattgataatggtgttatcctcgaaactgactctaacactattgcatccagagtttctaaaccacctacgaacgaaccccaaatggcattagatttggataagggtttcttaggcgcgtggggtttcgcaaagagcaagtttcaagaaaggttacagcaaggcttatgatcacaaggcaaagcggatagaagaaaattttagctggtcttatatggtatatatgcagtgtcttactttctcccttccatatatatgtatctacttatatatataagtatatgttgctcatttagaaatgattgtcacctcatgctaatcattttattcttctcgttggtctgtgatgaaaaataatgaaaaaattataattgctgtctattttcttttcatctcatatgatttagcgtttttttttgcccttcttcgaagagttaccaccgttcttggtggatttctgcccagcgattgttacttttaacttgtcgacacagagcagaagaaccaagtcctgttccttcaagcctttaatcatttcatgttcttggggccaatccatttcgttgtcagttgaagaaccgtctagtggtctactcttgaaataatgtaaaatttcagttaaagtcttagttttcttcgcacttcccggttgtattttgactttgtatttatatttcaaaagcgcaggccagggggcaaatactggtataatatcatcaaccacatcgcccttatcgagagatggttttaattcggacttgtgtttatcatagttcactcttgctttctcttttttggtgaattttaaagcctgtagtcttctttgtttctcgcgtttattctttctatcttctctaacttctcgcttcattatttcttctttcttcctttgttgctgcttttcgatacccttcaaagtacccaaggcctccaaacgcaagagacgttcagtttcatcctggtcggcgtatttcttttgaattttcttcaattttcctcttttaccacggacgttactgtttatgttttcgattaaagatatcggaacacctggttcatcaaggatacgctgcgtactgctattgtcatttttggctttagcatttccagaatcagagtcggtatcggatgatatggtgcaatgcttttcgatgtctttttcaagattatcgtgttcaaaactgttgtttttcgtgctatcgtttgaatctccacccttctctaacccattgacctcgttactatcgtcttcatcttgctgttgctcttcttctttttcttcttcttctttttcttcttcttcttcttcttcttcttcttcttcttcttcttcttcttcctcttcttcttcttcttcttcttcgtcatcatcaccattatcctcatttccactggttttcactttccataaaaatccaaaacccatcacaagttgagcagggggtaaatggttttgatcattctcatttttcaaccgaaaggcaccttctggcagaatggagttatcagagccatcgaatttactaacattctttgcaaagcaccaccatggagaagaagatatcttcttcgaccaagcctcgcttgaggacatgcatagtatacccgcttgcatcaaagtgttcggtggaacttctgttttttctggatttttgatccatacatgagagttaaaactattggacatataaatatcatcatcttcaatatattttgaatagatttgatctgtctcagccggacttttacccatcatgaccaaaaatccttcacttgaaataaaccaactatatttttcaaaaaagtaaggagtgcggatcttttttaagacactgtgagaatcttttagcttttttttcaattgttgatcaattttgacttcaatattcttcatagccttgccgacattcttttcgacttttttctgcttttgagcacttgtttttttgatattgaaatattcagtggcattggcataagctgataaaccaaggtcaattgtaacgtttatcttttcattagattttcttttcatactttttgtactcctctccttcgaactctccatgtcttctgagtctgagtcactagaactatcagtagtattgccttctgattcattgtcctcgtctgaagaagtgttgagttccttgctagagagatcaagcttgacgctaattttgttctgtttcaagttcaaaggcaagttcaaaagctgagcaattctgttgccttttttttgttcacttttaattagtttctcaatagtgttccagtccatttgttgatcgattagaccctgaacagcaagcttaacttcctctattaagggtgcattttcaattatgagatggcctttcctttcatttagttcttggacgtctaataaagcttgtatttttctatcattttcggcacgagcatcatcgattttcttttgcgcttgcgattcctgattttgtatacgtagagcatacttagaggattctattgttgagaaaaatttgtctagcgtcctattgtaaggaccttcaacttcaatgatacaagaagagtcagtgtctcccccatttatatatggcttaaagggatggaatgtatcataaataaattccaaatcggcagtatctttttcagagatataattttcatttcttttggccaaaatgtaaccctttctatcggtggtagttaaaagttgattatattctaactgagtactgtttagcaattcggcgagtgagtctgtttcctccaaaagatttaaacaagactctgaagggtcgatattgaataccttaaggttctttgataataaatctgaagacaaatgagggactttcgaaagcagcagtttatggatggaaggtactttcacttttttttttttagcgccctccttcccttgaatgttaagttgcttaataacagtaatgtctgattcatacttggcttgaactgcttttatccactcgttgactagttcagaggtgtattctgcctttctgtttttttctatggattcatcagcagactcgttatttgtggtaaaaagtgattcgtcaaacatttcataaatttgtccgaccttattttcatgctctagaacgactctttgcaaagccataattcttctgttctcatctagaagaatgacattccctgcactgaaaaattccaaaactaaatagaagtggccatcagcaaattgtagaacaagaattctatcctggtctacttgctttaaagctgttaaccgtttagctttaagatgcttccttagtttgacaacaaagccggaaggagttggaggtattggcctactaaattcagttaagtaaattcttaagccacaatcgacaacaacattgagtttagaatctggtttattaaatttcagcaaaaattgttttgaggaatcggcaatgttatatatattactcaatcggtagccttccaaatcctgtttcagctctctagccaacagcagtaaatctagggcactaattctttgcttcatcgctattaatctcttgcctgcctgacttcttagaccggataataagtagcaactttcttttcaatttgccatcggattcttttaaaactatttttcaggcgaaatttcatttttctatccttccgcagcatgaatgaaaagttcaaacgcgtccaaatatacaatagatatagtgcattagttaatgtccggaagagaagtcgcaattgttgaaaaggttaaaactcaggctatttattgaaaatccaattttaatcgtaaccacagagttgaggtagaggctcatttgttacctgacagttgatgacattatcactgacatatttaaattcatcattagtgtaatcagcacatgctaagttgagggcactactgcaacttcagtttgtttccttaaaacccaaaagagtagaaaaccaggctaaaaacagtcacactagtccaaaaaatggacaaaaaggaatattcggagactttctatcatccttataagccctatgatattcaggtacagttaatggaaactgtatacagagtgctatccgaagggaagaaaatagctatcctggaaagccccactgggacaggcaagacgctgtccttaatctgtgccacgatgacttggttgagaatgaataaagcagatattttcacccgcatggaaactaacatcaaaacgaatgaagatgatagtgaaaacctaagcgatgacgagccagactgggttattgacacttatcgaaagtctgttttacaagaaaaggtggatttgctaaatgattatgagaagcatttaaacgaaattaacacgaccagttgtaagcagttgaaaactatgtgtgatttagataaagaacatggaagatataaatcagttgatccattaagaaagaaacgcaaaggcgctaggcaccttgatgtatcacttgaagaacaagattttattccgcgcccgtacgaatcagattctgaaaacaatgatacctccaaaagcacaagaggaggaagaatatctgataaagattacaaattgagtgaactaaattcacaaataataacacttttagacaaaattgatgggaaggtttcgagagatccaaacaatggcgatcgctttgacgttacaaatcaaaatccagtgaaaatatattatgcatccagaacttattcacaattaggtcaatttacttctcagttaagattaccctcgttcccatcatcctttagggataaggtcccagatgaaaaggtgaagtacttaccacttgcttcgaaaaagcagctttgtattaatccaaaagtgatgaagtggaaaacattggaagctattaatgacgcatgtgcggaccttagacatagtaaagagggatgtatcttttatcaaaatacaaacgaatggcgtcattgtcctgatacgttagctctcagagatatgattttttcagaaattcaagatattgaagatttagttcccctgggaaaatctttgggaatttgtccctattacgcctcgagggaggcacttcctattgcggaggtagtgactttgccatatcaatacttactttctgagtccacccgttcaagtcttcaaataaaccttgaaaattctatagtaattattgatgaggctcataatttgatagaaacaataaattctatatattcctctcagatctcgttggaggacttaaagaattgccataaggggatagtaacttatttcaacaaatttaagtccaggctcaatcccggtaacagagtaaatctattaaagctcaattcacttttgatgactctgattcaatttatagttaaaaatttcaagaagataggacaagaaatagatcctaacgatatgttcacaggaagtaacatcgataccctaaacattcataaactattgagatatataaaagtctccaaaattgcttacaaaattgacacgtataaccaggcactaaaagaggaagaatcgtcaaaaaatgaaaatccaataaaagaaacgcataaaaaatcagtttcttctcagccattacttttcaaggtttctcaattcctatattgtttgacaaatttgacgtcagaaggacaatttttttttgagaaaaattattcaataaagtacatgcttctagaaccaagtaaaccttttgagtcaatactaaatcaagcaaaatgtgtagtccttgcaggtgggacaatggaacccatgtcagagtttttgtcgaatttgctacctgaagttccttctgaagacattacgaccttgtcgtgcaatcatgttataccgaaagagaatttgcaaacttatatcacaaaccagcctgagcttgagttcacattcgaaaaaagaatgtctccctcccttgtaaataatcatctttttcaattttttgttgatctgagcaaagcagttcctaaaaagggtggtattgtagctttttttccaagctatcagtatttggcgcatgtaattcagtgctggaaacagaatgacaggtttgctacattaaataacgtgaggaaaatattctatgaagcaaaagacggcgatgatattctatctggatattctgattcggtagcagagggaagggggtctcttttgctggctattgttgggggaaaattatcagagggaataaattttcaagatgatttatgtagggctgtggtgatggtgggcctgccgttcccaaatatttttagtggagaactaatagttaaaaggaagcatttggccgctaaaataatgaagtcaggcggaacggaagaggaagcttcacgagcaacaaaggagtttatggagaatatttgtatgaaagctgtcaaccaaagtgttggacgtgctatacggcatgcaaatgattacgcaaacatttacttgctcgatgtgcgatataataggcccaatttccggaaaaaattgtcacgttgggtgcaagattctatcaattccgaacatacaacacatcaggtcatttcttcaacacggaagtttttttcaatgcgcagcctgaattcacgctaaaaggaatacgtttacgtgtatactgtgattactactatatattatagtaaactaaactgatatttatgactactttttatatctgcaagtaattctttgtctcttgtatccttacataacttccagcgttgttccacaatatacgcttatttcattaaatctttctaatagaccccttgtaaaccaaccataatcattcaaatcatctcgttttatgtctattacccgttgtttgctcacgggacatatctttacatgcgttgtaagtattggaagcaaagtgacaccacacctcttccacgtgttattcgtggtggatgttacagtttcagggtcagccgtgaagctttctaaattgaacgtttcctcgagaaagctgttcttcatcaataacgtgccgttgtaaattggcgcttctcttttaagtattgccgctatagataatacgcaagctaaatcaaaactattcgttaattcggattttttgtttatagcgtattcatataaggcttccaaaaatgacaaaattgacggtttatcgatagtcatattcaagaacattataatcctcatctcttcacttttcattaatgcattgaggtatgattggaaatccagactaatagggtaattaccattcagtaatttcttgttcatactgaaattttctggaagtttgggcagcgattggttgtaaatttggtacgtctgataccacgctaatccaacagcacgttcagaaattgtccaagtatgatatagtggggcgaacatgatgttaaacgattgttctgaagctattttatatttgaaagccacccgttccatatcgtatactatggctattgaatagccgtctggagagagagatattccgtgtatgacaagagttgtttcataattattgaattcattccaaattgtgctccatttcttgaatttcttctctaagtaaggcgcgataatattatcagccgtcacatgaagttcgtcttctagtaaaactttataactagtcttattggacatcaataatatcgtgctctctttctcatgattcaatgggattatatgaaaattttcgagagatcctgttttcaagctagaaattgaataattttttaaatctatcttatgcacatatccgggacaagttaaaaccaccttataatccactatctttaaatcagtaatttttcttctcgaagcattttgtatcattctagaaacgggttgatgagaggaagcagaaactgtcattgaaaatacagaattgtttgaaagcgccgctacaagaacgtcttcgtaccatactatatgagtgacccagtcttttgagcctgcgtcacttaatctaatactactctcaaaataaaattctggagtattttctgaatttttgcgaatgctaaagaattgaagctcaccgtcttcattaccaaccacgattgatgattcaataggattccattcaaaacaatggtaggttctgctacttaagtttccttttgaatcgagatttgtgagcattttgttatctttgaacacagaaacattaccattattgctcaatacggccatccaatcgtctattggtgatggcttacagactctgggataacaaacaggttgtgaatttaataacccattctgttgcgccagctcgaaatccagtttattttcaaattctagcgggaattctttcacatgaaataaattcttactgttgcaattaatgtctttagcatattttggctgcccaatgctaatatcaggaaatgtggtcaaatatagagtaccatcccgagcccatgttaaattgttcttccaatcctcaaattcctttctatctaccaataagtcctttagaagcttcattatgaattgaattggctttcctaactcctaacaaagttagtcatgctgcttttttcattatatataattctgtctaatcattgtttagatctcattattgagaaaagtgcgttgcgcgtaagaaacagaatacacttaaggtgcgaaatgacggaagaaatacgccatttaaagccttccaatacgaagcaaaacttcaaaagcaaatgctgggaagttggattatctttgggaaggtctatttccttttttattgaaataaatcattcagctaattgcataccgtggctaatgtcacaacagatgtaagcaacaatttaatcttacataaatgtgttgcagttgtggtatttcgtaatatatacgcaatgattctctcctattattgaactgctatgcaggtattcgctacattgtttttctacaggcagtcgtcgacataaataacttgtataatcatttaagcgcatcccagtaattaactattaccgaacgatagagtagtcaagatattctcttcccatcactaacatcaagagcgccactttttggcaattaaactagacttctggatggcgctagcccattacctacagtactaaagattatttgcgatattctgataaagagccttgaacttctcgggtgacccccttagcgtttatatagcgggagtgccaaacgagaggaacatcaacaaccagtataacaacgttcttgtgtagaagataactaaattcatctccaaaaagaacaagagcagaacttcaattagtaaaaccatgaatgtgctatggattatagcactagttggccagctgatgcggctcgttcagggaacagctacctgtgccatgtatgggaactgtgggaaaaagtcagtatttggaaacgaattaccttgccctgtgccacgtagttttgaacctcctgttctttcagatgaaacaagcaaacttttggttgaagtttgtggtgaagagtggaaagaggtccgttatgcctgctgtactaaagatcaagtggtagcactgagagataacctacaaaaggctcaacctttaatttcctcatgcccagcatgcctcaagaattttaataacctgttctgtcacttcacttgcgctgctgaccaaggaaggtttgtcaatattaccaaggtagaaaagtcaaaagaagataaagatattgttgcggaattagacgttttcatgaattcgtcttgggcatctgaattttatgactcatgtaagaatattaaattttctgctaccaacggttatgcgatggacctaatcggaggtggtgctaaaaattacagtcaattcttgaagtttttgggggatgctaaacctatgcttggtggatccccctttcagattaattacaagtatgatttagcaaatgaagaaaaagaatggcaggaatttaatgatgaggtttatgcttgcgatgatgctcaatataaatgtgcgtgttctgattgtcaagagtcttgcccccatttaaaacctttaaaagatggcgtgtgtaaagttggccctctgccatgtttttccctttctgttctgatcttttacacaatctgtgcactttttgcatttatgtggtattatctctgtaaaagaaaaaaaaacggggcaatgattgtggacgacgatattgttccagaatcaggttccttagatgaatcagagacgaatgtattcgaaagtttcaataatgaaactaacttttttaatggtaaactcgctaacctatttacgaaagtgggacaattttccgttgaaaacccctacaagatattaataaccactgtttttagtatctttgtattcagtttcatcatatttcagtacgctactcttgaaacagatccaattaatttgtgggtgagtaaaaattctgaaaaattcaaagaaaaagagtacttcgatgataattttgggccattttacaggacagagcaaatatttgttgtgaatgagacaggccctgtgttatcatatgagacacttcactggtggtttgacgttgaaaattttattacggaagagctacaatcgtcagaaaatattggataccaagatctctgcttcagaccaacagaagattctacatgcgtaatagagtcttttactcagtattttcagggggccttaccaaacaaggatagctggaaaagggaactgcaggaatgtgggaaatttcctgtaaactgtctacctactttccagcaacctctaaaaactaatcttcttttcagtgacgatgatattctcaatgcgcatgcgtttgttgtaacacttctattgaccaaccacactcaatcagctaatcgctgggaagaaagattggaagagtatttattggatttaaaggtccccgagggcctgaggatcagttttaataccgaaatatccttggaaaaagagcttaataataataatgatatctcgaccgttgcaatatcatacctgatgatgtttttatatgctacatgggccttgaggagaaaggatgggaaaactaggttgttacttggaatatctggtttactcatagttttggcttctattgtttgtgcagccggatttttaactctttttggtttgaagtcgacattgatcatagcagaagtaataccgtttctaattttagcaataggaatagataatattttcttgattacacatgagtatgatagaaattgcgagcaaaaaccggagtattcaattgatcaaaaaataataagcgctatcgggagaatgtctccttccattttaatgtcattgctatgtcaaaccggatgcttcttgatagctgcatttgttacaatgccagctgtccataattttgctatatattccacagtttctgttatattcaacggagtattacagctaacagcgtatgtgtccattttgtctctctacgaaaagagatccaattataaacaaattaccggaaatgaagaaactaaggaatcatttttgaaaacgttttattttaagatgttaacgcaaaagaggctcataatcattatcttctcggcttggtttttcacatctctggttttcttaccagaaattcaatttgggctagatcaaacattggctgttccacaggattcctacctggttgactattttaaggatgtttatagcttcctaaacgtaggaccaccggtttacatggtcgtgaagaatttagatttgactaaaagacaaaaccaacagaaaatatgtggtaaatttacaacttgcgaaagagactcattagctaatgtactggagcaagaaagacacaggtcaacaattacggagccattggctaattggctggacgattatttcatgtttttaaatcctcaaaacgaccagtgttgtagattaaagaagggaacagatgaggtttgtcctccctcttttccaagtagacgttgtgaaacttgtttccagcagggttcttggaattacaacatgtcagggtttcctgagggcaaggacttcatggaatacctaagcatatggattaatgcgcctagtgacccctgccctctaggtggtcgtgcgccatattcgactgcgttagtttataatgaaacgagtgtgtctgcgtcagttttcagaacagctcatcatcctttgagatcccaaaaggactttatccaggcgtatagtgatggagttaggatatcaagttctttccccgaactagatatgtttgcatactcgccgttttacattttttttgttcaatatcaaactttgggaccattgacgttgaagctaatagggagtgccattatcctaatttttttcatttcatctgttttcttgcagaatatacgcagctcattcttactggctttggtcgttaccatgattatcgtagatattggtgctttgatggccctactaggtatctcactcaacgctgtcagtttagtcaatttaattatttgtgtcggtttgggtgtcgagttttgtgttcatattgttagatcatttacagtggtccccagtgaaaccaagaaagacgcaaactcaagagttctctattccttgaataccataggtgagtccgtcatcaaaggtataactctaaccaaattcattggagtttgtgtacttgcattcgcccaatcgaaaatatttgatgtattttactttagaatgtggtttacactaatcattgtagcagcattgcatgctctcctatttttacctgctttactttcattgtttggtggtgaaagctatagggacgattccatcgaagcagaagattagccatagcagattatactatattttacgtagtgaaaaaataggtaaaaattcgttaattattctgatgccacaccagaaaatctgtgggaaaatttttcgagtcagaaatgataacactaacacaggcttcgttgttatcgtgcattgaagttagatacttctactatatttaatctttaatagtgtcataaaagtattattggtttcgggcgaaaatcgtcattttcgcacacagaacttcaaaagaggaaaggccaaaagaactaaaaccgattacttcggggtgattttgttctggcatcttctggcactcttgggcatccttagccatttagtatatttatgaatacattaaggtgtttgacacaagcactatccaaaagtgggagagaagctccaaaactatatcagaaagtaatatttccaggcctgttcagagagggtataccaattgcaaatgtcaagaaagttgatgaaaaaataatagatagcccaacatcaacgtcagttaatggagaggcaaaaaaaatagtacggcatggtgtgaagtatgaaagggagcaagttaaggaatacctttcaagcctgccgactttaacgctttctaggaaacaaattagggatgactatgatgaggaacgtgcaaaacgaatgtatatgttctctaaacaaacgaattcctcgaataaattccagaaacttcttacagcaaagtctcaagagtttactagagaactattgacgctactgatagattgcacatcgaatgagaagaattcagggccagaacgcttcactcgtaagtttcttaagtttagtaatgacgagatccctcctctccctgacttttcaaagaaccctcaattgtttgaaaattatattggaatactaagtcatacaaagttcaattttcgttcatcttccaaactaaatggtattgtgcgtaagatgctgcggcacctacttcatccaaccaataagacgactctgccgttgcgttctgctcaagtttataatgactcaatatactttttcagtgagcacttcgactttgcgtcttgtagagaaatatttgcacaaatgaaggctgaggggactaaaccaaatacaatcacttttaatcttttactgcgtaatgtagtgaaaaactcgcatattagaaaaacgaagcaccctgacgatgaggtccttttttatcttagaagtatgcgtaatcatggagtttttgcagatgtaataacttggacgacatgttataactttcttcgtgatgaagtttcgagacaattgtacattgttcaaatgggtgaacatttaggaaattttaacgtaaattttgtttatactgtgctaaggaacggagattatagagcagaggactgtttaaaagttttagcagcaaattcactaccgatttcccgtaagacgttctatctgtgcatagaacgactactaaacgaggaacaacttgaaaccgcatctaaattacttgactatggttttcagcacttgaaaagtaattttaagttggactcggaggcaatgaatcatttcatgcgggtatttgctaataagggaagaagtgatttggcattcctttgctataatacttgtcgtaagatttacaaaattaaacctgattctcagacgttcgaaatgttatttaaagcgttagttaggaatggcaacaccaagaattttggggcagtcctacagtatatcaaagacttaaaggttagtgaaggatttggattgcggacaagttattggagaaccaaagcagactcaattttcaaatttggtagtcctaatacgctatcagaaaagtcaattgaaaaagcaagaaaattgttgggcaacctgattgcttccgagggtgagttctcttggaaaatttggaaagaaagtgattcttcacaaaaaaaaatactacgttttttgggttgtatccccactactttacgctgcaccaatacagcacaagatcatcagaagcccacaaacctaccctcaaacatttcccagaaaaaaagagaatatcgaaatcgggttaaagcaatagccacaaaggctgctttggaaaaaagaatggcgtatatcaaagacaatgatgtagctttcaaaaaagagctagtaaagaggagaatagttggggaggtttgatgagggaggcataagtgccctggcatttggacaggaattttattaatataggcatttttattgtacatatatacttcatagatcatattcatttaattagacttcgaaaagttgaatctcttacggcaaaggagaacaagagaaaggttaattattaggtcttataaaatttgttcaattaattataaaggtgattacaataccggaatattggccgaacaatacttgaaccaaattcagatgaaattaataataggtagacacgagctggtgaaaaacaagcacaatatagaaaggttcgaatatattaattattagaaaaaactcagatgttttcagaaccggaggtatgaccgttttgactaacatgatgatcggcctcatgggcttcatcatctacaggaacttcagtagtccattcaacttcctcttcttcgactacttgaccggggatatctccattttggatttcaggttcttcttcttcttcaccatcttcgtcttcatagacgtcatcaacggtctgatgaaatgaaagagttggtttgactgcagccatgtctagggtccaagattccaaggccgattcagcatccataataatttggcgagaagcttcatagccatcgtacgctggtctagcttcacctggagtgacaggagagtcatctagcagctccaataaggcctttccgtatccagcaatcagggcaaatttttcagaaagctctcttaatgaatcaaacatataactataagcagcctttaatttttcacgtgtgatattcgataattgagcctccgcaaccaaagattcagcttcggcacgaactagttcttgctctaaaactgggatttttgttgattgaggatctttatatttcaaatgggcaatttcatctgtgatcttttccttacgatctctcgaaggttgaacagaggcttcaatgttcctaattgattttaatgtgactctgtattgatcatatttatcgatgaactggtcctgtagttcacccaactcatatattaagacgcctaatttgtcggttacgtcggaaacatcatcatcattgtcagcaccccatagagacagttgctttgcagcttcacggcgttcgctggcaacaacttccatagctctaaggacacctttttcagtcttaaccaattgagataatttacgagccaactctggcccaaagttaccagccgcattttttctaaaactagacgcaatagaggcctttccgaagaacttggacttcgttgaggatggtggtggtggaggagcttgtagctcagcagccgttggagctctttgatttcttaaagagtaagttctgtgcattcttgtgttggagctttgaaagtttaatctttcgtataccaaataaagagaatttacggtcaagcattggaattgaggaaagaggttaactgatttttttcttttctatctcacctgtttatatattgcgatttagccgttgcatcttcccggtttttccgtcttttttttaaagggcccctttttatcccctctaacgcctttcgcaatccccttttcactcggctgcaacgagcggggttgtaagagctaagctttctagcctagcaatgaaatagaaggacaagtcagacgattgacgtcaaaaaaatgagtcgcctctctttctttcttaggccaactagacagccgtagatgaaaatatggaaagatatgatagacagctgagactatggggagcattgggccaagatagtttgaaccggtcccgtgtgtgcgtggtaggacctgctacacctttgctgcaggaagtttttaagaatctggtgcttgccggaatatcatctcttacttggctcaaagtagagtgtgcagttcaatcgggttctctgtttttagcagagcttaaaaaagatcttgagccattggcttctaaacagctagaatatgaggaaaatgaccttagaaagacgttacagcaacctcagtatgattggacccgcttctcggtggtgatcttgacttgtattggtgagcaaactgcgatgctcgatttaaatgagattaggcggcagagaggaacaaagtttccgcctgttctaaacactttcgtctctggattttatggatatatatatctggtactctcagaaacacattttgttttgcaagcacacccagatagtaagaagtatgatttacggttacagaacccttggcctgaactaataaattacgtagatacatttgacctaagtaaaatggatacagccacgttttctggtattccatatactgttttgctcatgaagtgtattgcaaaacttgaaagggatggtaataatgggaggataacgattgatcagatgaagaaagttttagaccaaatttgccttcctttagggaatgatgttatctacgaacccaattatgtggaagctaaacgctatgcttacttggcctgctctcaaaatgattgttgtaaagaactggaagatctgctccgaaatttggaaatatcagattatgggaacgattggcatgatacttataactacgagattctcacactattattgactttgaaaaatattgctaaagagaatggggagctcagctttcaacctttaacgggcactctcccagatatggagtcaacaacggaaaattatatcagactcaagaaactgtatgaagtaaaagcaaagcttgacaagtctcgtgtggaggaaagtttggctcgcagtaaaaaaatagtttcacaggatgtcttggagacattttgttctcattacggggaggtcaggaaaatattgccgccaaaaagtgacttgttaggtatttttagcacctcgaatgcccttttagatgcattagttatggtccaattctgggagcaaccggcagtaactgcagaggataaagatgagtttattggtttacgagtcgacgataactattccgtaatggccttttttggaggtgcagtggttcaagaggctataaagcttatcacacaccattacgttcctattgataacctatttttatataatggcattaataattcatccgcaacatataaaatataaaattttttcgtcagctctccgagttcatagaatgcttattttattgtacttccctggtttgcgttgatgcaaataaagactaaatgtaaacttttatgatgcatatgatatcgaatgtttacaacaacgagagatcaccggtaagaactgtgctcaataaaatacaacatcgataaatacttaacgctcatccaccattcctgttcaagtcaactatctcacagttgcctcgtaatccaagagggatcccaatacaacgcctctgcaccaccttgataatcaatccacaataaaccgttagcgaccatttcatcaagagcagatttactcctaacagcctcccatcccaagtttgcctttaataaagagatacttgagtagcccagaattgagcatatttccaaaatctttgtttgatctgatgtcaactcatttggaacacttcgtaaaaactttttgccgcgaatttgaaatatctcaaaacactctaggctctttagcatgtcgatagatttttccaaatcatcgagtccaacattcagcttacgaaaatgcaccttctccaactcttgaaaagaaatgacgcctccattcatatctttagtttgccgacaaatttctataactttaagacatacttcataataaaaatcattcactgtaaataagtgcttatctcgatcaaataaagataggggatcaatcccaatagatgagcacatatgcatgaattttgagcggaattcaggtgaagcttgaagctcgctattgtgtttcttggcaaattctaccagtcgttcttggaataccattaattggtcccttagttcgacagattgcttttcaagtatggttttgtttacgtcattgtactttccatccttcaactcgtcaaaggctgccagtccaaactgtttcatgttagtgagtttcgaagttggctgttacgccaagcattttcaagtcgtggtaaagtctttggtctactgcatcgcctcaaaaggttataatatatcccagaattgatggattaagttcttgaaatagcacaccgttataagtgataaatatattgtcttcgaataacgaatttattagatttctatgtatttctacttgaagttaggaatagatctttctggaattgttttcagcaaaattatgcttaagctataactatagtgagaatcaagaatatgtctgccaatgatttcaagcctgaaacgtggacttcaagcgccaacgaagccttaagagtttctatagttggagaaaacgctgttcagttttcaccattattcacgtatccaatttacggtgactccgaaaagatctacggctataaggatctcatcatccacctagcatttgattcagtaacattcaagccgtatgttaacgtcaagtattcagcaaaattaggagacgacaatattgtagacgtggaaaaaaaattactctcatttctaccaaaggatgatgtaattgttagggatgaagctaaatgggtagattgctttgcagaagaacgaaaaacacataatttatctgatgtttttgaaaaagtatcagagtattcgttgaatggggaagaatttgttgtatataaatcgagtttggttgacgattttgccaggagaatgcatcgtcgtgttcaaatcttttcattactttttatcgaagccgctaactatatagatgagactgacccgagttggcaaatctattggttgttgaacaagaaaacaaaagaattgattggtttcgtcactacttacaagtattggcactaccttggagcaaaatctttcgatgaggatatagataaaaaattcagagccaaaatatctcaatttctgatctttccaccttatcaaaataaaggccacggatcctgtctttatgaggctataatccaatcttggctagaagacaaaagtattactgaaattactgtagaggatccaaacgaagcatttgacgatcttcgcgacaggaatgatattcaaagactgcgaaaacttggttatgatgctgtctttcagaagcactccgacctttctgatgagtttttggagtcaagccgaaaatctttaaaactggaagaaagacagtttaatcgtcttgtggaaatgcttcttcttttaaacaattctccatcatttgaattaaaggtaaagaataggttgtacattaaaaattatgatgccctagatcaaactgatccagaaaaggcaagagaagctttacaaaattcatttattttagtcaaagatgattataggcgtattatagagtcgataaataaatctcaaggttaactgtttattaaatatataataacatatttatttgtttaacaagcctgaaataagaaattcttttataaatacatcatcgagatgatcatcaaagtgtctctatagttaatataagcttatgcaaaggttgaagccgttatgttgtcgtaattctaaattacaggttatattaaagagattatcttgactgatataaaatttcttatcatggtagtgatcacaaatagatcacatgatatattttttatttttaattttttttaattataaaaataatttttttctttaaattaaacaaaaataaaaaattgttttttgttggttaagatttccgaaaatagaaatattattcagttgaaagacaaaaaaacataaatatttctatgagcaaacaatttgaacagaaaaataaaattggggaagtgacacaccatggtagcggttctaaagcgaaatcggcaaagcggctaaatagcagttttgatgacttactccacactgaaaatggatgaccttaaataggagataaagctttttcatccctatgtatttaagatgactggcttgtcaagcattctaatcataaaaaaaagatcgtatttgatcaagaatttatacatagacgccgctaaataattgaatacaaaatggtacaaaggcttctaccgggcgcacatatatgcagaaggtccttcaattcgtctgcaattataaagtcttctgcattgactctcaaggaagcattagaaaacgtgatacctaagaaaagagatgctgtgaagaaattgaaggcctgttatggcagcacgtttgtcggaccgattaccatttcatcagttctaggtgggatgagaggtaatcagtcaatgttttggcaaggaacatcattagatcccgaacatggcattaaatttcaaggtttaacgattgaagaatgtcaaaatagattacctaatacaggtattgatggcgataatttcctgccagaatcaatgttatggctgttgatgacaggtggtgtgccaactttccagcaagctgcttctttcaggaaagaattggctattcgtggaaggaaattgccacattatacagagaaagttttgtcaagtttacccaaagatatgcaccctatgacccaacttgcaattggtttagcatcaatgaacaaaggatccctctttgctacaaactaccaaaagggcctcataggaaagatggaattttggaaagatactcttgaagattcgctaaatttaattgcttcactcccgctgctgactgggagaatttattcgaacattacaaatgagggacacccattaggtcaatatagtgaggaggtggattggtgtacaaacatatgttccctgctcggcatgacaaatggaacgaactcttctaatacatgcaaccttacttcccagcaatccctggacttcataaacttgatgcggttatataccggtatacatgtagaccatgaaggtggtaatgtttctgctcacaccacccacttggttggaagtgcgttgagtgacccgtatctcagctattcatctggaataatgggattagcgggtcctttgcatgggttagcagcacaagaagtagtaaggtttctcatagagatgaactctaatatttccagcattgcacgagaacaagaaatcaaagattatctttggaaaattttgaattcaaaccgtgtgatccccggttatgggcacgcagttttgcgtaaaccggatcctcgatttacagcaatgcttgaatttgcgcaaaagaggcctattgaatttgagaacgacaagaacgttttgttgatgcaaaaattggcagaaatagcgcctaaggttttgttggaacacggaaagagtaagaatccatttcccaatgttgactctgcatcggggattttgttttatcattatggaatcagggaattattattctttaccgtcatttttgggtgttcaagggccatgggacccttgacacaacttgtttgggatcgcattctaggtttaccaattgaaaggcccaagagtttgaacttggagggtctggaagcacttaccaaagcaagcaatgttaacaagttgtaacgcagttccaatttacaagaatgcttcgtttgctattacaatattgaaatataaataaaattccatacagcatgtctaatcatagctaatttatacatattcatcatgaaaacatataggggaaaatatggtcggttaacacacctatcaaaaaattattcagcaattccaatctcgttagtaaaatatattcttattttttttttttttctctgattgtattatttctggagttttgacttatttttttaccacatcgcgcttttcgtccccaatctctctgatatatgatgctgtctataggtagccacttccccgatgtcggacctcgggccgtttacaaactttattgagatgaccttatttctccacattctagtcattcaacttttaccctcatatgtttaccttcactaatgtgaaagcatgaccaaagaaagtgtataaggtatataaatctgccataatgtatgtataacttattaggactttctcaaatagtattttggtattttctactgttctctgatgatcgagagcaaacagaatgtttttagccaaaaatctaaaaaataataaaatcaaggtatgcttgcctaaaaagaaatttgctgcgctgagtacagcgtctatacaaactaatgaaagaccaaatccagataaggttttgaaggacatcgcgaaatatgtccatgaaaccccattaaaatcatctttggctctagatacagcacgactctgtttccttgatactctaggctgtggcttggcggctttgaaatttaagcaggctcaaaatattattaaaccaattgtgccaggaacaatagttcccagtggaacaaaaatattgggcacatcttacgttatggatccagtgaagggagcttttgccattggtactctaatacgttggttagattacaatgactgctggttagctgccgagtgggggcacccatcagataaccttgggggaattttagctgtcgcggatcacttgtccagattaaacaaggctacccacggaaagaatggaaaacagtttcttgttaaagacgtattagaggcaatgattaaagcgcatgaaatccaaggtattatagcgctcgaaaattctttcaataaagtaggtttagatcatgtggtactcgtgaaagtagcaacggctggtgttgtctcgaagatgctgggcctgagccaggaacaaactattgaagcattgtcacaagcatttgtagacggtcaatcactgcgtacttaccgtcatgccccaaatactggatctagaaagtcgtgggcggcgggagatgcagtttcgagggctgtaaacttggcttatttagtcaaaaatgctaatgttggcacgataccttcagtattaacagctagaacctggggattttatgacgttttatttaagggtaaacctttttcattccaacaaagatcaaaatatgattcctacgtcatggaaaacgttctgttcaagatatcatttcctgccgaattccatgcgcaaactgctgtagaagctgctgtaaaagcatataggattcttgccaaacaagggaaaacttttaaagatattaaatcgatcagaattagaactcaagaggcggcaatgaggattatagataaatccggtcctctgtataattatgccgatagggatcattgtatccagtacatgatcgcggttccgctgattactggtaatctcacagctactgattattcggatgaggtcgcaagaaatcctgagatcgataacttgagatcgaaaatgtactgtatcgaagatactcatctcactcaaaactatcacgatcctgataaaaggtcgataggaaacgctcttctcatagagctgaacgatgggacgcagttggatgaaatttttgtagagtaccctgttggtcacaaatttagacgagaggaaggaataccattactaatgaataaatttcaaaggcatctgcgcgaacattttgtagagagccctgataaagtcgaccttataatgaaggtaagttcaaaaacaaactttttgaatatgcaaatcgacaaatacatggatttgtttactgagggatgaatggttggctctttaagagcgaacggcatggtacctacttcaatttttaaagacaaaaggcgccgtttcgataaacaagaaatcactttcaaaacataattaaaccaaagaacatgcggttttctaattatgctggcttaattttactggtatttatctacataataataactattaaaaaattaaataattggctctatttatttttctttcttcaacttgcaagagttcgtcaattcatggaaaaatacaaaaatagaaatgcgaattctgtggatcgaacacaggacctccagataacttgaccgaagttttttcttcagtctggcgctctcccaactgagctaaatccgctcaatttctatgctctaaccaccttagctaaaaactcaatacaggattagttgataaatgggtgttatcaactcaatccacagtgttggaatcagagtcagttatcatctttgggctagtattattgtaagtgttggaataaaaattctaaaatatcatccatttagtagtgttcatattactaatatatctgttggaataaaaatccactatcgtctatcaactaatagttatattatcaatatattatcatatacggtgttaagatgatgacataagttatgagaagctgtcatcgaggttagaggaagctgaagtgcaaggattgataatgtaataggataatgaaacatataaaacggaatgaggaatattcgtaatattagtatgtagaaatatagattccattttgaggattcctatatcctcgaggagaacttctagtatattctgtatacctaatattatagccttcatcaacaatggaatcccaacaattatctcaacattcacccatttctcaatatcatcacgtgcggtctaagaagatgatatgaagattgagaatagtcatcaggtgtaatggaagctaattgcaaggattggtaatttagtaggatgatgaatgacagtcacataagatgaaaaggaaaacaataatgccattatatcgagaatatcgatctcttcgtggattcttctcatagagaaattctagtataatatatatacgaaatattatggcctttaacaacaataaaattccaacaattatcaactaattcgaacatctcttgacaatatacattattaatttttacatttcgactttctttgaattagggactgtctctcaattcatctctttctcatacagaatatcacttatcctatataacttatataagattagaatctaactagagcgaggagagcggaaactcggatcaaaagtgattgtttaagtgtttgtgcgtttgtgcggctcattaagacaataaggttttgcttttgtattcaattttgtgggttttataacgtataaatgcgcttcttgaaagcttgttaacgattttatcgtaaagaaataaataaactaaagaattgaggagacaatactgttttgataaataagccccaaaaatattatagggccgcaaggaataaatttcataatgcgcatatgcccagactcctctgtttctttcgaagttttacactagacttgaattaaataaagtattggacataaaactctccgaatcattgttcgggacgttgttccctttaattttcattttctcaatttcataaagagccgcatcaatgctatcgaagtacggagaatatgtctctcctgcatcactaaatgtgttgctagtattattttcgttgttatttgcttgcgctctttccacactagcagctacacctgctttgaataatcgccttcttactttgtcatttatagatacattgacaaggtaaataaagacattgcgcctcttgtaactagtgataatttcctccagcacttgggcggctgaagaatctattgaggtcatcccacctaaatcgaaaatgacatattttatggaatccttcgagcgaagtgatttccttccaggatgtatcttagacgaaccgtacctctctattctgtcaagtctctgttttaaatcttcgctgtttgtaaatgtgagaggctcaggtattctaacaatcatgcatccctcgatttcttctgtgccctcaacatccagagagttccttttcatgttcatcatgtagtcgtcaagattcgtaaagttcgacgttcccgctaccctagccagaatttggattcttgactttgctgaatgctttataatatttataattgaatagacacatccgatgcatattcctgcttcgattgagtaaaatattgtagtgcagaaggtaacagcaaaaacaaatagttcactaaagccaccacatcgcaaatggaactttatgtcgcctggcacttcctctaataaactaattccgatgatggttgttatgacggataaaacacaattaggaatataatgtacgaattgaagaagtaaattcattgtgattagggtgatgacacccataaacactcccgacattacgctttgtgctcctgatagggcgttgatcttggatcttccatatccgccgaatgcgggaagagcaccgaataatgagatgacaatattcatgaatcctaaagctactagttctctattagaggaaacggtaagattgtaagttgttccaagagatttcgacgcggtcgtagattcaaaaaaacccaacattgccactattagagatgcactaaaaagatctggtattagcttacgtctaggacgagttaaagggtttttcaattcatcaaaattgtccatgctaaagtcgccaatgatagaaataccatatctgtgttttaaattaaatttcatggaaataagaatagtaacaattaccaccaataatatatctggaaaaaatattgcgctcttgtgatatttcattaatttcctctttagtagacgcgttaaaaagaggacaatcaagcaacatccgctgaatattgccgttggtatatggtattgtgctggtgcataatcaatgaggaaaagtattttctcgaaaggggtatggtagtgttgaggcaagcttactaaaaatttgtctagctttaattcagaaatcaaagagttgattatcataaccagtcctactgaacttatgaaacctcgtagaagtgccttgctaagaacatttccaaggaaaccaaatctggaaataccagaaaaaagtaggatagtgccactaacaaatgttattactgttgaaatatcaattagagaaacattttctttatgtagtgttatagattcgactgcttgtcccacgaccaaggaaattgcactttcgggcccaactatcatctgaggaacagaacctaaaataccatagacaaatgggctaatagccaaagaatatagtccgcataaaggtgggacatgtgcaattgaagttgtgtacgatagcgcaagtggtatctgaaatgacgctactgagatacctgcgattacgtcgccccacagtttattgaaagtgtactcaggaagccatgaaaagcagggcaggtaataaggtaaagtttcaaacactgtattctcatcaacgctatcattattgttcgtattacttgtattacttgtattatttgtattatttgtattattggtgcatcctgatcttgagttgttgggtgggggtaccccagtagttgaattagatgctgcaatataggtcctgcctcgattggatgaatccttatcataatcaaaattgtccgagaaagtgtcacgctggtcgactgatcttttgaatcttggtggagcggtagaggaatatgacatccttccacgccccaataacgaattatttgatgtcatcctataattgtttccgtaagttcttggaaatcactaggaagtttgtggagttattgttctcctcatattctcccatctggaagaactctattattcctttgccatttctcgtagtcttttatatttagtccgctttacaccgaaaaggtcatttttaaaaaggcaagagaactaggaaaagtaaaacgtgcccccttcaaagcgaagagatgaatatatttagaagttaagaatttatttatttatatttaccaagtttttcagttagttcagggactattttgtaaagatccccttgcaacccatagtcagcgacattaaatataggggcatcaggatcattgttaatggcaacgataactttcgaatccttcattcccgctaaatgctgaactgcaccagaaacgccaatggctatatacaaatttggtgcgactaccttaccagtctgaccgatttgtagagaattatcacatagtccattatcaacagaagctcttgtggcacctatagcagcgtgcaaaacatctgctagcggcgataatagcttctcaaatgtctccttatccttgagtgcccttccaccagttaccacgttctgtgcagaagtaagttcaggcctttcactcttggtaagaatagttttaacccaggtaacatttaagtcacaaggaggaatatcagttctcttctcaatggtaacagaatccatactaccctctgcaattggtggaaaagctgatgccctaataatcaacagttttttttctgcctggcattctattgtagaaataatgttacctgcataaattggccttataaaggtcttaggatctttgattacagtaacctcacaaacaggttggacgtccaagagcgcacccacccgaggtaaaacactttttccaacagaggagtttgagacaacaaaatgtgaatagtcgccgccttttaatagtttcactaataacggagttagttgttcgggaagacaggtatctaattttgaatcttcaaatatgacaagcttttctaaattgctgcatgaatatgaagattttagcgcctcagcagttttttcagctttgctacctgtgattacagctgtgatagggttagacaacttttgtgcagcagccaataaactcaatgatgaccttgaaacagagccatcttttgagctttcaatgaaagctaaagtggaggcgtaatttttctggaggaactttgccttgctagctctaggcaagacagcagccaatgatttaaacatagaaattaacaattagctgctttaccgttaatggtagtaaattatatcactagattttgtttgttgattattttaattgtttttaatttttagttagtagattttcgttcgaggccctaaaaatgtaccgaaaagtcataataaacgggcggagtcacatcgtaagagtaacatatacaatatgcgagcagactttgtccattaagccaagtaacaacaaaagaaccaaaaaaaggaaagtatctcgtctctgttgagtaattcttatatcttgcaagatttaattctcactactaatacggaactcaatcaaagtggcttaatcccaagacatgcattgaatacggtatcattggctgttgacagtttaagaaaagtagttgtcacgttcctgaggttactggggacaagggaaagtagatactcgtcttacgaaattggatatagttactctctaatgctcaatccatgtaaagcatgaatcatctcaacagaaaaatctgggagagcatatttgcaacaaaagaatccaaatatcagtatataattatataagtgagctaagaagtgaacaaaagaaaaggaagaggggaaaaattttggctggacttgtagaacgatagaacgaaagagtccaagggggaagtaataaagttattgaacgaaacaacaaaaattcgatggagatattaacaaatgcatagcagcgcagctaaccgacccgaagctagtaccaacgaatttttcaactattctgtgttgattgtctcctttgcaacaccgagctcttcagtattctcagctgaaagttattattgaaatcacgttggggactttcatgatctagtggtcttggtgagtagcatttaatattttgaccattgaaagggcatctctcaattggagaaaggccactcttagggataggcgttttaacaatctgtttatgggatgaatgatatatttttgaggatggattcacgatactgatatgtttcccgtccgcattattcggatatgtagtgccttctttcgataaaatagatgccaatcctggcgtatgctttgtttcgatgacggagcttaccaatttttcacttcgtattttcgatgagttcttatttttacatttgacgttcaatattccgacatacgtctctctttctgaaatgttggaactctgtggccttggatttggtgttttttcacccgaaaaattgttgataactgcacttttctttgaggtactactatttatatcttcctgctcttttgttccccgcttaagatgttttggatggcaagtttcaataaactgcggttttattcctgcttctgaagaggtgcccgagatgtgaacctcatttccaccactaccagtataagtaaagtagtccgtaccttcttttccaaagtcatttgaggaatataccaaaaaaacaccttcctttacttgaaagcgatccacgaatgggaaagtatccccttccgaagtcacatctgagggaacaaattttaaaacatatgagatgttgttttcatccacggcatcataaaatttacagcaattattctcatacatcaagtttttgagagtgtagtcatgcaatcctaaatctttgaaatgcatctgatctatttgtttctgtatttctcttttcttgagttatataaacggaatgattagtagtttggcagaatttatagcaagtattaaatagttgaatacctcaatattctccataataaacgccatatcgtacataaaggctaaaacaagaatgcctgataccgttctgctttttgttttatctttccctatattttctttcccttttgatgctttacgtaatttttcccggcatatgtgagcttcctaatagactctatttttatttttccctttcaaagtgcgagagaaatacacacaaccagcctacgcttattttcacccataccgtcatacgccatatgatatataatgtgaaacaaacgcggggaagagcgcgacacgacagcttagcaggggcattccacgcaacacctgaaactttaagtaaaactgtttctgcgaggatatcttggcaaaacaaacactaactttcgaactaaatatagtgatcgtggtcataaattaataaaaagaggataaatagagataaaagagatatgtgactaagttgctggcaatatgtattatttatacttttatcttcttgaagcgtattcaaaattgcgtttcggtaaagctctcaccagatgtacttaaagtttgggatgaagcaccgttttggacaactttcattaaggaatcaacatattctgcaccagaccatagctggtgtgtcatgatatcacaattagtctccttttcccgtttttgcactttttcgacgtatgctttcattccgtcactttggaagctattggctaattcccagaatgatactccatctgaatgcagaccggcaagggaaaccagttgcaacgtgaagccttcttttgccaagtcccatacgaaggattttaatgccttatcatcaaagccgtgagcgctccaattgaaactaggagataagttatatactagcttggtagctggaagttgtttatgaatttttcttgaaaatgagcgtgcctgctccaggtcaggagttttcgtttccagccaaatcatatcagaatatggggcaaacaccaaagatcttctaatagctgcttcaatacaaccgttaaacatgtaatatccctctttggtcctcggagcatcccagtcaaatataattttctttagtggtgtcacttcttgagctaaaagtttcatttctcttaagcttaggtatgctctacccagcttgtttaccataaggtcttccttcttttctttatagctttcaaactcgcttgccgtaaactgcttttctaaggcctcttcaaatgtaaacagctcattttcatggtaccattctttttccatgtcagcaatggcggagttgggaatttttttgtcctccatctcaatcaatttttcgctccaaggcaccacgttatctcttattatacccctaatgaattcgtggtctctcggatcactgcttgaactcaacagcttaccattacaggaatctgttcttgcaataaccaaattttctgtccccatgatatcccattgaaacctggtggaaatcaatctcataagatgtgttgctgtgggcaccaaaacagccccacttagatggccacaccttttgcctcccaccatctgatcttcaagatgaataccagcagcccctttctccgcaaacaacttagcaactttcattacagtcgttgggccaccgtgacccatgtctgcgtccgcgataattggttttaaataatcaacaggagtagaacctttgatggaggcctccaagaaagcctttcgatcgtgcaattgctgcgccttgaatattctctccacttgattcggcacagtatcgtatggataatcgccaaaatccggcgatacttcatttgtagatccaactaatgtggaagaacaagcccaaccagatatgtaagcaactttgatatttctgcaacgggccaactgactcatttgtacaggatcgataactcccaacgtgtgaagtggagtaccattcttgaaattctcttctagtaagttgaacagctttcgagcttgataagatgaaggataaattgaagtattagcaggaaggctgccccgatgctttacaacatccgtagctgagtatggacgactgatattcttaaatctggctgattcccaccattcttctactttacttgattccgagaacacgaagtctttagtactgcttgccccgttgaaagatcttcgcagtgacttgtctgatgacaaaaccagcttcttcagtgttcccgtagtttttctattgaaagttttgttgttaatcattgtaatcatcggcgaaatactagaaaagtcgaaatcgatattattatcggcgctgtagcttctttaggccactagtacttttataagctcttcaaccgcaacaaaagttaagaaataagagagttattcttaagcccattttttacattatatagtgtacgtatgatatcgctagcatgatgttagtgtttcggcgcttctaattgaagagcatatccttttcttctccaatgcacttttatttctttccccgcaagcatattcggcccggatctcggacttggatcattaacctgaggacagcggctagtaaccgctgtcgctcatatggaaggagaaaataaaaattcaggcatatacaattatttcgtcctctcttctcagtttaagatctttagttaccgcatctgcaacaggatattcgttcaacttgaccatccctttcgtagccaaattcagtaaggataggaaggcactggcggctatctgtctgctgacacctctttctacatcatcaaagttagctcccgtttgagcttcgcccatgcggcttgggatgatgtcaaccaacagcatctttctcttgaaaggcggattggagcgcgttgttcttccgacaacaattgatctttctttgatgtaatcgtagaattttttagtttgataatccagaatgacgtcttgaaaatttgttttgtcctgctgcaaattttgctgagagccatcagaaaaacaactgttgctggaatcgtcttcctcggcaaaattctgttcagatggcccgactctccttctgagagcaccaactatatcttcattgaaaccactagacctggttgagtttctggtatgacttcttccaaaacttgaaggaggtagattcaaattaaaatctaggatgttaccttgagagttttcttcaatatagtgcccatcttccaaatcctcattaatttgttcaaggtttaaaagtaaattatcattttccatatcggaagaataattatcgttcttattattgcgaaaacttttcctaccatattcgtgacttctggtactacttgagctttgggttgatactaaagaatgtgctctttttctccctctttcaactgaactaaaaccttggggatataagtcccattcgctagtctttatattggaaaagtcgttaaatatacttaaccaatttgttgaaaaaaattcttcctcaccacatgaccttaccaaactacttatgttagaggtgagaaaattttggccggttagttttctaatcctgtttttttccattaagtgactgtaatttccatggttgaatttgagaacttcatttggataactcgttttggcatcaaattgtaccttagaaaattgcccacctacatcggcgcgatgtcctctttgcattctggtgttaagtttctgttgaagatcgttttcttcttcagaagcctgcgcttctaaccccaattcgtagtctttgagattggctaccggcccttcattttcaactgatgtatcttctcctccattactgttattttcattatcgttctcaaaattcaacaccaattcatctccttgataattaaacttgaaatcgtttccatccttctgtgaacttgagtgagagcctaaaggtgtcccctgatggctcactatatcatctaagtccaggttaaagtccacatcaacgggaatttcatccagcggaaaagaatttctaacgttagatcctagattactttgcgcgtctgagttagtcatgtccccatgaagctcgaacctgttagaattacttaactcattgatgtagtcttgtctccttattgatttagcttcctcaataaaagatacattatcttggagagtagtgttaagaaactccagtgcgggaactttagtaatatcatataagggatcgtcatcgaaaaaaacgcattcttcccaggtgtaattattgtttttgtttcctataatactgttattactattcaatccattaatcctcgtagacttatttttggccttaaaagcgtatacatcatttttttgtaactgcacaagcaggtgatttaggtcattcaacacatactcggtttttttattatagcaaattgtcactccatataaaagattagaaatgtatctaagagaaaaatcattttcgaaattttgaatttcatcacatgtttttggtatggaaatatttacgatgtcttttttcttaacggtggatgaagatatgtttccagtggagttgcttttgtttgaataataattgttactttcctttacaatggaatttcccaacgcagaaagcaaccacactgttgtgaggcccttatatttcttgtcatctttaaagttcaacgaaagaggtgccattgcagaatatttgtaatattaatctatatatagcaaatgctttagagttgctgaggctaaaaagaaattatagaacaactataaaatattaagtccggatacactgcttcctttataccatgcccttccctttatagtgtaaaaacgcgtaatcttaatcaatctgatatattggtttgccgccgaagtcaagttctcctgctaaaacgagacaaaaagaacacgtgaaagaagaaagaaaaacgttacgataaaataagttttatacctactttcatatctaccaaaggaacacaatgaattgccgtatgttattcttgaagtaagagtcaagtattatttatggactagtattcacgttactagtacattatcacatgcggtgtaagaagatgatataaaaattgagggacagtaatcaaattcaacggaagtcaaaaaggaaggattggtaatgtataatatcgaaaaatgtgcgaaatagttgataattgttggagttttatagttgttaaaggctataatattacgtatttagaatatactagaatttctctatgagaagaacccacgaagagatcgatattctcgatataatggcattattgttatccttttcatcttatgtgactgtcattcatcatcctactaaattatcaatccttgcaattagcttctattacacctgatgactgtttttcaatctttatgtgatctttttacacccaatgtgataaagtactagtaacatgaatactactaaacagatgatactttagagttttcattccaacactcaattgtaaaaataagacaatattatgattttttggctgtataaccacatctatttagtagcagggtgacatgttactcccacacaatacttcgcgcaagtggtttagtggtaaaatccaacgttgccatcgttgggcccccggttcgattccgggcttgcgcaatttttccccctcgccctgaagggcgtaacgttaacgcttccggtaatttgcgaataatttttcttcccatttcccctttcttttccctttaacatgtggagcatagcaggctctttacttttttacgcattcagacagtcgggaggtcaattggtggtgccggttgtgggaaagaggtaattttatttcctttattggacatgatttcaatagtcacattggggcaggaaaaagaaaagggagaaaaaaattcagtaaagaaaaaaaataagaaaaagagaaaagaaacaagagagggctacagatttctaaatatccttttgctgcacattttttatttacctgctaattggtcttagtaatacagagtcgtgcatttccactttataagaaaaaaaaaagggataacagcaccagcacttgattgaaaactagaaagttcacgttttataagtcctttccgttctctttatcagttataataaaagagccaagacaaaacgtggcagggaagcttttccaaggaaaagagggttgtaatattaaacaaaaaccgtaatcaagcaaaataagaccccgtggttttttatcataggaaaagagttctctgttgtcactctaccatatttgacaagaaaaaggaaacaaaagtatagaaaaaaaaaacctaaaaaataatggtcttgataaatggcataaagtatgcctgtgagaggtgcataagaggccatagagtaacaacatgcaatcatacagatcaaccgcttatgatgatcaaacccaaaggtagaccttccactacatgcgactattgtaaacaacttcgaaaaaacaagaatgcaaatcctgaaggtgtttgcacgtgtggccggctagagaagaaaaaactggcacagaaagccaaagaagaagcaagagctaaagccaaagaaaaacaaagaaaacagtgtacctgcgggactgatgaggtttgcaaatatcatgctcaaaagagacatctaagaaagtccccttcaagttctcaaaagaaaggaagatccatttctcgttctcaaccaatgtttgaaagggtattgtcttctacttcacttgacagcaatatgttatccggccacggagcactatcagatacctctagcatactgacgagcacatttttagacagtgagccgggtgttggtaaaatttcaaaagattaccatcatgtcccttcattggcctccatttcatccttacaatcctcgcaatcgttagatcaaaatttcagtataccacaaagcccgccgttatcttcaatgtcatttaattttctcacgggaaatatcaatgaaaccaaccaaaatcacagtaatcatcagcattcaaaatcaggcaataactggcaagatagttcggtaagcttgccagcgaaagctgattcacgtcttaacatgatggataaaaacaactctgtgggtcttgacctattaggccattcaaaacgaatatcgccgatatcaaactctcgtgtgggcgaagttagcgttccgctagaagaatatattccttctgacattgatggggttggaagagttactgataaaagctctttggtctacgattggccatttgatgaaagtattgagagaaatttcagtacaaccgcaaccgctgcaactggtgaaagtaagttcgacattaacgacaactgtaatagaattaatagcaaaagttatagtaagactaatagtatgaatggaaacggtatgaacaatagcaataataataatatcaacagtaatggcaacgacaagaacaataacaactcttctagacaagaacatcaaggaaatggactatttgacatgtttacagattcatcgtcgatttcaacgctttcccgtgcaaacttattattgcaagaaaaaattggttcgcaagaaaactctgtcaaacaagaaaactattcgaaaaatcctcaacttcgtcatcaattaacttccagaagtagatcatttattcatcatccggcaaacgagtatttgaagaatacttttggaaattcacatagtaatgacatcggaaagggagttgaagtgctatctttgacaccgagttttatggatattcccgaaaaagaaagagaaacggaaagatcgccatcatccaattacattactgacagacctttcactcgaaaacctagatcttctagcattgacgtaaaccataggtatccacctatggcaccaacaaccgtagcgacatctcccggtgcattgaacaatgccgtagcaagcaatctcgacgatcaactgagtttaacatcactaaactctcagccatcatcgatagcaaatatgatgatggacccttcaaacctagctgagcaaagttctattcattcagttcctcagtcaataaactctccgagaatgcctaaaactggaagtcgccaagacaagaacattcacactaagaaggaagaaagaaatccgctaaataacatacacgatctgtcacaattggaaaatgtaccagacgagatgaaccaaatgttctccccaccattaaaaagtatgaatagaccggatgccataagggaaaattcatctagtagtaatttcataatccaaggaaatagcatgatctctacgccttccggaaggaatgaccttccagatacctctccaatgagtagtattcaaacagcgtcaccaccaagtcaattactgaccgatcaaggatttgcggatttggataatttcatgtcttcgttatgataaatttgcttttcgtctcttgcttctctgtaactgtagttttcctcctcccacatatatatatatatatacacttttatacacctaataatatcatcggcattatgattgcttatacattttcataatcaatattactgttcaccatttgaatcactgcagaaatatgcactgcgccttctttttctttgcctgaagcacccacacacaagaacaggaatgtgaatggcctccccatctcacttttacttaatagtattctgacaatataaggtatcagagagtaagaccattattaggcaaacaataatcttcagaatttttagtagcgcattctcaacctttctaggtgcgtttttctaatgaaatagtatcgttttccttccgcattccttgcgtagtttgttgtgtaaatatagcaataagaaaccctataaatcattatgatgtaactcccgattcttttaaataattacataaactaggaaggcaagtccgaacacgcagagatgaggtatttgcactcaatgacaaatctaggtttaaactacggggctccataccttatctcttcacttatcaaaagtaggcaaaagaaaagaaaataaatataatttctttttctgcaggcaagattttaaaagaacttgcgcgtcctctgtgcaatctacctggggagtctcgggctttaaccgctccccattctaaactgcttccattgacgtgtactatactgctcacttcttgctcttcgagcaacaaaatctgtattacgtttcttacactagtcgagtgaaagagataagatacccacttttacttgccgggagaatggaaaagagaaaacggaagaaagggcttaaatacattttcctttaatatgaacatcctactgtaagataaaaattggatgctgataatggaaaggagacatgtacggtatgtacggcaaaacctcggcgggttttcgccgctagctcatatattctttcgttaaattttaaaatttcttattctaaatcttctttacatgtttggaaagaatttattggagagaaaaatctagacctgccaagccgataaacgaatgcctgcgaagaaatagtgtaaatattactcctgaaggtagagtcatctaggcggagacgaaaacaaagtttagcttttcgtgaaattgcccatttcatgtttatcaaccaccaaaggttaaatggaggtttgacaaaagaaattttcttgctaaaggttagcattttttttggaattttttttccttcgactggctgtagttgtccttctatattacgtacaacaaaaactttcttgaatgaagaattagttctatcatatagaccataagaaagaaaacgcacttggataatttttaacaaagaagagggcaaactgacgctcaccaagctattggtttgtttggatcaatcgtcagatatgaagccgaacaatcgaacttgtgatgtaattaccaacaaagatgaatctcttcctgcacttttgctgcctgcactgaacagttacacctgtgacgattcattgctaaaaggacaaatttcaagcaatggcagatatcaaccattcgggttttctgattgctctttactgccaaagcgtttaaacattcaggcagggcaaggatctatgccagtttcttcgattcaatgtgcagaccacagttatagtaattggcaaaaagaatccgaaaagactaagcttcccaagcttggttgcccaacagagtacactgaatactataaaactgtttcttccggcgaaacaaccgattcagcggttgtttcatctatagcaacgaacagactcaaaagaaaacgtcagagggacggcccaagttgtgactcttgtaggataaagaaaataaaatgcaatgcaacaatcattatctttttacaggataggaacctaatttcatcaatttcttcaaatttgcattatacactttcccaagacgacataaaccagtttcgaatgaagtttttcaggaaactgcctgacgtgatgggcacatatgaagtcataaaacaccttgataaaatagtccttttcaaagcctgcacctcttgcagtagaagaaaccaaaaaaatggaaagtgtcttttttcgagaggatttacaaaatctgatatgaacgtatttcccaagataaatagtaaacttaaagacaaaagtatcttcgagatgactgtcgatgattatgttgccgctggcttccaaaccctttaggtttcatgcatgtaatttcctcctatgtaaaatataggaatattaataaaacgcaccaataataagttagatatttttctgcaagatataaatttgtttactcatacatatatattctattgcggggcgctcttgtataagtaattcaataaaaaacctctatatgatacaattgaccaagccttcatttaccattctatatcaatttggaaagaagggtatttctctatttgggctctacattataacgcaatcttatacccattgcggatagctcagagtccaagtacttcaacacaaatggtatggccaccgtagttgtttcattaccaccaacaaatttgttaccttgtccatcttcccaaatttgagagtcgtcaataaaaattttctctccatcttctgatttagtcaatagcttctttgcatcttcgaatctcatggaacaacgacggcaacaaacggtggaaatcgaaccaattcttggcacactctgttgcgtggtcaaaatagaaccacactcgcgacatacggatgcctgtgtgtagtctgatgaatttagcagacgatcttgtaatagaaaagatgtaccatgcccaatcaaagcatctctttccatttcaccgacacgaataccaccatgtctctttctacctttgacaggctgcatagtcaaactattcacaggaccagtggaacgaacttggaacttgtcattgaccatatgacgtaatctttggtagtagacaacaccaacataaatatctgcccttaattcttcaccagtagcacctgagtacattggctcattaccatggtagttgtaacccgccttcgctagttgctcaccaaagtaatcggctggggtatcgtcctcgttaaagatccaaggtgtagagtcctgtgcaataccatgcaatgcccccgctttacctgctaaagattcgacgaacataccaatggtcatacgcgaagggaaagcatgagggttaatgatgatgtctggttggatacctgtttcgctaaaaggcatatcaatggttggccattttcttgaacaaacacctttttgaccgtgtctagaagaaaatttatcaccaatttgaggcgttcttctaatacgatattttatgctaacagtttgtagttcttggaacttattggattcatcaccgattaaatttacctcttcgatatatgctggttcagaggagtgatatgtcttgattttggtcttatttaaagtatcgtcaaagtatgcgcagattggatcaccctcttcaacataagtgccaatgtatggcaaaccatcctcgtctaatttctcaagccactcctttggccattcgtcattcccgaaaccaaaatgctgtgtaattgggtcaccacggtttctgttaagtgctaaatccactttctcagtcttatacatagtaccataaccgaaacctctttcatctgctgatttgtttataatcattgcatcatccatatcataaccagtatacgagatgaccgcaacaacagcattaaacccgtttggaaagttatccatgccataatcatcatataaattagcttttacgataggcgtttgacctgtttgcaacctatacagcttattgtcggaacgatggcacaaagctacacccggagtacccattgtttgtttacccatctgacattgatacatgtttcttggagactggttgaaatcagaaaatggagtcaaattagccaaaatagaaagaatatttgtgggcgtaaattctacgtgtgtatgaacgttattttgaatttcttgaggagtgacagcaatgttcatgtacacttgctcaaaaggtccaacaatgtcttctttatccaaaggcaggtaacgaacaggacgcagcatcctagaatgaccaccaaataggtagagacctggatattgaccacgagttgagggaggaacatatccaatttctagatcaatcggtaacccaggcgtcttgccttcaactttccaatatctcaatgtatccgcaatgatcttaccttgttcatgagagacccagccaataattttaccatcaatttgaacacaacacagagaaggaccagcagcaaaggtgtgagatgccggagcaacaccaagtgagtataatatagaaggaattcttgagacgtcagattgctgagttgatatacgacacttgtgcgcaaaatggtttaataaaccacaaggagaaccatctggtgtatgaacagggcacaggaatccccacgactcaggtagcaactttctgactgtggtagttttcaattgcgcaaaaaaggagcctctatgaaccattctaaaatgagagataaaacggtagaagttaattttttctgcaaccacagtataaccagaaacttgttgtaaatctaacccagactgggacaccaggttaccagttgataaaaagtattgcattttggaaccaatgttttcattaaccctcattaaaactcttgacatgtaccttttgtctttgaaattaatggccataccacggttaatatccatcctgacttgagcaataatattctgtaagtactcatcaatcttttcttttaggatcataccatataagaaaccacccaaaagaacttcttgatgttgcgtagcatctgggttatctggagaacattcgcctgcaaccaaggaatacaactttctgatcatgaacaataacattctgaatttatcctggctgccatccttacccaaatgcacgagaacgatgcgatcaaggacttcttgtccgacttctaaatcagattgatcaggggaagcttgaaagacaacacgaaatttgtctcctaaatattgcaagacttgtgtgcgattttgtaaatgaggatatcttttcttaaaaccacgtaacagtaattctaaacgatcggtcaaaaaggaatccttaacgtcattaccaataataccatcaaaaatttccctatcgctggtatgacacaaggcttttaaaatcataacaacaggaactaaatattcattttttctccaagaaaatctaaatgtaacttgaccgtcatttaagtaatgcaaaacattagtttgggaagtttgatccggcctgacagatctaatttgaataccgtaatgagaataggatgcacccctgttagcgaaggaaggtctgatgatagccataggatgatttctacgttgcacaatcagcattctaataagcttttctataccgttaacaatgaaataaccacctatttcatcggattcttccttgtgttgtaccagttcatatggtgacatcttgttcaagtgacatctgttactctgtagcataactggtagaccaccacaatctcttacttcaaataagttctcctcgccattgttcacggaccacttcaactttaaaagtaatttacctctgtaagaagtaagcctttgtcttgactcacttgggtaaacttttctctctactgcagaagaaacaccatcgttagacattggcttcgcaatagacacttgttccacactaacagaaagcttattcccgaggtatccgctgttggatatttcgtcttcagaattgagtggttttccatcaaatataactttttcaccgatgtctttaacaccaagatttaacaaacctccatccggaccttctgttaatgcgttaaaagacccaatatgaggttgaacagcttcctgtaatagtggaaatgctgatttatccttaggtggattgatgaacctagattcacgttctaaggtacggaaatcagcagttctggcttggccaggcggcttaatcactttgctcatctcaccaaatgcgtaattctacgtttatttgtcaatattcttgaggaagacttgcttgaatattacgagacagctgaagtaagtttgaataattaagagatgagatgagtctctaagatgcgcttgaaaaatttttcatacgaaaaaaaaaaaaaaaaaaaaaaaaaaacactcgcaagagtaatctcaataataatttccgtcattagcgattatagcatgaagggaggccgagaggccgcttctgcggtatgataattaagtggtagtgcagagactcaaaagggcgctgagaatctattagaaatgccattaagtgctttgaactcttgtagcatgtctgcttctgtagatataacactctgatgcagatttatgaataatttcatcactcgatgtcatcagcgtcttccttcatttgatgcttttttgaagttttcatggcatgatttagcatttgaaatataatgagaaaagagccctttaacttacagaagtaaatgtacaaaacttaatcggaggaagaagcttaaacatacaaaaacaacagcaggatgactacaaagaagccgttaaacaaatctttttgtctccgttactaattcactaatatagtaattttgctaacctctatcgtcattgaaactgatttgtcctcgagaaggcaacaatcaaactgcaaaagaaacgtaaagcaacgacttgaacaagtaatcgctaaccacatattgagataagcagataatcgctgttaaacgtcgttgatacagtcagtcaatatgaatagtgtagtattttatcgttaggttcaccttccaaatattcgttagataaagatgtttcggttttttatttcaacaaaagagccttgttggcgcaatcggtagcgcgtatgactcttaatcataaggttaggggttcgagccccctacagggctttcttttttattgcatggtctatcatcaggttcccttaaccgctgccaagaaagagcacgtgtaaaaatggaatgattatacatcaattaaacatatagtcatggtggtgttgacatgtatataatatacattagttttgtcatatttgaagaataaataatatttcgatttgttcccgacaattattgaaaatgttttaagtgtagatattaatataacaaatcatcaacatggtttttaatccttatctttggcaaggacttcatctaaactagataattctgggttacctgtcaatctcaaagtctcgtcagttcttaatttcttatatgtgaagtatgtcccagagcataaagctacaccaacagcgagaaataacggtgttaattcgacgggtattttgtagccaccagatgtttttttctagttttttgttagtataatactctataatcttgtagttagcattcataatcaacataattgttttcttagaaagcatcaagtcagaatgaacgcatgattatccgtttgtcacaataaaaagaaaatatcccttaacatacagctgtattcaacagtaactgtgctggtctcatttttctatatttttctttttttaaagtattgtcagaagtcgttcaggaaactaccaaaattaaataagtctcaaaacaaagttagcttatactggtatgggaagagttatagttgcttttgaggagatggcgatgcctttaaagtctgttctcatgctcatcataaagtacgggaaatcccccgctttgtacgatatgattggcccatactgcaagaccgatataaagaaaaatagacaagttaatgctatatacaggatgtcgttcttcagcggagggatcgcgtcattacttggttttcgctgacccaagcctgtcacctcaagctcaccaatttcttacagaatcacatacaacttcgtaaactagccaactcactgcagttgaaggaacaactttaaaaaggtttgcagctaagcctttgtagtaaccgctaacgccttctgctctgccgattgtcacgagcgcatcccagacactcgtgtatctaaatcccagttcatttccgcccattgcgagaacttgaaatcttcttcttagcagatcaaagggataagtgattgtttgcgcaacccctccacttatggcgccaattgttaatttatagaggttacttttccaggaaggctgagcatcggaggaattgacaccgaattctctcaattgttcgtaaactgcaaagtttagtgctacatatggaacaacaccaagactcgttggccatacacccctatataatcccctgagaccgccttcgagtctgtaagtttcgcttagtaattgccagatccccggaggctttgatatactttttgcctttgagcggtttaaactgctcaaatttgctgtctgaatcgatagtcttgttttgatcaagtccaacgggtaagtagccaccacactacaaccaccacacaatgcaccactgaatagtctttgggtgttcgttagttgttcttgtccattattgccatttacatggaataactttttcttacaagcttcgtatactacaaactggactgcactatagggaaaaattcttatgcagttcaaaccatttcctctgaataaacctttggttccctcctcatggtaaacctgccgtatagagctaaagatacctcggttataagaagtggttgaactttgaacttgcagcagtattttaactctctcaaaaggtgaaacaacggttcgggaaaccgcgccagctactccaccagctagaaacgcaatatttgaatcctgcttgagaaaatctttaattgagttcggctgctcgaggacggtcagtacttctgccatgttagcgaaataacgattaaaaaatttgaaagtcaatactatgaaacaaggaaacgagcaacttggtatacttccctcacctttgttaaattcacttggccttactggcaatcataatcattttgacgaactgcggacatcgagagtaccctgcaaatatatctagaaaaagaggtaaaaaaatattgaagggtcaacctgaaaaaaattgaaaagtgaaaatagatctgctgataaataatgcacggcttgcatcaagtgatcacatggaactttcccaatacctcaactacgcattttcccttgcatattatatcatcatccatcttctttgcctctcatatatttacgaaataatacataaacataaaaacgtctttgtgcgtccaagtaaacttgaagacgcactcccgttatataaaactgggaagaacactaacaaagaaggtgacttgcgcttaattagttttattcccttgcttctaaagtccgtaaaacattctattagagtctatacatagttttgccttacctttgaatatgagttctaaaaattccattgcaataaagctttccgttcctattgtttctatgtagtgtttaagactttgtttcttttcctttcatggcttttcaaatgtctcagcatattgcttttcacattgaaggattttgtgcaaccctcccaagtacatttgaaaggagtatctcccgtatgaattaagtaatgtgtcttcagcgttgagggcctcgaacaaatttttccacatactgggcactgctttctcagctttgtggatgatattcgggtgtcagttttccaatcagaaaatgttgctgaaccgttcaacacggcaccaggttcgctttttgttctgccgttactggcttcctgcatggttggaagtacgccatacccaggtgggactgattttggcctatcgtggcatagctctaaggcagcgtttgggtgactcgccattgatattgcagtgaagttaggttcggaggcaattgttattggttctttgtcgtatggtgtcaatggtttatatactgttgggaccatgactggcatcatcaagggagcagaggaggtcaaatgaggagactggctatgtggtattggttgctgactttccgtatagtagataggatattgatcagatgttgcgttcatggaaattggggtgtagatctcattaacaatgggtacaacattcatgctttgataaacttgctgtggagggaattgaacccttgaatctacgttaggtggtgtattattttcaaaattaggcaaaagggatgaaattggtggtaagtttattttcgtactattataacattcccgttcatttttgtagctattgtggccataaaattgagtccccttaccagtgctcagctgatcaactgcggacacttgaagggggaggttcgatttataattgactgtacacattcctatattaggagatcttgacttgtctgtatatgatgattgtttttctgaactttgctttgaaagggaaaaattcatgtaatttactttagtggcgtttactgctatttttcgaaggtaggtgatgaacttgtgttataactaagaagctcaaaactaaaagtatactaatgtttgaggaattattgtgaagccatagaacaataaaaagctaacaattgtatctttcgttcaacttgtcaaaccctgacaggcatataaaagaggtattttgaaacatcaacatgtagtagtcacatatatagcaaaatagtaagtaaggaaaaaaagaaggcacagagaatacaacaataatgatgaaggcacacgactgccctttccgggccacctgcagatctgtaaggtagttcaaatgacgttctcgcgcgggtttcttacttatgaaactttagggacataagtcgggaacctgatgcatcattctttatcttgttttttgttgttgtttgagtttcttgtacagaataatacgcagaattaaagcggaagttaaaaaacagatcgtcttgatctgccctcaaaaccagtatccactgaaaaccttatttcccaccgtaaatggcaatcactcgtagctcaaggtggaatgctcccgtaaggatatttcctatatgagatagtcccgatcctgagaagagggatcgccgtcattttattctttaaccccgagaaacggcatctctcacctgattgttctcaagattgctgcaaaacccagatatacttttaggtacggagcgtacgcgatgtatatggattgattttcacatgtatcgtttatgagtacttgactgcacctcgtgtcggaagattttccaatcgggctttttttcaatcttgaaggccctccttttcatttccatttgctctgacattgcggctatgcatcacaggcaaaagctgaaaaggaaattttgtagcgtatcggtttactgcacagtctcagaccctttgtagtactgttacctggaagaatagtaggtgcgtacaacagtgattatgtagtagtatctactgaagagcctacgagcgaaaaaaaaaaaaattatcggctacattacgttgtttcctacggagacaagaaccaatataagctgcaaaaaatctatgagcattttaagtttccgatacaacaagatgtatgcgtactattcacgtcgtgttatattgctcacgtaacaacttctatgacaataataaaaaataacctttccattgtatcattaaggttatctacggaggattgtcaaacctagcggatatgaaatgtacttgattcctaattcgggtttatttagagttcagactatgtgggtcatttcttatgctaataataggcactgaggtaagtcaaaatagcgacactcaattactgttgaatgggaagaaaaaaccgagaaagggatacagagatcttgcccacgcctttttttcaaaaagagcccttcgcaaggttgctcaacgggattgtcatagaaagaaaaaatcaaagccaataactacaaggccaaaagtaatggtagggagctactacaaagtgggctcagcctacctgaagaaaataaacaattaatggacaagatctgttagcggacatacaagagatcaaattaccttctggttaatgctgtaggcgaagcaaaccattcaattgaggaaaccttattcccaattgcgcttttgctccctggaagcctataacagcgtgtgggcaaataaagttgtttttcgccctcagcgactttacttcggaaactgaagagcggctagaaatttcgcagaaaagattttcctttgaggatagaaaaatgaaaaaaagaaatttatcttttttcacaacaggtgctgctttttcctcacgtatgcacagaatgcaaagtacaagatttgtaatacgcgactccgcgcagctgtactctactcccaagtcagcggaaaaaatgcaagacatacagaaagttgccgctttattggctatttttttgggcgacagccctggctagcctcctcattgggttgtagaggaaacaaaactgagatgtctttggactaatgtcagcaataataactcgtaaaatcaagtcagaatttctatccattcaataggtattcattgtttatgaaactaagaaacgaatgtaaataattctgggatataacaaatagttccctttggattacttaaaacatagtactgcagctaaaatttgtaaaaatgttaacgtttctttgcgttgagtaacttgaccttcacacgtagttgcaagtaccgatgcaaaatttttacactggtgacaaccttaatggtataatccaattagcgacatcaccgagaaagtatccaagtcgatttgatgaataaaataataacttaaacattcaacgccgtttgttaatactgacacctgaaggagagtcaaaaaggcaaactttcttgcaacaatcataaagctaaggcaccgctagagcttacgatattggccgcaaaaataactattacactttttcgtttctgtggaaatgtagggtgatcaactggctaattgctgccttttaagatatgcggaggagattgtgcagccattttcattttagcgactcattgatggaagtattcaagtcaagatcacttgtttaaattcaagactactgtttaaattcataattttttattgctatcttttttttaccacagatctgaccgacactcccgcttatcgcccattgcggcatatacttaggcaagtcaaaagccgaggacagcagttgaagacaggctacaatttctatagtagctttttttcgttcctaatttctccaaacactttaagtttcttgaaacgtaaatgatactgcgaaaaatttgatttcgttctgaagatactatcaattaaacgtgcactaggtgctgttccctcgatgagctgccgcgctaacccgtaccccccaattttgagcgattttagtgagttgtgttatataatccaggggtactctgctccgcgatttgtgtgatagcagccataaatgccccacgccaaagttccacgttcaaataaaacttacatcaaaaattctttctctttgaagtaaatatgcgtggggattgctgaataagcagcccagtgaacatcagcgctttctgtaaatcatttatcagctaacaataattacataatataaacctccaataactgtcctgctagtggcacgttgttggctgtcagaaacgaaatgtgggtcctatttaccccttggttttagtatgggagcacgaatggtaaacaccttctcataaaataactgataacgtcttaaagcgaccaaatactttattgttgcgggcaaacattattgttaaatgcgtggtctagaagtaaaattttctgcatagttcactgttatgtaaattttgaacttgaaatcttttcttagaaagagtctgtcatccttggaaacattgctgaccaagaatacgatattgtgagaagacattgtacccaaaaaaaatttttcattcctatagtttggattggagatgattcaaacacagcatattcatgtgttaccttcccggttatgcacgaggtcaatgagaccgttcccttgtgttgtaccagtggtagggttcttctcggtagcttctccgcaataagaatgattgaatcatattgtaacattagattttggcctttcactaattaccgtaggtaattttgttggttaaactgacaaagaataagagtttaaccaacaaaattaagtcttggtgcattgaatggaagaaaagatgatacaacgccaacctaaagagtggaaagcgttctttcaaatgagggtagtaggaaattcagcgggaaagtttgaaaatgtggtggtaaaacaataatcctggtttttctttgttatccgataggaaatttatccccttctatgttccactaatcacttcatgggttgactatcactagcgcatgaactccttttgaccaataataagcacaatactaaaggttgtggtaattgataaataaagacttccattgaaatgacagaaacgatatgtatgaatcagaatatcaagcatggatatatcattgcgctcaaacttagtcaaattcctttgttttcttagtttgttatgactcccttgacgtaattattcttgcattaattttgagcttctgtaaacttcattgttccaatggatcattatatattaacaacgttggcatatacgtgaccgcaatttgaactacctacatttaacatacttttgtagaggaaagaggctgtttgttctttaaccatgattataccaatttaaccttttttttttttttgatagtgaactgcatactagtcaggtaattgaattcctggtacagagattcatcaagacatccgtgtcggcaacgttgtactaaatgaaaaggtcctttgtcttacgaactagacagaataaaatgtatcgtgcggcagtatagaaccgtattacaaatgctgatgcattcgcaaacaaatttcttgtagaaattataattcgaacaaaaatcctctcactattcaaaaatcggaagtcagtaaaaattgattgttggctacatgtaatatattatatggaactaatacatatctatactcattttacttggtaaaaagtgtcacacctacatcaaaatcacactgaaaacaaaatattctaaacaatgctttcactgatgttttttctttgctattttcttttgatgggttcttaaatgccttaacatgttactcttgacattgaaagatttgttgcaatgctcccaagtacatttgaaaggtgtgtctcccgtatgtattaagtaatgagtcctcagtgttgaaggtctcgaacaaaccttcccacagataggacattgtttccgtagctttaccacagcgcgcagttgcttttgtataagatctaagtcggtttgtgtttgggataatagcgtcccaggattttgccctatatgcacattcgggagggagtactgctcgttgctcaccgctctgtggttttcctcctgaaaatgctgcattgatggaggtacagattgggcagtataagaggaagctgccgttgaataaatagggcaacaagattgacgttcaacgaacgttaaagggaaaggttgcggtgttgctataaccggcgaaaagataatagagttgggacttgatctccatacgggatcctctgtctgatgcagagaagaaggtgcgtaatggtaagcgggaggtggtagtgcggcctggtttatttcaggagtaagtggagcgtgcataatcgacgaacaaggtggaagatgcacttcccttttggtcgtgttcgagacttcctttgaagattgcgcataggatccccctatgttagacgatgaacatttcattgggctacaaagcatagattctagcgtttttgttctccacatttaattagtgttgaagatgaaaatttatgtatattaaaagttagaaacgggtcaatgaagacgtttgcttatcgtattggatccttgcaatgccctccaaaaagaagaaaaaagttggaccaagaaaacaattataattttgtaatttgaaatatctaccaatgaggtcaaaagagcgacaacaactagcgcttatataatataaagaattcttgggactgtatctcatggcaaccaaatgccgttcatatttagggtttcagtgggaaaagatttccggtgctttacgctccttgtacaaacaagtgctgcgaaactttctgtggaaatcgtgccttttaaaccattagtgaaggctccagatagagttgtcacagaaaacagcgtggcggacttatttttttgcaacgattttctggaaacaatagaggaagaatttttggcgtacgaaaaggaacgatgcccccaacacctcaacaatactacggaagtttcttcgagcggaaaaacatcgaaatactagctgtttctggatatgagagtgggtatgcgtggcaatggaactcagggagttgttgctatttcagtgagtacgatggatcagggtgtttatatctcaagaactaccaagttgaagagatgaaacgtagttcgcttgatagcacataaatggacggctgacttgttgtacaccatatatatatatatatatatataattttacggctcacttctgtaccgcttgtgaaaatcttaccgcacaacccccggtgttctattagctttgttcgattttattaatctttgccaagagatactactctccgggttctggtggagacaatagtatgtcctagcagctagacaaaaaagccttcaaatggtctacgtgcggtgcaatttttcttggagaagttctatattgtctaacagatacttggaactgagcaagttgtcagaatagtcggagaagcggacggaaaatccatattatgcaaagaatttgcttagaaacccgttacatatgcttcgaacaaagtgactacatgttacaattaagacgcctacttaaactgcaatgaatagtcacccataggtataagaaaaaaaaaaaaaataaaagagtacataatatacatacaactaaaattaaaatgcatagaaacctaagaaaaaatatttgttataccaaaaaaaataccacaaatgatacgtaagaagattattgcaacatggggactctttcgcatacaactgtaaacagacttgaggaaggaggggaatcccctcaggagtacctgacatctatgagtaggtttcaatcaaagtatcacgtaggttacctgaaatggattctggttgggcatcttgcaagcggaaaatactttcaataacactcaattctggggctgtagtatccagacctgtaactgccaagtaatcgttcacaaccataccggcaccgacaactgaactaccacggttaacggtaccagccaccaaaggaacttgtaataaggaggacaattcttcttgatcttggacacttgtttgtggatgcactaacccaccttgattacttaaagaacaatatgacccaactaagatattacctgatatggtttgacggaagacctcaacgcctagtacatcacttatcaattcttcagtttctctgtcgatatctggatgcactaaagcaacgtaatcattacaacagatgacgttacccaaggcagatagtctttcctctaccctttgaatcttaacggaatccggcaaactatttcttaaatgttgtaattcttgatcagtagtttgggttggaactagcagacctctacggttacccgcggtcattctaccgatgatacgcgtaccagcaatagtggtatgaacgatgggaatagcatctcctaattcagcttcaaatgcagagtaaaagttttcagaaccaccaacagcaaccaaacagtaagtattcgttaatttggagaatacaccgatttcattggagttttcaaattgagtcctggtagccattattgttttctagagttagttgaattatgctcttgttccaaatactctgtcgtattgcttcttgtaattatactataagaccaacgagggatgaggcttcttttaattatgcaatattgaatattgcgttacatacagtaaaagaaaaaatctgcacaaaggaatatgggtttaaatctttaattaataaaaattttccgaaaattttcgtttggccctcggaaaaaacgggtaatgctcatccattaggatttcgtccagaatgcctatattattacataaagtgatgctagtaatgtaaaccagaactacttctatagcttgttataggtggcccatgccagtgaaataggtggttggttactcttttttttttctggtggcggcaacctatttttgttctagtgcctaccaaactaattccttcccataatttgaaggcttcgcaagcttagtagatgcaaaactctttcttcattctttgtctgatcttgcaccttacatattattccaataggacctttatcacaatcagcgcatatcaaatatttcaagcactttttaatcttccagctggaattaccatactcaaagacaaaatcactcttatcactcaaatcccctaatatagaagaaggaatttctctagatacaccaacattatcaaagtcccaaacatcagggacgaccaagaagttgctctcgctgggggtagcatctcgcatagttctgttttccagcaacttgaattcgctgtgcacctgctctggtaagtttattatgttatcatcgttgatggtaataactgcactatgacagccctcaaaggaacacgtagccttgctcatgttctctgttattcccccatttttccagcccttttaattgaactttctactcataccagtcaagtttttgatatgtacttcattaattaaaatgatcgatatataatcgttcagtacgacaatgacgatattcacagtactactaaactagcgggtccccggcgcccagtcagcctttacgaagagaaaggaagaatgatatggatatgctgaaaagtattttgatacagaagaagggagttttgagttgtcgggctcatcgtgctggatcaagtggttccctacctggcgcgatctatagtgtcagacggcttgcatatatgctcacgcgttcggacgcgtgaaaggcttcaactgaaaaaaagaaagatctacatcgttaaaccaaaaggtttgcgaactgactaaaaaataaaattcttattggttccacttcttgaaatacatcatttttccagccaattcgttgaggagaagaacattctgttattgctgttacagagaattatatgttttagtgaacctcaagacagaagagaatcgaaaggaaaagggaaaatggagcaacatctcaaatcaattcctctacaggacgacactaagaaaaaaggcatactatcttttttccagaatacaactacggtaaagagtaataagtttctcacgaaagagaaggatgtcatcactctagatgatcctaaagaggatgtcagtggacctatgatagaaactgttaaacaagaaaccatgaaaagcatcaataaagagtgtgcagatgaaatgaaaacgacacctaagaaggccaatgctgaagacaagcttttatgctacaaaaattcacccatacaaagtacaaaatacgatagaaacaccaacaaacaagtacccaatggaaatataatagctatcgagacaaaaagcagaagctcttctccatgctctaagagagaactttcctcatcgaaaaaggaagaagctaaaagagaaaaggaactaaaaaagcagcaacgtgcagaagagaaacacagaaaagagttattacgacaagaagagaaaaagaaaaaagagctaaaggtagaagaggaaagacaaaggcgtgctgagctgaaaaagcaaaaggaagaggaaaagcgtagaaaggaagaagccagattagaagccaaaagaagaaaagaggaggaaagattgaaaaaggaggaggaaatacgtttgaaagaagaagccaaggaaagagcacaatcccgtattggtaacttctttaaaaaactaagcgattctaatacgcctgtggttgaaaagtcggattatgaaaaattttttctacctttctatgctaaagatggagttagagtcagtaataagtggaaactaacaaaagtggagctggaaggtagcaaaagaaaaatagatgatgaattactgaacagtaaagataaaacaagtagtgacgacttattgaattggttacagtctagaagattacctagaggacataaaattaaacgtaaagctgttgacgttctacagcaaatgcctttgaaggagaaaacagacgatgagctccaatctttacttgcacaagttccgcacaaatatataaaattctacgaaaatgttagacctccgtttatcggaacctattctatggactttactttgccaccaaacgatcccttttctacgaaaggtactggattcaattatgattacgattctgacgttgaatgggttaatgaagaagaagaaggcgaagtcgataacttagaaagtggtgaagaggaggaggaggaggaagatgatgaagacgtacctagcgaaggagagtttgacgggtttctagacagcgaagaaaacagtgatttggatggcctaccctgcgccaagagaaaatttgtaggcccattgataccaacaatatgcctaaaatccaattttgaaaacttatcagaggaaaataaacgatacttacaacaactcaaggccgaagttatcatagaaaccgacgggccaatcgatccattcaaagaacccaaaacatcgtctctaccatccaaaagaagtaattccgacttacaggcacagaccgctagccaatctcaaagtcccgaaaagaaacaaaaagcaatgattacagaccccatggacttacttcgactttttgatggggttcaagacagcacgttttctttgggtactgtgactgaaatagcacagaaaaatttgccgcaatacaacaaacaaacaattaaaaacaccataaaggaatatgccataagaagttctggaaagggtgatttgccccgcaaatgggtaatcaaagacgcacaaaactgggagaatcttcgagccaatgcaaatatgccaaccccgtctttgtaacttgaacggatctttagtatatagaaacatacagataaactgattatttattggtatacatgaaaaaggcgacaacactacgatcgacagtcaagccttttggactttgaataaaatccagcacttctcgcatgcaacaaaagaaaatcttctatataagctgaactacatttatctgtgtcagccaactgcatgttttatatcacttctttttggaatattacgagtagattcatgaaaacgcaaacacttggtttactctttcgggaaatttaatgctagttcgccgcctcgaaaatgaaaagagaagaagagaccagaagagcaacttcgcattggcactgtttatttctttaagaacatcttcaatactaaataagacaacccatcttcagttatttttactcttggtagagcccaacttaggatccttttgaacctcaagaacttaaaatgtctcaacagtctagctctccaacaaaagaggataataactccagctcccccgttgtgcctaatcctgattctgttccaccacagctttcttccccagctctattttatagctcctcttcatcacaaggtgatatctatggtcgcaacaatagccagaacttaagtcagggagagggaaacatcagagctgctataggttcttctccactaaattttccatcttcttcccaaagacaaaattccgatgttttccaatctcaaggcagacagggcagaattcgttcttctgcgagcgcttctggaaggtctagatatcattctgatctgagaagtgatagagcactgcctacttcttcctcttctttaggccgtaatggtcaaaaccgtgtacacatgcgaagaaatgatattcatacatctgatttatcctctccaagaagaattgtggattttgatactagatccggcgtgaatactttggatacttcttcttcttctgctcctccatcggaagccagtgaacccttgagaataatttggggtaccaacgtcagtatccaggaatgtacaactaattttcgtaattttttgatgtctttcaagtataaattccgtaaaatattggatgaaagggaggaattcattaacaatactaccgacgaagaactatactatatcaagcagcttaatgaaatgagagaacttggtacctctaatttaaacttggatgctagaaacttacttgcttacaagcaaacagaagacttataccatcaactattaaattatcctcaagaagtgatttctatcatggatcaaactatcaaggactgtatggtttccttaatagtagacaacaatttggattacgatttagatgaaatagagaccaagttttataaagtaaggccttacaatgtaggttcttgtaaaggtatgcgcgaattgaatccaaatgatattgataaattgataaacttaaagggtcttgtcctgagatcaactccggttatccctgatatgaaggtagcgtttttcaaatgcaacgtctgcgatcatacaatggcagtggaaattgatagaggagttatacaagagcccgctaggtgtgaacgtattgattgtaatgaacccaattccatgtcactgattcacaacaggtgttcattcgcagataaacaagtcattaagttacaggaaactccagactttgtgcctgatggacaaacgcctcactctatctcattatgtgtttacgatgaattagtggattcttgcagggcgggcgatcgtattgaggtgactggcacgttcaggtccatccccattagagctaattccaggcaacgcgtactaaagtcgttgtataaaacatacgtcgatgtggtccacgttaaaaaagtttcagataagaggttagacgtcgatacttctactattgaacaagaattaatgcagaacaaggtagatcataacgaggtcgaagaagtaagacaaattactgatcaggatttagcaaaaattcgcgaggttgcggcaagagaagatttatacagtttattagcccgctctattgccccaagtatttacgagctagaagatgtcaagaagggtatattacttcagctatttggcggcacgaataaaacctttaccaagggtggccgttatagaggtgacataaatattttactttgtggggatccttctacttccaaatcgcaaattttgcaatacgttcacaaaattactcctcgtggtgtgtatacttcgggtaaaggttcatctgccgttggtttaactgcttatattacaagggatgtcgacacaaaacaacttgttttggaaagtggtgcattagtattgtctgatggaggtgtttgttgtattgacgagtttgataaaatgagtgattctacaaggtccgtcttgcacgaagtcatggaacagcagactatttcaatcgcaaaagcgggaattatcacaacacttaatgccagaagttctattttggccagtgctaacccaattggttcacgctacaaccccaatttgcctgtgactgaaaatattgatctaccgcccccactactttcgagattcgatctggtctatcttgtccttgataaggttgatgagaaaaatgacagagaactagccaaacacttaacaaatctttacctggaagataagcccgaacatatttctcaagacgacgtgctaccagttgaatttttaacgatgtatattagttatgcaaaggagcacatacacccaataatcaccgaggccgctaagactgagcttgttcgtgcttatgtaggaatgagaaagatgggtgacgattcgagatccgatgagaagagaatcacagctaccacaagacaacttgaaagtatgattcgtttggctgaggcgcacgccaaaatgaaattgaaaaacgtcgtagagctggaggatgttcaagaagccgttagattaattagatcagccataaaagattatgcaacagaccctaaaaccggtaaaatcgacatgaatttagttcaaacaggtaaatcagttattcagagaaaactacaggaggatttgtcaagggaaattatgaatgttttgaaggatcaggcatcagactcaatgtcattcaatgagcttataaaacaaatcaatgaacactctcaagatagagttgagtcttctgatatccaggaagccttgtcaagattgcaacaagaggacaaggtcattgtccttggcgagggtgtaaggagatcagttcgcctgaataaccgtgtctgatgctgtctactacaatcattccctgcgtaacaattaataaatactaattaattatagcaagtttgtattttttacatccttatgctttgtaacactattcaatactgtatgtaggctcgattgagtgggcggcttttttcttattcctgattggctgaaagaaaatattgttaaacgcactaaatttatcccgaaggatgattacatttaaagaccgaaaaatgaagatgcaaagatccctcatattttctactccagtccaaatcgacaagataaacctgccgataaatcatatttcagaacgctaatcaattcatcatgctaagcaggatccaaaattataccagtgggttggtttctaaagcaaatcttttgtcatcaaaggctttatactatggtaaagtcggtgccgagatttcaaaacagatttatttaaaagagggtcttcaaccaccaactgttgcccagttcaaatcagtgtattcgaacctttataagcagagcctaaactttgctctaaagcctacagaagttttatcgtgtttaaaaaacatccaaaagaatgaactattaaaatatggcgcatatggtattcagttgatagggttttattctgtcggtgaaataattggaagaagaaaattagtgggatataaacatcactaagctttttaattctatctattcgcaaaacccttgtatattcgttaattaaattaaatcaatgtacaaatagaacaaaactagaaaaaagaatatatattcatctcaattctatttattttcttttcatgacatacaatggcattaaaagcgatatcgagttatattacattagcttcttgccgccagttatttatgaaataggccaatataacttttctgtaaaaaagaaaacttgacctcagagctttcattacacttattaagaacaacatacttgttgcactatagtaaaaactacagtgaaattgatctcaggatcattagtaatttttctcactataagaaaaaaaaaaaaacatatattttgctatgaattataataagtaaatatatacatatatatgtacagagaaactgacgaagaaaataaatcacccgttaatgcttcttaggtgctcttgaaagtttttataaactgaagagtcaaacctagaaaagttattgtccaaatcaatgaatgttttcgcaatttgacagcttttatagtaataattggcatgttttctatcatcagagtaaaacttttgctgtgggagttcaccgttactatgaactactgtctcttcattgcctgcgtcgtcatcgatacaaaatctcttcctaccctctctgctttttaatttgttatcgggggagggaataaagcccttgaataattcataggcggccagagtgaacccaaattggggagaacttcttaggacacgggctccaccacctttgaaaaagcttctaaagctctcttcctttaagatagttcggatagcatgaaatataccgttatactttgtctcaccttttcgaggatctatctggagccttgtttttataacatcaaaaggagtagtcaagaaggcagctggcataccagcaatggcaccggcagttaaaagctcccatgtttttaatcgattcctctttgttttatcatttggatcaaaatcaaagagatctttttttaaatgtgcataagtgggaaaataaatagcagagaatggaacatctctcattaaacatgcggctacaccattgtacaagcccctcagtcctaattttttgactatttgagtggcagtttcattggcttgttgtatgttttcaccaacatagtcggattggacctgtagcctaatttttacaatctctaacggattagtaaatataacttgacatgcaccagctgaagcgccagaaataatttcaggaaaaaggcttagcttgccgtttttatcagtcaacctgtttctcataaaatcattgacagtcaattttatcgccttttcaggagcaactcctattaattgtggccctaagccagagtagagaccttttattccttcgcgggatataatcttcaacaaacaatcaattgagtttttgtattgggctaaagatctttgggcttgcatccttgtttttataaagtctattgggtatactacagttgcaccaatacaacccgcaatagaacccaaggagaaattgtacaacgaatcgaaaattggataaaagtagtaattaatatacaatgactcattttgatttttttgcaattccatttggtgaactaagtcgttcaggtaatttgggttcaaaattttcatgaaatcttcaattgttaagtcagaacgcatcgttgctttatcttttttacctccaaatacagattcaaacaagccagtactcgcttttgaagcttttttaacaccagagtcttggtcaaatccatccgagagatcatgataatagtcattaaaactttctaaattttttctggatctgcttactccatgcaaatactcattatggataaaaaaatcaatatctgaatcataatggtgatcatttaatagctcgtcatctcgatcttgatttctctttcttaatcttctgttttcctttgaatttgcgacgatagaaaatagtaggttgatttgggaaggagagaactcaatgatattgtttactttgttatactgggcgtttaaaactgtcataaagtcatttttagtaactatttgttccctaatatcctgctcattcaaattattttcagtaacatacttgtgaaatatttggttcagtaggtcaaaattttgaaataaataaaatatatccttgaatacattgtacggaatggaattattgtccgcttttagtaattcggtgtttgatagattcaaggaggaaaatatatctgcagacaccctgtgagagtaaaataaccttagaagataggtgagttgatttttgcttagggctaaacgatgcccttgtgagtccatctgtgccaacctatcaaaacctataaatattttttcattcttaagatcattttgtaaaatcgtgaccagagagtttaaactcaaatactcttcattttcatgataacatttgtaaaatttcagaaatcgaaagtcattccaatcaagtagtaatttgttatctttaacaaaattatcatcaatagattcgtgcaacaggcggatagtatctttgaattggttcagattcaaaagaagatcatcaaagcttagaaatctgttaccataattaattgacttaattcgatcatctgcagcctttaaattaaacgacgaactaccaagctcttttttttgttttgccttcaaattctctacatcaaatttcctaaagaactcatatagaataatgagatgataattatcatattctaataaattattaaaataaaaccaatcattaagcgtcagatatcccttgttttgttcatcaatagcgaagaaaatacacccgaaaacgttcttgggtatctggttcaaattgaacgaatggtccgtaaacttcgaataaatagtctttgagctagatatcagttcaatgaaatcgtcgtatgttaaaattagttctcctgtaagcttctccgtgtcaggtttcccatttcctgctgtgagtttactggagttcactgtcggcatatctaacataccattactgatactaataggcttgtcctcttttgtaaggacacttgcaaaatatttgaatacttccaattgttgcttcttttttctactgttcgaattgatttgctccataatagtataataattctttaaggtcggtagcaaagctgcatactttcaaactacgctatgaaagttatgtacttttccagtgaaatatgttcacaaagaagggatcaggctacttcgaaaattatggcaaacgcgaggttgtgagataaaacttgaaagtctggtgagattagatatcaaatcttaacatataaaagacaggttcgtcttgaggtatttatctatcttcgaaatatttttttctttgcttcgaatactggttaattctgagattcaatatatgtttcgagatgtttttccaacatgccggcagtactcccctaaagcgatgctgcagaaatttttcataaccgcttgcagtgggatgaccaataaagaaagctctttctcctacgtaaaacatagatcatacttacatgtaaaatatgaagcgcaattatatacagtgtcgattttatttaacaatttcacagctggcagtttacaaatgttttcataaccatttcattaatctaacaataaatatgatgatttaccaatatacgaatataaactaaacatcaaacatgttatgacaagtgggtgacgttttccctaggctcctttccaaacaattatcgaagagttttccgaattcgcgccctaaatcccagtagctcttgttgaaaatatctctcataaactgcatcatcccgcatagaaagtgggtattagaaatatgttgaagtaaactcgcttttgcccaaacgtcattctgaaagctaactacatcgagtgagctatccacatataagttccgatacattctcaataggtaaacttcaaaactttctattggaatgtaattgttcttttcctttaaattgttgtttgcaatcgtcgatccattattatcagtattgcctagaatgtttccaccattgctgtcatctggttgaaagcattcatcctttgaggcttctgtattatcccatatgctaacttcacagccatgtaatgcaaaattacaagaccaaattaggagtgaagttaatgcaatcgcatagggtctagtaatcacaggatcagaatttatattgtagctcttcactacggttggaacgttattttccttaatgataaacatttcaaataagaactggaaggcatagactacagctacacccccattgtaggggtccttagcgaactggagaatcctgcgactgatcatgtcatattcatcgcgaccaattggtacattcattctccaaggtgctcctgcatatatgtaataatcatgatgaagaatacgtaggacaatttgagagatatgaataacgggaattttacaatttgacggattatcggaggaaagcaagtccaaatcatcatcacatagtccatctccattatcctcgtcaatttttctgttcgttagtgtctcctcagatggagtacttatcctacatgctttcggatcagtgcagcttttctgaacttcgtgaagccaatagttcattgcaaatgataaaatatctttccatgaaaggcctaaatgatcagtgattccgcccctaaagttagtaatgaaatagtcaccattaacttcctcttgacattgaaataagatcgaaattatccccgccaaaagaatctttttaccaaaaagactctgaatattccaatctgtagtgctttccaagtctgtaggggtactctctattccaccattgttgactttgtttctccgtatattattatttcgtaagatttgaatgacatttttcattaattgcattaacgcagacaaaaatgtattattctcatctctctttgtgctgccatacccatgctccatcagagtttcatagctcaaatcataagattcccacacttgatctggacagggtaaagttagttgaatctgattgctattaataaataaattccagtatccaaacactacagcatgtgtagtgtccatataaaatgcgtagaaagctattcttttcaacatttcaaaatcaatccatcttttataaacttcttgtgggtcttgaattgaattttccccagaggttttgccggttttgaccattaagggatggccgcctaaagagggcgttcgccttagcaattgaatggtcgttccgtgatgtaaaaaagacctttcatgtaaatacctgttcgtacttgttttttcatatccttcgactaataataaactttgaatgatgtaggttttagaaggtggttgaaaatcagcatgagaaaaaattatccatcttagaggaccacaaattgggtcactaatctgttcacgatactcgcttcccaaaaaacttgcgccagtcataattagtgccaaattcaaaattgcaggctgtttatcaacgtgaaaagagggtttgtgaagcagaccgtattgtggatggaagttcaaccagaaggattttaacgatttgtgtatagattcaatagagacatagcgtaattctggaacaaatgaaaacatttcttgacatttttcttttgatatcttatactttgttaagggatccggatggaaaaatgacgggacacttttcatagagtgacgcaactgttccttgtagttcagagaggaattgtttcctactcctgaatctttagatgatctccgttttagctcgttgatattaagcttctgactggaaagattgtccttcactgaagtactggggttatcgttgaacttcggttgtgctttgggaattttaatgttatcttgtggtaactcaaacataactggaggattctggaacccttcgtcttgttgaacaggtttttcattaggtgggattgtattcttgtcagaaaatgtatcttcaatacttacttgcggggcttcagaaagttcttgcatgaaagattgtaatgggtcgctgttcaaaaaatttgtagaaaaaaggtcctgcataactgacaaattagcaccgctagaggaagatgttaatggatctccaaatggattctggggtggtaattgttgttgttgttgttgttgctgttgctgttgctgttgctgttgggcaagcttttgctgctgaaagtactgttcctgttgttgatcctgggtaagtggctggagtggctgctgatatgaactacttgcaaaatttctgtcttgatatcgttgctgctgcacggctggattgatattcatattttggtcattgccattaccgttgttattcgctgcatccacttcaaaaccattaacgcctgtacggttatcaaatatcaaattaaaaaattgattaccattttgaccgttgttccttattcgaggatcatacgatggaaaagtaggacttgcttgctgtggatgcatttgttgctgcaacataggttgttgcaatggtgcccgcagttgctgcgggaattgaagttgctgcagttgttgaatttgttgtggttgttgtgattgctgaacctgttgaggttgttgagcctgttgaagaaaaggacgaaattttgattcttgtgtgatagatggtggtggattcacagaattttttattaagttaatcgtagaagttccactttgcgtagaaaggggtacttcactgggattatatggtgcatttttggagaagtccttatttgatgaggaaatctggtccttgcttggccgacttaatctgtttttcacctttgaatgcctcttttcatgtctgatcagtaaatctttccttacaaacgttttattgcaaggcgcatttgtagtaggaagcacgtaagaacaaacatatatctctttcggccagtggtttagcttgtgtcttgataaatgttcctgacgtgagaaagttttattacattcgggatgtggacacctaaatctttcagcaggagaagagcttgaatttggtgataaatcgttatcattttcccttttccggagcctgccagccaactctttgccgtgcatttttgccaatattaagagctagcttcactgctttattggtcactttttataattataaacatagtagatgagtcctagaatctcaatacagcctttaaaactattaaagaagctgttcgcaactcacaaaaaaaataaaaaaataaagcagaacgaaaaaaaaaaaaaacaaaaaaaacagttaactattctaattacttagaatctttaaaagtcttactgtaattcgatcagtggagaaggaaagcgcacatgtgatatctcgcaatttcttctcaaactaccttgacagtaatttttcttaaaaacgattggctcctacatgaaatccacgaaaaagcacggtagtcttgttagaggacactgatatacgaggaaagaattgataaagcggaaggtctttggaaacaattcaagaccgatgacataacttttaagaggtaggtggggaagcccatatggagaattttaaaagcaatagggtgctcgcttccaagcaaattagtactttttttttttttttagcaggagaataaagcttcaagctaatgcactagagttcgaggtgcatcatttcagttttttttgctagggcataattgatcagcctgttaaactcattgcatagtcagtaaatttacaatccccgaaaataatggttcccttaaataagcgagttaaggacttttttttttttttacagcagtagaccaacctgtacatgtttcatagtcaagtaatagcctgacgaatatcaaacgtttcctctttttcattcctttccttcaaatgccttgggttgaaaggatagacgtgtatttaatgcaagctctatctataatgagtgttattacaattgttatgcttctgcattgagcgatgaataaatataaacaactccttttcgaacaacttgtaattatcctacgcttttgcctgaggtcctttttagccattgacaacaagcaagtgtctttctgtatgaagtaaaccctgcataaagttgttttttgctgcgtcagagggttaatgacttcgaaagacccttttctcatataagacgcgccacagaagaatgcgcacgacaacggactattttagattatataatggcgcgtgtgatgctgctttaatcatgttgcatagaccatgcaattacactaaaaatataaaacaaggagccctggacagaacttggtagtgtgcaaacgagtaagtgaagatgatagtacattatatacgaagctcttagtaagctcatactagatgcgaaacgatggatacgtcagaaaaataacaaaaataaaatataatcattaatgatgttttaactcgacaagcccctttcagagctgccattaccctaagaaccttgcaaagagaataaacttgaatttcgtaaagtgccacgaacagtgtccatattcttacacgagatattctgtgaagagttattgcataaatacggaagaactaaatactagaaataatcccaagctagaatataaacgtctcacatacctaaagccactccttcgtattggctagacgtatttacatacagagcatcgtcacttctatttggatccttgtcattgaagtattcgtccacatgcatcaacaaccaaaccaagaagtcttcggtttgtttgattaaaagctgacagctttgtagatccattgtagtagacgagatcagctctggtaaaacacttatcaaccttaacagatggatagccccataaattctaattggtactagtggcttttgatccttcgatgattttttcagaagttcgtcatattgcagccgttccaacctatataaaagcatattacccaggcacttgtcaaaatacaacttgagaccggcacagtattcgctcaactgtgactgggaccctggcgattccaattcttgactcacttcatgttcgtatttattcagtaccatctctaccgtcacatcagcgggtagtctgcaaatttttttgtccttcgttacgtattcccaatcgtcgactaacacgctcttcaattttatgggaatttgaagggaaatcttgggggttggatagccggcaatatgatgtagcatatttggcgatagcgaagaagatcttctgcggtcatcattcccattttggtcggatgacgagcgcaaagagctgccaggatggagggaattagcggaacttcttccgcttttcctgccgctcactgaagatgttaaaaaactctgtgaagtgctcttacttatactagcattcgagcggctgtctccctttctttttccaccattactaggccctcccagactagtggagagcttcttttttttctgctgttccagtaacgatttcttagcttctttcgcctcgttcgccagtctttttttcatggcaatattctcttcattgtaggcccgtatcctatcatatccaacccactcatcccaactcgacttccagccttggtaatgtatgaaaaaacacttcccattaatgatctcttctggaatgctttcatcttctcccagcttttgtggctttatttccttagttgcttgtgaactaccacctggcttgtcattaggaatgctggtatacattttcgaagatggatcccatattttcaagatctttgcttcatacataagaggaccatggaatgccagacaccgcccaccgagcgcaaattcctgctccaaatcaaccattatacgttcttcaatagggtaaatccagtgacgaggcctcacagatgctaatgcaaaatgctatatgcttttaacgactgttttgcaatatacccttttacgtttctggtcgggatttcggatgcatctttattttcatctttcgtgaaatgcgatatgtggcgatcgccggaggaacggcccccaatcttcgccacctttttctatcagcatcggttggttagtaatctcgaatcacatggtacctctttcttcgaggagtggtagctcctgtacgctgtagcggtagtgaaaaggcaatatatcggagttggtgaagtgagttaaatctctaccttgcgtttttgataagtaaaaagcaagcacagcttaaaggataaacaggattttattgaagcaatttttaattataatacattgtggatagaacgaaaacagagacgtgatagatgaacgtttcaaaaatacttgtgtcgcccacggtcacgacaaatgttttacgcatatttgctcccaggctacctcaaatcggtgcttctttgttagttcaaaaaaaatgggccttaagatcaaagaagttctaccgtttttattctgaaaagaatagcggtgaaatgcctcctaagaaggaagctgatagctctggaaaggcatccaataaatccacgatatcttcaatcgacaattcgcaaccaccacctccatcgaacactaatgataaaaccaaacaagcgaacgtagctgtgtcacatgctatgctagcaactagagaacaagaggccaataaagacttaacgagtcctgatgcacaagcagccttttacaaacttctcttacaatcaaactacccgcaatacgtggtctctaggtttgagacccccggtattgcgtcatcgcctgaatgcatggaactgtacatggaggccctgcagaggataggcagacactcggaggctgatgccgttagacaaaacctactgacagccagctctgctggcgcagttaacccatcattggcgtcatcttcatcaaaccagtcaggttatcatggtaactttccatcgatgtattctccgctttatggatctcgcaaagagccactacatgttgtcgtatctgaatcaacttttactgttgtatcgagatgggtaaagtggctgcttgttttcggtatcttaacctactctttttctgaaggttttaaatacatcacagaaaatacaacgctactaaagtcgtcagaagtagccgacaaatcagttgatgtagctaagacaaatgttaaatttgatgatgtctgcggttgtgatgaggcccgtgcggaattggaagaaattgttgatttcctgaaagatccaactaagtacgagtccttgggtggtaaactaccaaagggtgtactgttgactggacctcctggtacaggtaaaactttgttggctagggccactgccggagaggctggtgtagattttttctttatgtcaggttctgaatttgatgaagtttacgtcggtgttggtgctaaacgtatccgtgatttgtttgctcaagcgcgttctcgtgcaccagctattatttttattgatgaattagatgccatcggtggtaagcgtaatccaaaggaccaagcttacgccaaacaaacgttgaatcagttattggtcgaattagatggtttctcacaaacaagtggaattattattattggtgccacaaatttccctgaggctttagataaggcgttaactagaccaggtagatttgataaggttgtgaatgtggatttgccagatgttcgtggtcgtgctgatattttaaagcatcacatgaagaagattacattggcagacaatgtggatccaactattattgcgcgtggtacccccggtttatcaggcgctgagctggcaaatttagtcaaccaagcagcagtttacgcgtgtcaaaaaaatgctgtttccgttgatatgtcccacttcgagtgggctaaggataagatattgatgggtgctgagagaaagactatggtcttaacagatgcagccagaaaggccactgctttccacgaggctggacatgccattatggccaaatacaccaatggtgctaccccgctatacaaggccacgatattgcctagaggtagggcattgggtattacttttcaattgccagaaatggataaggtcgacatcaccaaaagggagtgtcaagccagactggacgtgtgcatggggggcaaaattgcagaagaattaatttatggtaaagataacaccacaagtggttgtgggtctgacttgcaaagcgccaccggcacagcaagggctatggttactcaatatggtatgagtgatgatgtaggtcccgttaacttgtcagaaaattgggaatcttggtctaataagattcgcgatattgctgataatgaagtgattgaacttttgaaggactccgaggaaagagcaagaagactattaactaagaaaaatgttgagctacatagacttgcgcaaggtcttattgaatatgaaactctagatgcccacgaaatcgaacaagtttgtaaaggtgaaaaactggacaaactgaaaacttccaccaatacagtcgtagaaggaccagacagtgatgaacgtaaagatataggcgatgataaacccaaaattcctacaatgttaaatgcatgattttattctaagaagttaaacgtatgaaggaacctacctcaagaccgagaatgctttgttcttttctggtcggtttcgcttttgcttcataacaccagcaatgaagcatgatcgcgggaaactttcagaatctacatcttctcctggtcagcttgaaacttcagattattcgtaaggagaaattataatattatttctgtgataagaaaagaggcattaagcttgggtatttgcgacaaaatacttcaggataaccgatgatcgcaagtgggttattaatttctttcatcccttaaccaaccgtcgctttcccccagtgacaagccttaaaaaagtcacaccatggaacggagtatcgttgatgattaaaccaatcattaatctttcataaaagttaagataaaagcacttgttgatatatataggtacatgtgtatcaatacgccatacattgtaaatagaatattcaatggataaacgtgtgtagcaaaaataatcacattgtagcgctagttagcaatttactcattgtcacattttttgcagtatatattcatggcatgaaataatataaaatggcgccggtctatatacctatgcatcttaatctatatatatatataaaacagaaacctacggtaacagagctgtttcatgttttttgctttttctcaacggtggacgaagtatcttctccattcaacttcctttttaatttctgaatcagtgttgatggattttgacaataatagttttttgccgcaattttcttggcctcttcagtactcggaggtttacaatcttcaataatacttttacactcgcgtattatggttagtaacttcgcggagtctatcgaatattcttcgctctctgtggacttctctttgtttttctcagttgtactggcatcattttgtggttcttctttttcgtttcccggtactgattcctggctaccttctctgctgggaaattttgtttctaaataccttgtgaccaaggcttcatcctcaatcaataatgttgctagtgttatttggggtggagtgtagaaatatacgacatcggttaataatgcggcagttattctcttcttacacctatcgtatatttggcccatgtaatttaaatcaaccttaccataaaggacgttctggatatctaagaaaaacccatgaagcggtttgtaaggatgatggttcaacagtgaaaatttcaatgattctaacaacttaaactcgaatttgagaacactatctctagtagatttggccttttgagcaaacgagtccacgctaataaaatagttctccgatttgcaggctagaaagatagtagtatgtacaatacttttaggatctatttgcataacagaattttctaagaaaaaacgcctaaaaaaggatatcgcagtggccactacttcggttggcaaatttagatgctgtgctattacctgaactttttttgcgtagaaattcaccaaatcgagttcttcttccattgtcaaagggatagcctttgcttctagtacttttatttcttcttctgttaaattgtgtgcttctctaaattttaataaattttcctcaatgtaagcaatcgctcgggcattggtatctacccttttctcctgaagttgatctttagtgtatgaccacattctatactgagaagagtgcctatataaatcatcgtcagaaattcttttgtagttcggtggcttgttattctcatcagccgattttaattttgcctctttttcttttgctgacatggtagcagaaggagtatctaatgtactctttccatttagttgaatatccgtcattctatcaatatctgtgcagcacagtattttcctctcttaaacttaatattcactcatttgtttgagatctttcttaatataaaaactgtgttaagatcaaatttattacccggattgtgaacggcttaaacaacgaagggataccgcaggaaatgagaggccctttcttctctggatggcaaacagttcgtgctatcaaagtctgtaccaaggttatttcactcttcaagccagcaataactactttctttcaggtcacctctcagccgtcacgtctctagctgaagctttgttattctcgcttcactaaaaacaagtgtatctacaatatttaccagtctattcgtatatcccttatcattctttttcaataagggcaaatacttcggaaaaagaaaggaacattcatcttgattctagccgtaaagctatcacgttcactctaagcaagcggaaagttgagcaaaatcaacgaacaatctgagtcagcaaggcagtacaagcatctcttctttgcccctcaaaatttatttcctttttggtatagtcttacttccaagtccaagcaagcactacgtatcacgacaaaccaacagccgcgccgtttttatattcggaaagagaattcttgtcgttattgaataataataacaaaatttctccacttttcaccatattaccactccctttttttcaagtaaaaaaaaaaaaaaaaagaatcttattgctccttaaaaaaggattcatcagtcctttatgagagcctgctagtatcacctaatattgcatctgtttttaccgaaatttcctcattccaataatgaaaagaataagatcgctttggttcaatgcggaggcttcttattcaaaccttaacaattctcctagtttgaggaacaaaaatagtaccggtaataactctcgctctaaaaattatcgttctttctcaaggtttgacttgatcaactctatacttttactgatgatgctatttttattagctatcttcgtcactgcattatatttaacaaagagttccaggcttacatactcacatgcctcgagggctgccctatttaaccctctgggtgtgatatcgccgtcattgggaaatcatacgttgaactacgatccagaagcaagggaatcttctaaaaaactttatgaactcctttctgatttcaacacggcatattatgatgatgagaacatgattttgggaagtaacttgttctcaaagaatacatactcgagacaaccatatgttgctaacggttatataggtagtcgtattcccaatattgggttcggctatgccttagacaccctgaatttttacacagacgcaccaggcgctttgaataacggttggcccttaagaaatcatagatttgccggtgcgtttgtatcggacttttattgtctacaaccaaaactaaattcaacaaacttcccagaattggatgatgtaggatattccactgtcatttcatctattccacaatggaccaatctacagttctcattagtgaatgattctaagtggttcaatccacaaaatgttacgttggatgacgtaactaattatagccaaaacttatcaatgaaggatggtatcgtaactacggagttagattggctaaacagtcaaatacatgttaaaagtgaaatctgggcacatcggcacattcatccactgggagtggtttctttggaaatttccctgaatacggaccatttaccttcggattttgattcattagatgttaatatatgggatatacttgatttcaacacatcacataggactgttctacatagcacgggaacagacgaaaaaaataatgcggttttcatgattgttcagccagataacgttccatcttctaattgcgctatttactcaacgtgtactgtaaagtatgaaaattccaccaatccaataaattctagtgaatcttttgaagaaaaagatgtttcttctaatatttataatgttattttgacagaggaccaacccaagataatcgttcataagtatgttggtattatgtctactgagttcaataagaacaaagaacaacaagacaatactaatattggtttggccaaaatgatagctctaaacagtaaaggcaattacgagaagcttctgtcaagtcacaaacgtgcgtggtatgacctttacaacgacgccttcattgaaattccttctgacagtcttttagaaatgacagcaagatcgtccctattccatttactagcaaatacaagagattacaatgtctcgagcgataggggtcttcccgtgggagtttctggtttgtcatcagattcctatggtggtatggtgttctgggacgcagatatatggatggaacctgccctattgcctttcttcccaaatgtggctcaaaatatgaataattacagaaatgctacacattcgcaggcaaagttaaatgcagagaaatatggataccccggagcaatatacccctggacatctggtaagtacgctaattgtacttctacgggaccttgtgtcgattacgaataccatattaacgttgatgtcgctatggcctccttttccatatacttgaatggacacgaagggattgatgacgagtatctgagatatactacatggccaattatcaaaaacgcagcccaattttttactgcttatgttaagtacaattcttccctaggattgtatgaaacatataatttgacagatcccgacgagtttgctaatcacatcaataacggggctttcacgaatgctggcattaaaacacttctaaagtgggcaacagacattggcaatcatctcggcgaggtcgttgaccccaaatggagtgaaatttccaaagatatttatatccctagatcctcatctaacatcactttggaatattctggtatgaatagctcagtggagattaaacaggcggatgtgactttaatggtttacccacttggatatatcaatgatgaatccatattgaacaatgcaattaaagatctttattattattcagaaagacagtctgcgtctgggcctgcaatgacatatccggtttttgtggccgcagctgctggtctgctgaatcacggctcttcttctcaaagttacttatataaatcggttcttccatacttacgggctcctttcgctcaatttagtgagcaatcagacgacaactttttaacaaacggattaacccagccagcattcccctttttaacagctaacggtggatttctacagagcattctgtttgggttaacaggaatccgatattcttatgaggttgatccagatactaaaaaaattaaccgtttgttaaggttcaatccaatagaactaccgttgctccctggtggtatcgctattagaaacttcaaatatatgaaccaagttttagatataataattgacgaccacaatggtacgattgttcataaatcaggagatgttcctattcatataaagataccaaacagatctctaatacatgaccaggatatcaacttctataatggttccgaaaacgaaagaaaaccaaatctagagcgtagagacgtcgaccgtgttggtgatccaatgaggatggataggtatggtacctattatcttttaaaaccgaaacaagagcttacagtccaactgttcaagcctggcttaaacgcaagaaacaacatagcggaaaataagcaaataacaaacttgacggccggcgttcctggtgacgttgcattctctgctctagatgggaataattacacgcattggcaacccttagacaaaattcaccgtgcgaagctattgattgatttaggtgaatacaacgagaaagagattaccaagggaatgattctttgggggcagaggcccgcaaaaaacatttccatatctattttgcctcattctgaaaaagtcgaaaatttatttgcgaacgtgacagaaattatgcaaaattcgggaaatgatcaacttcttaatgaaaccattggtcagcttttagataatgccggaattcctgtcgagaacgttattgattttgatggcatagaacaagaggatgatgaatctttggatgatgtgcaagccttattgcactggaagaaggaagacttagccaagctaattgaacaaatacccagacttaactttctaaaaagaaaatttgtgaaaattctggataacgtgccagtgagcccaagtgagccatactacgaagcaagtcgcaaccagtcgttaatcgagatattacccagtaatagaacgactttcactattgattatgataaattgcaggtgggtgataaagggaacacagattggaggaaaacaagatacatagttgtggcagtacaaggagtgtatgatgattatgatgatgataacaaaggagctacaatcaaggaaattgttctcaatgattaaatgaaatgatgcatataagtagcgctttttttaatattataagtttggataaaagttaccaattttttcgtaggatatatattttaaaggcactatattgaaaatatcatgcatgcttatataaaagcttttttttttctatagggtgacatttaggagcaataatttttactacaagctttttttgcaccttatatagtagtgaccttgaaattggtcttttgcaccagcgtactttaattccactaagtactgtttagcagcctgttttccagagcccacaacagttttctataaaattttcacatgcattatatagacatgatctacctaccaatttgatcttcctgccattgagatcagttctttcattacattgattgcacatttttaattggcgccttttctaattttttgtatgagtccatattaaaaaaatagacttcaaattcctactagacgattctgattccatcgggattaccaccagatttgatattggctcttctctcgtcagtagggtttgaacagaaatattcctaaatttctcgcaacttaaattaaatttgcaacgataatgtttgcatacatttttatattctagattcaatacattagaggtaacttgatgtagcgccaatctgaaaatacagaagcctactaggcaaatatttaaagctctatatactattcacgaaagaaaaacgtactttgtataaattgaagaaaatgagtttgtgttagttgggtcctgccatttggtatcctgaaggttttctcaaggtggggtgggctaatctacaggaatagtttatagtaattgtgtgttaagaagtattttggctttaaatgacgtcccccacaaatttattacttcaggtgtataatgtattcacaaatatgttcgtttcttttttgctcttcatcgtccccagtttttcctcacccttacaaaacaaaaacggcaggaaaagggtcctatgtaaattaagcaaacactgcggggtagaacctaaattttaatgtatttttttacaatccaaccaagattaaaccaattgccgagctttttcctttctcggtgaaacaaacctttacaaaagatacgccagagtaaacgcattcctacaaaaaatgaaagatcttcattatttacactcttgtagcccactaatcaattggtttcgcaacattgttcaaaggcagtggtttctttttccctgagtatcctactatagtacaaaaaaaaaaaaaaagagtgaaaaaatcagaagagaaaattatatcgattataaatttttcaagtacatcgtctatcgaagctaaagacttgaataattaaatttctggaaatgggacaagtgtacttatcaacaacgaataaggtatagcaaagtttagagaattattttaattatccctataaaatgaaaccgatatttgagatttgtttgggcctttttctctcccatgagcagtgaagcctacagcagaaccgtcccaattttcgtcggtgattttttctgaaatttgataaagctgagacttaaaattacctgatatttttctaatgtttgatattttctggaaaacgccattagcaattccttggctgttttcgtttaaattgccctgtatgtccgataatttataatttgtgaactcatttgaagcgccttttgtataacaaatctgctgggccaagcctgggaaaggcagagccgtcttctcgccaagtttgagaatcaaacagttttggtttagttcacttcctgaagtattcatatttactcctaagtataggtcgagaggttcaaatgttgttttgattttttcattcacataatttgaaggtagctcgacgtattttggtttaattaggtcatataacctttgcggttcattgataccatcattttcgagcttgttgataagctcgatgattaatgaaaacattaagattacaactcctagcccacaggatatcatattggccggattttcacctacagaaaaacatgataccatagtttgaattacttgaagtgttagtttagtgtcatccagtttcttttcactaacagattttgtagcggcaggtgcaggtgcagtagaagttgatgtcaccgtttcatatacagttttgatgattgtaacagtatctatcatgtcatcatcatggaatgcaaaaagaagacccaggagtgggacgaacgaagcaagtattctgtaaataccaaccatttctttttatctggcgctttatatgtttatgaatagtacgttatgatgattgtttttttacaaatgtttgtgaattacactaatggtaattccctctttagttagaagtaatggaaaattagtactttctaattcttgtgatcaacgctttttcaacgttgccatcatcaacagaatctcgatctgctagccaacatcaaaaagttgtttgccgcacatcatgtaaccgaactttcagtaccacaaaaactaatatgcacggcgcttgaaaagtgctttaattttgtaaactattttgttttgtaaatttctaggcagttgaggctaccgtcgtgaccacagaaagaaaacatcttcaaaacactttagtgactgtccatatagccgccgaagttagtcgctgatataatttgaaacctacattattatttgttcgtttggaagacacgttaggtttagtatcaataaacttcccatccgaaacacttattctactagtgtgtttcataatgcgtaagccagcacgtatatattcatctcaatttgttacacacttaacatactatataattcctgagaaaatgcccagctcataaacatcggtagtccaattcaagaacgggggaactgaatttgggagtaatcaaaaaaaaaaaaagacgttacttcatcgtttttgttgtcattgtacacttctttcatttcttttcagatttaacttctctgtccgtagtcggcaaataacggtcctttaaatgcaagggatcatcaagagattttgaaaaactgtggagccagatatttatttgtcaactttggacatctaccttagtctgtctgcttccctctttttgacctcttttagtaaactctgaggtgggatgactgactctgacggagaaagtatgtagatatctcaagaaagtatcagtccacgatatagtaggaaatattatacaatacgtaatggaagcaaagtgtgcttccatgagttttagacaaatttatgtccctaaaacttcgaacttttaacgggaacaattttggccgtgataaattcttttccaacgcttatattgattatccgttattggttttttgttggagacattaaaagatggccaatggcgtaagaaaattttgaaaaaaagtcagacattcaagttgaaaaactccttcatcttcctacttgagtctatattttcattgatatttccataagagaaggagcagtcaagttcaagaaccaactttccgcagttggcaggtcgaaaaaataaatgcgaattctgtggatcgaacacaggacctccagataacttgaccgaagttttttcttcagtctggcgctctcccaactgagctaaatccgcatatcagaatgaaataaacaagcattcttgtgctttataaatggtccaagcgtctaacttttaaagagtacattctaaaagtaagagacgaagacaacattataataattttctcaagacatatatgtttcaccggcacgttttgttttgtccccttttattttgagcctgaatactatgctttataaaactttaatgcgctcaacaagtgcaccttccaacggaaaaaaagaaattcaacagggagcgatgccatcatcacatgcacgttttcaagtatttataagacttgctacttgctcgtccattcatgactttaatgaggttctaatttattggtgcaactcttcaaactagctgcccaatcagtgctggaatgagtgccaagacaagcgacaaaccctgtcaatctcctgaaaaacaaaaattaagtgcttgagaagaccttcagaagagttgcatagataggatgggtgagcgcaattactagttacgcagtaagtaggttatatggctgctggaggggcagtactgatttaatcacaatccggattaaacttcctcctgaaaaaaaaaaaactacatcaagtcaaaagattttcattcactctttggaaggctgtgtggcattctaacctttatttttttatcaccattctcgaattttcgtggttcgctttcttagcgccgttattctctcttcttgtccacgtcaaagggagtatgcgtaacccctttcaaggttgaacgaaaaaaaaaaaaatatgtccttcaaaattttttttgatttaaaactaaaaaacattcccttgaagcttgttattccgaaagaaagaatctaaaattgcaattggtagtgaaaacaaataaacaaagacataaccgcactccaatcatgtccgaatatgcatctagtattcactctcaaatgaaacaattcgataccgtatgtaagatggttttattggttccatcgtcatcatggttcaaacagccaaatgacccgacacacgtaaccgaagcagttatactaacaagaaagctaattttcaccctccttgctacatttttttctacagaagtactctggtaatagaattttacagcaattagaaaataaaactaatttgcctaaatcttatttagttgctggtttaggtttcgcttatctccttttgatttttattaacgtcggaggtgtaggtgaaattctttccaattttgctgggtttgtgttgccagcatatttatcgttggttgctttgaagacaccaacgtccaccgatgacacacaactcttgacctactggattgtcttttcatttttgagtgtcattgaattctggtccaaggcaattctatatttgattccattctactggtttttgaaaaccgttttcttaatctacattgccttgcctcaaactggtggcgctagaatgatctatcaaaagatcgtagccccattgaccgacagatatatcctaagagatgttagcaagacagaaaaggatgaaattagagcttccgtcaatgaggcttctaaggctacaggtgcttctgttcattaagaggcaactcacctatatcctcaaatcaaactctcgtttttgttctctttgttatctattctattgagagcatataagtacatatgttattagttgttatatatcgctacttaacatataaaatattttggagtcgtttatggtgtcccagaagatagcatttctattcatcgtgttgtgtcgtgacgtgtctcttgatatgcgcgacagaccatccaacgcaaggtcattaatcatgttatgttctgtaattttaaaggcattttttatagagtttcatcgaatttgtgatcgaactgttcattggtgatagatgaagagccatttaaatgaaaatccaacttaactcttaacttcagtttcccagatccagaaattttcaatgactgcttgcaaatttggctggcgtttattgtggaagatggatataactggcctagtgttagcttttgagctttaggaacggcacagaaagtttttaagtcagatattaaagactttgcctgaaaatataaatccaaatgtgctaatccagagtttgcagagagcaaggaagcatatacattcagtgaggaactgtcatatatcttgttggcatccaatggtaaggtgacacctgagtttgcctccactgccgacgaatgattgattgattcttccttgttcgcatttttgggcacctgagcaatgtcattcttctctccaaaaatctcttctaatatgtcaattggtttcacattgtcaccagtagaagccttgctttcagccttgctatcctcacccaataaatctgacagcagatcaactggttcgttggagataaggtttttcgatagagcttttccattatcctgttcctcggtaattttttcaaatttaggcattgtttctaaaatgatcttcttcacagaaattgactgattgaaaaatatctcgtattgattgcttttcatttgcagtgataaatcagtggaatccgtgtagctcaatatcagttgtcttagtttttcaatatttttcgcgtcatggaacctcacagataattttaatgctgctgttaaaatgtaattgattatcttcagattcgttgctgtgtagagttcttgcaaagttagtaagtaatcagtaatagatgactcattgattatgtctgcaccatttttattgccctcgttgagtactaaatcgccatattcgccaatgcaccaaatcaaaaccaactgccaaccaatattttcctcggaaatctccgctgatgttccatttagtgaaattgtcagcattttccgtaaaaattcagatttgtcggataactggctcgtattatttattatgattagaatatcattaattttttcatagttgataaacgatcccactaattttaagatattaaagaaaacatctaatttccagctttcatctttgacaacgcgggtatcaaaagtgtcaattaagtgatctatagtgtatattatgagatcttttgaatcttcatcctgttttgccaaaaatttcatcaattcgttaaccaattccactaaatttgaatcgtccaagatggcgaagctcaactctaacgctctcatgcggatcgacacatcggtatcctgcagacaatgagaaatgaattttctatgcctttgtactgcggtaggctcttggggaacaacttttaataaggtgtttaatgaaacgtatttagtattattatcttttcctgcaagaaacttggccaagatgttaataccaaggacacgtagaggctggttcaaatccaacgaaaagatcgtcttcacggtctcataaagaatggcctgtccgctgtttttcgttgaatccgtattcgtcgcaatacgagtcaataaatcgcagaaattatctttgtagtccaaaacattgttcgaatttaagagctcaccaacttgaaagtatagttttaaagtgtaaattatttcacactgcagaaatgggtcacaaataccttggacatcatatccaggttcaatatttttagaattcatattttccaaacgaatgaaaaaatcacgcaaaagtaaagataatggagacaagatgtcattgctgtaatcaataccgtcttcatcttcatcctcatctttttttctgttcaatccaattaacaaaatagattgtatgattttcgtaacgcctaaaagtacaccgtgagtacatattgaatgactagacaatatcttagtaatgtcttcgatgttgaagatttctaaaagtgaaacgtctttgaaaattagtttggcagcacattgaagcgcttttttcaagaggaaagggtctcttgaatttttgatgatattttcgacgtctgggtataaatctctggctaattcaggggagctcaaaaagcctaatgaggttagtgcaagtgacactgcatatttgttgggatgatgcaaatcgttgttcaacatgttcgttaagagtgtcaataaatcttcagattcgtccaacaataaagttgcggccagatagcctaatcttttatcgacaaaatcgtcagaagcaattaaattgatagactccacctgaccgaaatgtgtcttttcccctagaatgtatagatacagaagtttctggatatttactcgccttttttcatgtggtagatggtcatctctcaattttgtcctaattttagcagattgtttcgttataattgccctttcatctgccagtgttttggcaccacgaacgtctttgataaagcttctcaacgaagagcccattatggtgttcaggtctttctcgttgctaaatcaagatggtcaatatttcttctccaatattagcagtataaaatctcgaaaaagtatgatttagttgtaattctcatatggccaagcccactaaattcagtgaatacaaacagctaaggacgtcaaaactcagagtcgggtaatcttcatttgaattttttttctcttaaggtagataacaccaaagaaaagcaatcagtagcaaaatatggactttaacgctgtcagttccaattgagaaatatcgtaaagaaagttagttgttttcactcgcaacctctctaccttcgtggcctaaaatagatttaaataatcgaataaacggtttgttcttatatgtgataccctctttcaccaccttcctgtagccccagttggtattacttgtcccaacctcattcctctttccattatcaattaatcggtttgtgttgttcgtagcaggaccacacttccggaattatatacatttacatgtatatagagaagaaagcttcggcggctaaagaatagaaccatctattacccgctcgcccggtcgtttggatgcgtgggtggtatagtttcttttttttcattttaagggataccgctccccacgtaccccacgaccagccctagtggaataagaaatgcaaaatccggggttggcgcagcgattctgcacggccaaaccctgggcttctttattttgtagatctgccaaatgatggctatgccttactcggtatcacatggaaaagacccccggcttattgaatcccgtctcccgttccctgcatagttgtcacggtttggactatatatatcgtcgtttctctgttttatttattatgatggctctccaagggtaatcagtcagactagtaagcaaagtcaatcatgcaatctactgtcccaatagcaattgcgagcaacggcaacaagagagatgtcgtccagaacgtttctgcaggcgacgagggtgatatattgcaaaggctagcccgtaacagagagatgatttctacctccctctcgccacaaaaatcgtcaggatttagtggtagaaggaggtcatctagtgttagggacgccctttcttctttttttggaactggtaatagtccaacatctagtatggacgattattccaatttgatgaaccgtaactattctaccgcatcaactgccatgtgtagggggaacagttttccttcagatgttggcactaaggcttacaatattacgggatcttaccaaccggataggcacaggaattctgttccgtataccaccatagaccagttacacacaaggcaagacaccgggttgaggagagagtcagatccagtcgcggcaaaacaaatatctagtaataatgatattgttaggtcattcataacacatcatgctagtaatagcactatgtttattaatagggtgctatcggactatttagcggatcgtggtttcatcaagcaaacaccgttatataataagaaaagtgtgctggaaatttccattgcaacaagtgcagaatcagttttcttgccaactacaaaaagtgatgaaacagagtatctatcactgattcatggttctttaaatcaggcgcgaacacagcctgtcgggtccactaacactgcagaaagtgatttcctcccttcatgtcctacgatggacactttgaatgaaaacaatgatttatcactatttccgttacatacacagcgaaccagcccctctaatacagcaaggacaggtaatgctatggatacaagcaattctgatcgtgcttctccggcctcgaacaataacacaacagatgcggattcctttgttgcgagtggcaataacaaccctatgaataataacaattctcccgcgagaaacagacatcctaattctcactcgcgttctcttcctaatgcttggaatagccaaatgccttcattcagctttgcattgatattttccctgaataaatcaactaccctttctgatattaaagtagaactcacttctaacgtgagagtggtgtggttcaatggtcttccccctaccaagaatgttaacgaggaatgctataatataggttctttggactggaccttaaatgcagacaactttaatcttttcattccgcaaggcgcaaagtctcctcttgatatcgttgaaaatcattccaataacaggaaattgaaagtgctccagaaattatcgatgaggaaacgccgttctttctcgaataaagcagttcttagggaaaatatattaaacaatttaaatgcctcgaattctacgaacaagttaaatgctggtgtttatgtctttactatccccatagtgcttgccagtcgtattcctgaatcgctttactacccatcagcgagggtatcctacagcttaagattagcgacaaaattgaaggatgaacatacacagttggttgcatcacggccacgttcttcttctatctcttctcctcaaaaactgcgttcatattcctgttctgattcttatgaatattctcaaattgatgacaccatagaaggagaaacctacaataacgacaaaaattctactggaaaaatcgcatttccctcctcatggttaaaaagtgcgaaggggcgcttaaaaaggaataattctaacggaaggtcagataataatggcgcatcttctagtggtttagcgatgcaacatgattctgaagacactataaatttacagtacccgcttaatttggtgagaactccgccagaaatctctgtcactacagcaaataagccactttacattaacaaggtttgggagaattgtctttcttatgaaatttcattcgcccaaaagtatgtgcccttgaatggtgaaattccaatcacaattaaagtggcacctctagtaaaaagtcttagtgtcaagagaattcgtgttagttgtagagaaaaaatctcctacaggagtaaagactatcaatatgattttgaccagttggatccattggcttcagatccttgcaatccctatcatatgagatatttagtgagaaaaaagaaggacagaagcttgcctctatttgaggtggcctctaaatgtactagtgggccttctattagagaggaagttgtcaccaatacagttgatgataacttattagcctacacttcatcaaaagaaaacaacaaagatatcccattttctgagtcctttactgttaaaacgaagttaaaatttccaaaatattgtgaagtggacgctaccaaagctgcaagtctaccaccatatggtatcgatcttttcgacccaataaaagatccaactcagagtgagaacacctctaataacggcaatgtattgggctttctagtgggtcgccctaacagggcttccaagacagttcataaaataccgcaagacaagaatcataatgaggtcaatgatacaaatggaaactcgaatacatctttgcaaactagctcgaatgttcccattcagcactacacacggttgaataaaccaagacgcggtttatatttggacagtatgcattttaagaatatccaatgttctcataaattagaaatcgtcttgagggttagcaaaactgatagtggtagctcaaaaatcataaggcattatgaagtaattgttgatacaccaatttatttgatttctgacctttgtaacacttcaaatatagacttaccgacttatgacatggccaccactgaatcttctaaagtcctgccaccaacttttgaagaggcaacatcagtttcagcatcaccaagatcttctgtatcttattatcccgatgacatttccatgcaacagttgaatttgtctaggtcgacttccctcgcaaatggttacctgtcaaccttacatccaaaaacaaccgctgtttcggactcgtctaacggtgccccaatccgggaccagcaagagcaacaagcacgccccttgaggactgaagattatgcgctacaaatggggaatgaaaataacgcctatagcaatatggacggtttgctttcgcaggatatctttgaacaggagaccgcggccacgctatttaaaagagacattgtcacaatgaactttaacaataatatattcacaccacggtatagtccgcgcacttttaccaataccgactacaattataatgataatgataataatgataatgatacagaggggcctggtccaataattcatccgggtcctgaaccaccaagatatgacgagatttcatcataaatattaatatcttcactttttttataaacctcacacacacatatatatatacatttgtacaaatatgtacctgtccgaactaactttttttttcgtgtaatatacgtagaatatatgtctttcggctcatcgcaaattgtagcaccgaaaaaaatggaagacgataataataaacaagtttgaaagtttgaaagccgtgcagtttttcaacgtattaggtttttttattcaaataactttgacaagggcgttgtacgacttagcacctaatgaataggggatcattagatgatgggcctaaactacgtgaagaaaagcacttccaagatttttatcctgatcttaatgccgatactttactgccgttcatcgttcccttagtggaaacaaaggataacagcaccgatactgactcagatgatatttcaaatcggaataacagagagatcgggagtgtcaaaagcgtacaaactaaagaattgattttcaaggggagagtcaccactgaaccactagtactgaagaagaacgaagtggaatttcaaaaatgtaaaataactacgaatgagttaaaaggtaagaaaaatccatactgcgttagatttaatgagagctttatatccaggtactatcatataaacaaagtaagaaataggaagagttataaacaacaacaaaaagaattcgatggtgtggaggcaccctacttcaccaaattctctagtaaagaagccccgaatattactatttcgacgagtacaaagagtgcaattcagaaattcgctagtatttcacccaatcttgttaatttcaagcctcagtatgacatggatgaacaggatgaattatatttgcactaccttaataagaggtattttaaagatcaaatgtctcacgaaatatttgaaattttaatgactacactagaaactgaatggttccatattgaaaaacatataccctcaacgaatagtctgattgctaggcataatattctaagggactgtaagaattatgagctatatggttctgatgatggaacaggtttatcgatggaccaggcgtgtgcagtttgtttaggcacagacagtgacaatctgaatacaattgtcttttgtgatggatgcgatattgctgtgcatcaagaatgttacggtataatttttatcccggaaggaaaatggttatgtagacgatgtatgatctcaaaaaataactttgccacttgtctaatgtgtccaagtcatacaggtgcattcaaacaaacagacaccggttcttgggtacataacatttgtgctctatggcttccagagctatacttttcaaacttacattatatggaacctatagaaggcgttcaaaatgttagcgtatcacgatggaaacttaactgctacatctgtaaaaagaagatgggtgcttgcattcagtgctttcaaagaaactgttttacagcatatcatgtcacgtgtgcccgtcgagctggtctctacatgagtaaagggaaatgcactattcaagaattggcctctaatcaattctcccaaaagtattcagtcgaaagtttctgccacaagcatgcacctagaggatggcaaacgagtatagaaggtattaataaagctagaaaatacttctctctactctctacattacaaaccgaaactcctcagcataatgaagctaatgataggacaaattcaaaattcaacaaaacaatttggaaaacacctaatcaaacgccggtagcaccacatgtttttgctgaaatattgcaaaaggtcgttgatttttttggcttagctaacccaccagcaggcgcatttgatatttgcaaatattggtcaatgaaaagggagcttacaggaggtaccccattaactgcctgttttgaaaataattcattggggtccttaaccgaggaacaagtgcaaacaagaatagattttgccaatgatcagctcgaagacttgtaccggctcaaagagctgactactttggtgaaaaagagaacacaagcttcaaacagcttgtccagatcccgaaagaaggtttttgatatagttaaatcgccccaaaaatatcttttaaaaatcaatgtactggatatctttataaaatctgaacaattcaaggctcttgaaagattggttactgaacctaaattattggttattttagaaaagtgtaaacattgtgattttgatactgtccaaatttttaaggaggaaattatgcatttttttgaggttttggaaactctacccggtgcatcaagaatactccaaactgtctcatcaaaggcaaaagagcaagtaacaaatttaattgggctcatagaacatgtagatattaagaagttgctatccagagattttataataaatgatgacaagatagaagaaagaccatggagtggcccggtgattatggaagaagaaggtttaagcgatgcagaagaactgagtgcaggggaacaccgtatgctgaagctaatccttaacagcggataaaataaaggttttaatattgcattatgtataatgagtatgtatttttatgctattcttgtaaaagtttggcttattatttactttcatggaacacttagtaaaaataacttagaaaggtcgtcttttctttattctttagcatttcaataccgaactaaatatccgtttttatagtttagttggttttgtttaatttctagaatcctgttcggcgcttttgttaaaagtaaaaaatgaaaattcaaacgaaatgaacctaatcacgttagaatttaaatcttggaatatgttaaatataaaacaagaagagcaagcaatactatttctgactaattctctatacacataagagcaaaacaaaatgttcggtagcaaacgtctgaaaaatgttaaggaagcatttaagtccctaaaaggccaaaattcagagacacccattgagaactcaaaggcgtcttttaaatccaaaaattcaaagacatctactatttccaaagatgcgaaatcttcctcttctttgaagattcctataagttcaaataacaaaaataaaattttttcactagcagaaaccaacaaatatgggatgagcagtaaaccgatcgcagccgctttcgatttcacccaaaatttattggcaattgctacagtcacaggggaagtccatatttatggccagcaacaagtggaagtggttataaaactggaggatagatctgctataaaagaaatgagatttgtgaaaggtatctatttggtggtcattaacgcaaaagatactgtgtatgttttatcgttatattctcaaaaagtacttacaacagtgtttgttccggggaaaataacatcaattgacacagatgcatccttagactggatgctaatcggccttcaaaatggttcaatgatagtttacgacatagatagggatcaactttcctccttcaaattagacaacctacaaaaaagctcattttttccggctgcaagactatcacctatagtatccattcagtggaaccctagagatattggaactgttttaatatcatatgagtatgtaactctaacatactcattggttgagaacgaaatcaaacaatccttcatatacgaattaccaccttttgctccaggaggcgacttctcagaaaaaaccaatgaaaagagaactcccaaagttattcagtccttatatcaccctaattcactgcacattatcactattcatgaagacaattccttggttttctgggatgctaattcaggccatatgatcatggcaaggacagtgtttgagacagaaatcaatgttccacaacctgattacatacgcgattctagtactaatgctgccaaaatttcgaaagtgtattggatgtgtgaaaacaatccagaatatacttcactactcatctctcataagtcaatcagcagaggagataatcaaagtctcactatgatcgacctcggttacacacctagatattcaataacctcttatgaaggtatgaagaactactatgcaaatccgaaacaaatgaagatatttcccttaccaaccaatgtgccaatagtgaatatactaccaattccaagacagtccccgtattttgcaggatgtcataatccggggttaattttgttaatcctaggtaacggtgagatagaaacaatgctatatccttctggaatatttacagataaagcctctttattccctcaaaatctttcctggctgagaccattagccacgacttcaatggccgcttctgtaccaaacaaattatggcttggtgcgctttctgcagctcaaaacaaggattatttgttgaagggaggggttagaacaaaaaggcaaaaacttcccgctgagtacggtacagcattcattaccggccattctaatggctcagttaggatatacgatgcttcccatggggatatacaagataatgctagctttgaagtgaatctatcaagaacgttgaacaaggccaaagaactagcagttgataagatatcttttgccgcagagactctcgagttggcggtgtcaattgaaacaggagacgttgttttattcaaatatgaagtaaaccagttttacagtgttgagaacagaccagaaagcggtgacctggagatgaatttcaggcggttttctttgaataatacgaatggtgttctcgtcgatgtgagagacagggcacctaccggtgttaggcagggatttatgccatcaactgccgtgcatgccaacaaagggaaaacatctgcaatcaacaacagtaatattggatttgttggaatcgcatatgctgccggaagccttatgttgatcgatagaagaggtcctgcaatcatttacatggaaaacattagagaaatctcgggagctcaaagcgcatgtgttacctgcatcgaattcgtaattatggagtatggagacgatggttactctagtatattgatggtctgtggtactgatatgggcgaggtaatcacatacaaaattcttcctgcatcaggtggaaagttcgatgtgcaactaatggatattactaatgttaccagtaagggtccgatacacaaaattgatgcattttcaaaggaaacaaaatctagctgcttggcaactattccaaaaatgcagaatttaagtaaaggcctttgcattcctggtattgtattaataactggattcgatgatatcagattaataacactgggcaaatctaaaagtacacataaaggtttcaaatacccgcttgccgcgacaggtttatcttacatctcaaccgttgagaaaaataatgataggaagaacctaaccgtaataattacattagaaatcaatggccatctaagagtttttactattccagatttcaaagaacaaatgtctgaacatattccatttccaattgccgcaaaatacattacagaatcatctgttttaagaaatggtgatatagcgattcgagtgagtgaatttcaggcgtcactattttctactgtcaaggaacaggatacgctagcgccagtttctgacacactgtacatcaatggaatcaggattccctataggccacaagtaaattcattacagtgggcaagaggcactgtatattgtactcccgctcaattaaatgaattattgggtggcgtgaatagacctgcatccaaatacaaagagagcatcattgctgagggaagtttctcggagcgttcttcagacgataataatgcgaaccatccggaacaccagtataccaagcccacccgtaagggcaggaacagtagttacggggtactaagaaatgtttctcgagctgtagaaactagatgggacgccgttgaagatagattcaacgactatgctaccgccatgggagaaacaatgaacgaggctgttgagcagactggaaaagatgtaatgaaaggtgcccttggtttttaaatacatacactaattcatacagggtaatgagcaacttccttctatacttatttttttttagttctatatgctttataaattaatttgaatcgatttatttttcattatacatgtctagttttacgaaggtttgtaaatacatgagctatcaagtttataatcctttaattaaacgagtgacctcatttagaccatcttcatgaatttgtgataacttttcttgaacaataggaacaatgtcagccgcactaaccaattcaccatcatcatcggcaaattcttggcccaatcttttgacacgtaatttaccttctaagtactcctccttaccgaggattacggcaatgtgacaacccgctttttcagcagcatcgaattgcttcctaggattagccttggccttatagacatattcagcttcaatgccagcatcccataattgcttagtaaccttcattctttcgggtaaataaccagtccagtccttaccaccaccaaaagccataacgaacacctgtgtagccgttggctttatagttgtagaggaattaattctttgtttgatcaaagaaaatattctttcaacaccaaatgaaataccaacacatggaatttgagtagattttttgccggaagcttcagagaacatgttgaccaaattatcatatcgaccaccggctgcaatagagccgacaccaacgaattctgacgcgtcttctgcagatttggccttcttcttcaattctgaagcattctctggtggagcagatgcagaagtaacaacttcatagatcaaacctgtatagtaatccaaacctcttgcaagagaaagatcaaaagagatgaatgagtcaatgtcaaatgcttcggtatacttcatcaaagtagcaatatcatccaaaccttgtttagccttttcgtttgaagtaatgttggcatctgcggatagaacagcgtgaatttccttcaaagaaccatttaatttaacatactcaccgattttatcagcagtttcttcggattgacctttttcttcggtcatttccttcttgactgcttcccatggagatttgtccaacttatcgacagcagaagagattttcctcacatcctcatctttaacaccagcgatttggaagatcccatcaagaatcttcctgtgattcaatttgattttgaaatctttgattcccaaactggtcaaaccttccactaaaatggacaaacattcggaatcaggaaccatagattcgaatgtgcctgcaacgtcaaaatcacactggtaaaattctctcatacgacccttagtcatggctggttggtctcttctgtagacttttgcaatgtgatacctcttgatactctgaatattgttcatggcaacgtacctggcaaaaggaacggtcaaatcgtaacgtaaagaacataattcaccaccctggtcctccaagttgtagatcagtttggagtcctcaccatacttgcctgctaaaatttctcttaactcgaaaacaggtgtgtcgatagtgacaccaccatgcttcttgaataggccagataaagtgctaaaaatggcttctctgataaccatatcactatcagcccaatccttcgtacccttaggtgttttcaaagacacttgtagtttacctttctttggagcctttgaagcttttagagcattagcagcattagcagtaggagcagaagtagcagcagcggtagcggatgacatcctgattatcgaagacgactttatagatgtgactactttatttagtgatctactaagcattaagcaagagacgagcagaaaggaactattctaaagtaacacattgggccgtaagactcatttaaaagcccggtcgatcaaggccataagtcatcttcgagctggttagaattgaagaaaaaaaaaaacttgataaaaaatttcaaacaaaaaaattatcgccttacacggaaacgaatagatttacttattacacaagagagaacagtgattataaggaaagaaagagatatatacaatatttccatcaaagacgtacgcatcacggcgttcatataagtatatcatcggcaagtcttcacacctttcaatacttagacttgttcaccttgagtgatcctgaaaaaaaaaaatgatggccgcgtttcgaagaaaataaagaaaaaataaagcaaacctcaaacaagaaaacaaagcggaaaatggtaaacaagagagatagaacagagtagtaggctattagcaaaagcgcgagaattactacattataaaggatctgtcaagaatgacattgaataggaagtgcgtagtgatacataacggatcgcacagaacggtggctggatttagtaacgttgaattgccacaatgcattataccctctagctatattaaaagaacagatgaggggggggaagctgagtttatattcggaacctacaatatgatagacgctgcggcagaaaaacgcaatggtgacgaggtgtatacattggtagatagccaagggttaccgtacaattgggacgcattggagatgcagtggagatatctgtacgacacccaattgaaagtttcacccgaggaactgccactggtgattacgatgcctgccaccaatggtaaaccggacatggccatattagagcgctactatgagctggcgttcgacaaattaaatgtaccagtattccagattgtaatcgagccattggcaattgccctatccatgggcaagagttctgcattcgtgattgatatcggcgcgtcaggctgtaacgttactcccatcattgacggtattgtggtgaagaatgctgtagtgagatctaaatttggcggtgatttcttggattttcaagtacacgaaaggttggctccactgattaaagaagagaacgacatggaaaacatggccgacgagcaaaaaaggtccaccgacgtttggtacgaagcaagcacgtggattcagcaattcaagtctactatgttgcaagtaagcgaaaaggacttgtttgagttggaaaggtattacaaagagcaagcagatatatacgctaagcaacaggagcagttaaaacaaatggatcagcaacttcagtacacggcgttaacgggaagccccaacaatccgttggttcaaaagaaaaattttctattcaagccattaaacaagactttaaccttggaccttaaggagtgctaccaattcgcagagtatctcttcaaacctcaactgatatcagacaaattctcaccagaggacggactgggaccgctaatggcaaaatcagtcaagaaggccggcgctagtataaattcaatgaaggccaatacctccaccaacccaaacggattgggtacaagccatataaacaccaatgttggcgataataacagtactgccagcagcagcaacatatcaccagaacaagtatactcgctactgttgacgaacgtcatcatcacaggatctacctctctgatcgaaggtatggagcaacgcataataaaggagctgtcaatcaggttcccgcaatacaaattgacaacttttgccaaccaagtcatgatggaccgtaaaatccagggatggctgggcgcccttacaatggccaatctgccatcatggagcttgggaaaatggtactctaaggaagattacgaaacgctgaaaagagacagaaagcagtcgcaggctacgaacgcaacaaactagtggtaaggcgcaaatatccaaaagggattgtaggcggctagaaggagatgagatctcgacccatttttctcagcgccggtagtagctatcagtaaggagtaagcgggtttccttcaagattcagtccaccccctactttgagtgagggacatataaacaaacgcgataactcgatgaacccattctaatataaaaaaactgtataaatagttatatagagatgaactctaagctagtgaggcccactgtaaacagccatttttcaatatgcgctacccggcggcggaatatcgtcccagctacatgatagccgcttttttgtctctctttgtcccacctgttcaaagacatttggtaatcagtttgtcaggacaatagtaaacaaaagtgcgcaagtacacatgcgctgcacgtgcggccggaacaatggcgcttttggctcgtccggatgatgcgaaagggaaaataaaatctcgcaatcggaaaaacactcgcgagaaccaaaacaaggatcccctaaacccagtacccgcatacggttctcccggggaaaagggggcggaggccggacgatgagtgttacccggataggactacggatcgcttcgcacgtttgtttacaattgatgactgcgctcccctaatagataagataagctcgcgaaggcagaaaaaaaaaagtcttctacagcagttggtccgcacagacgatgccagacggtgttttatcgaaaatttttttcgcatcatagtgccatttgtggtcattattattccccaaatatgcgaaaatagtacactatttttggcaggagagtaggctgatatgccgcattgatgtcctgtgtagcgaaacacaaacaaaaaaagaaaaagtaggatgaaaaaaagaaaagtaatatgaaaaaagagtgaaaaattaattcatttgttagtgtaagcggtcaggtgtaagtagtaggcttgataatgaattaaagatgactccgacgcatattgtttgccatgtttttattttagtttgtagatttctttttttgtaatatataagggagtgattctatatatcgaattctcaggcttggttggttcgtaggttgttctgtctttgttttcgttaggtaagaacatcacacaaagataactatagaatcacatacatatttgtgagaaattaacttcatttcatttatagaagaagttcaaccgaaacaaaaattaaacataatataatataatataatcaaaaatggctgaagcaagcatcgaaaagactcaaattttacaaaaatatctagaactggaccaaagaggtagaataattgccgaatacgtttggatcgatggtactggtaacttacgttccaaaggtagaactttgaagaagagaatcacatccattgaccaattgccagaatggaacttcgacggttcttctaccaaccaagcgccaggccacgactctgacatctatttgaaacccgttgcttactacccagatcccttcaggagaggtgacaacattgttgtcttggccgcatgttacaacaatgacggtactccaaacaagttcaaccacagacacgaagctgccaagctatttgctgctcataaggatgaagaaatctggtttggtctagaacaagaatacactctatttgacatgtatgacgatgtttacggatggccaaagggtgggtacccagctccacaaggtccttactactgtggtgttggtgccggtaaggtttatgccagagacatgatcgaagctcactacagagcttgtttgtatgccggattagaaatttctggtattaacgctgaagtcatgccatctcaatgggaattccaagtcggtccatgtaccggtattgacatgggtgaccaattatggatggccagatactttttgcacagagtggcagaagagtttggtatcaagatctcattccatccaaagccattgaagggtgactggaacggtgccggttgtcacgctaacgtttccaccaaggaaatgagacaaccaggtggtacgaaatacatcgaacaagccatcgagaagttatccaagagacacgctgaacacattaagttgtacggtagcgataacgacatgagattaactggtagacatgaaaccgcttccatgactgccttttcttctggtgtcgccaacagaggtagctcaattagaatcccaagatccgtcgccaaggaaggttacggttactttgaagaccgtagaccagcttccaacatcgacccatacttggttacaggtatcatgtgtgaaactgtttgcggtgctattgacaatgctgacatgacgaaggaatttgaaagagaatcttcataagcataatacaatggtgcaaaattttttttaggcaggaactaatctactaataaactaacaataatgcacaggaaatattaatgatttatttatttattttactactatattacattacttttttacataaaaaatttcccatctcacgatcaaaaacaggcatgagaaaaaatcaaaatttataaaattaatttctaataaattaactgtaatgacataaaataagaggctgcgacagtcgaattttttctttttttttttttgcaaagcgacgctgtgttgtatattgctctaaaataattttctattgttttcctcatgccattaccctacctacccgtgcataattacacgagggggagagctttttcttcccaaaccagaccaggaaaaaaaaaaaggtttgataatgaaaaaaaaaaaaagtattgtatatgactgttttcctgataaaagaatgcctgcaataattcaaagacaagagatataaaagtgcactggcgatttcaggaacaatgggcgcaaccaaaattttaatggacagtactcatttcaatgagatccgtagtataatccgttcgaggtcagtggcatgggacgccttagccagatctgaggaattgagcgaaattgatgcgtctactgcaaaagcgttagaatccattctggtgaagaagaacattggtgacggtttatcatcttcgaacaatgcacattccgggttcaaagtgaatggcaagacgttgataccattaattcacttactttccacctcagacaacgaagactgcaaaaaatctgtgcagaacctaatagctgaattgttatcgtctgacaagtatggagacgataccgtgaagtttttccaagaagaccccaagcaattggaacaattatttgatgtgtcactcaagggagacttccagactgtgctaatctctgggttcaacgtggtctcactcttagtgcaaaatgggttgcacaatgtgaaactagtggaaaagctgttgaaaaacaacaacttgatcaatatcttgcaaaacattgagcagatggacacttgttacgtgtgcatcagactattgcaagaactggccgtgataccagagtatcgtgacgtgatatggttgcatgagaagaagttcatgcccaccttattcaagatcctgcaacgtgccacggactctcaattggccacgcggatagttgcaacaaactccaaccacctgggtattcaattgcagtaccactctttactattgatatggttgctgacctttaacccagtttttgcaaacgagctagtccagaaatacttgagtgatttcttggacctcttgaaattggttaagataaccataaaggagaaagtgtccagattgtgcatatccatcatcctgcaatgttgctccacgcgcgtcaagcagcacaagaaggtgattaagcaacttttgttgctcggcaacgcgttgcccaccgtacagagcttgagcgaaagaaagtattccgacgaagaattgcgtcaagacatcagcaacctcaaggaaatcctagaaaacgagtaccaagaattgacctccttcgatgaatacgtcgccgaattggactccaagttgctgtgctggtctccaccacatgtcgacaacggtttctggtccgataacattgacgagttcaagaaggacaactacaagatctttagacaattgatcgaactcttgcaagcaaaggtccgtaacggcgacgtcaacgcgaaacaagaaaagatcattatccaagtcgccttgaacgacatcactcacgtggtcgagcttctaccagagagcatcgacgttctcgacaagactggcggcaaagccgacatcatggagttgctgaaccattcagattctagggtgaaatacgaggccctcaaggccacgcaggcaatcattggatataccttcaaataaagatatagaagaccgtaaagtagtagtgggtttgaagcctaaataagtagttttgtacgtactattattttaagagaagaacatccatagaaaagaaaagaagaaaaagaaacgaaccagaagagggtagcagaatcagtcattcacgcacccggcctgcgctgcgtgcaccgactgcgtgcgtgcgtgattggtaatgcagtgaatcatgctttttcatgacgcctcctccccgcccctgagccttcggtggccgccgaagtcgggtattaatgggcgcccctttcctggtgtccgggaaccgcctgccgaaaaccaccctccgcaggtccgcggaaggtgggtgtggctgtccccgcgcaaatccgagatcgattccgcggcgggtcggtcattcttttcatttgcgcgctaatatgcgctgtgactggcggttagtcatctgcgtgatcaatcgttgtcatgacgctctataacgtaagagaactttagagggggctcaattagcatgaagaacagacacatatataaggtctctagatttctccaatagctcaactctcacaattgtttcctctagtccttgtaaaatataaaaaatcatcatcaaacaagcaactacaaaacagctttactgacaactcacacaaataacacaaaaaacaaaaatttcaacaatggtcgcctttttagaactaacttctgacgtttctcaaccttttgtcatcccatctctttcgccagtctctcagccaagctcaagaaagaactctgacgcaaacgtcgatgacctgaatctggctattgccaatgccgctcttttggatgcctctgcttcaagccgctcacactccagaaaaaactctttgtctctgttgtaagtgttgtacacgagaattagcacactattagcataaaagacacttggcatctttacttacttgggcaagtaagtcacgtacttttttttttttttccggagcattcattgtcattctatctgcactttcccgcacttacattcaataacctcggatcgggtctcttctacgacagaaactttttgatatatacatatttatgtaatataaatactgagaaagtaaaaaaatttaaaatataaaataataaaaaatttactattactataattgattaatgtaatctttctttgttcaaccgtgctgtttagcctccttctcgagagacacgcgtttaccgtcgctgtcactacatccacaatcgtagtcctccaggatggtagcacagtcatatatgtctttctttaggtattcgttcaccttgttgtgaatgtggcatccccacattgcggcagccgtcctgctagatgtctgtacgggatacttctcaatcaactttacaaagtgatatgaacattccccgcatggatagagttctgcatacaacccaataaacgtgtgcagtttctctctttcttcaggagtaggctcgtccggaaaacgggccagcagggtatggaagtacttccacgacgccctgcccacttccttcttcaccttgtcatcgcccatcaatggcataatggtttgcttctcgatctctttcaaccgagcgtcgttcttctcagcagccgccccttgcacttcatctataccagacttcgccttgattaggcccggcgtagcgatggatagttcattagacgagaaaaacatccacaggcctatgattcctaatgctgcaactattctgatggcatggcttcttttgactatctgtttcatcccttcgttccttgcacaatctgtccagactttcctctttacaaatcaccagccttcccgtcttcttgtcttcatcacccacgtttattgtttaatgataaagccttttgtcctttatttttggttccttttcccgcttcgtttacccggtggttaacctttctcttccatcttgtaatatataataacaaaatgcatcaccatacttacgcaccccatatacatgacctaagggcagctttagacacaacagctccccagaaaaaatgtccaaaagaaacactccaccgctcagatcatcagggataaacactattcaaataaatgctgctagagaaatgcacgctcaaacggtgcgcgctcgaagaatgcccatgccaactagcggcatcactacaccctctgtgcaaccaactgcagccccagcaacaccacctcgacatatttgcaataacccaaacaatccgcagtgtctccactgtgggtctgttatcattccatctccaagggccacgttacccttggaggacaacccctccatctccatcaacgactggaccatctcctccagaaagaagcccattttgaactcgcaggaattagacatctgggaaaacgaaaaactcaaaggtttgactttgccagagatgatttttggtaacaactacatcaggatcgaaaattcaaaacagcattggtccatagagttcaatgccctggatgctttaaaggaggttcaactccaggattcaggtattcgtgttgcgtactcaaacgactggataaattctaaaaaaagacaaaattcaactaatggtgcgcaacggttcactaacgatgtgaacgacgattccttaaatatcatacacaagtacgactggacctacactacgcggtataagggcacagagagctcacctgagtcgaaattccgactggataacgatcaaaagctgccccttgacaaactggccgtacacgataaaatcctattctatgacgacatgattcttttcgaagacgaattggcagacaatggcatatcaatccttaacgtcaaaataagagttatgaacgaaaggttactgctgctgagccggttctttttaagggtggacgatgttctggtgagggtctacgacaccaggatttacgtggagtttgacgaaaacgtagtgatcagagaatccaaggaatttgaaggtaaatatcaggatgtacttgctaagcaccggctatcccaatctcacgacccaaaagctgccttgagagatagtaattgggtagcacagaacacgccgatgatcaaaagacaatgtgaaataattcagttctaacaatcaaatatacaaaacaatacgtacaaatacatacacgtcacatatacataagctccggatacatcatacaagaaatgatcttaaaatcatgctcttacccgttctgtaaatagtgaaaaattttcatcgcgaagtatgaacgaaaaaaaaaaaagaaaatagatgaacttttagcatttaattagtggcaaacgcctacccctccttcccactttgctgacttacaaagacaccactacattaaagagtatctcgtgtgttcttcttttttttccaaaaaaaaaaactcctattatttgcataaacacacgttcactggtacaagatgtctattaatatttgtagagataatcatgatccattttaccgttacaaaatgcctcccatccaagccaaggtggaaggtagaggtaacggtatcaagactgccgttttgaacgtcgctgacatctctcacgcgctaaatagacctgctccatatattgtcaagtattttggtttcgaattaggtgctcaaacttccatctctgttgacaaagatcgttatttagttaatggtgttcacgaacctgccaaattgcaagacgtattggatggctttattaacaagtttgttctctgtggaagctgtaaaaatccagaaacggagatcatcattaccaaagataatgatttggttcgagactgtaaagcctgtggtaagagaactccaatggacttgagacataaactatcatccttcattttgaaaaacccacctgactccgtttctggttccaagaagaagaagaaagcagctaccgcttcggccaatgttcgtggtggtgggttgtccattagtgatattgctcaaggtaagtctcagaatgcaccttcagatggcaccggctcatccactccacaacatcatgacgaagacgaagatgaattatctcgtcaaatcaaggcggctgcctctaccttagaagatatcgaggtcaaagatgacgaatgggcggttgatatgtctgaagaagccattagagctcgtgccaaggaactagaagtgaactctgagctcactcaactggatgaatatggtgaatggattttggagcaggctggtgaagataaggagaacttaccatcagatgtggagctttataagaaggctgcagaactagacgtcttgaatgatccaaaaattggttgtgtcttggcgcaatgtctattcgatgaggatatcgtaaacgaaatcgctgaacataatgcatttttcactaaaattttagtcactccagaatacgaaaagaactttatgggtggtattgaaagatttttaggtttagaacataaggatctaatcccactattaccaaaaattttggtacaactatacaataatgatatcatctcggaagaagaaatcatgagatttggtaccaaatcatccaagaaatttgtacctaaggaggtatccaaaaaggttcgtagggctgctaagccattcattacgtggttagaaaccgctgaaagtgacgatgatgaagaagacgacgaatagcttaggagggggcaaaagacttatgtgtaaattattatatgacatggcgtaagataaggattatgttctgttgtttttgagctcgttgatgtatagatatgtaaatatttataaatataatatttcttccaagtgcgacatacttggtactggcaaaaaacaaagatgagacttttaaagccactgattgattgattaattattaagtaaaaaaaaaaaaataaaatgtcggtgtaatttggctccacgatcgcatgcgtatacataacatgagattaccgaagatttttctgaaaggtaatgcattatattataatcattaatagaagtagagcctaaagcctgttgaaaacttgtacaatagaggaaaaaaaaagggtcattaatcgtcatgtttacctaagagcgtctaaactttttggtattcttctggggtaaacgtaaaaacattgcaccaagggcaaaattgaaaaaaaaaaaagtttaatagaacagaatgattaaaatcattagctaatatccgtatgacctgtagcggtacaaacttgtatcattattattattattattactattattactattattattattattattattattattattattattattattgttattgttattattattgttatcattatcattattgttgtagttattggtattattattgttattatgactcactgagcggcttagaggattcatttgactcgaataaccagaattattataattgttattattattacttacatttggtaagttaactataggtagggataaatttgttccattagcaattctaaatgaatcaaattgtgaattcaattcatctaatccgttagaattaccgttctgattttgattttgatttccggagtacaccacttgttgattgttgaagtaggaatttatttcactcatcggggctgggttaaagttcaatgctggcgttggacctgcattgttcatttgtataacgctattatgccttgaatttgaacttctcacactggaaacagaaacgcctctggcgcgaccaggagaatgaaacccctgaggatgctgtttacgatgattcttggaggattgtttgggtgatattcctgctgatgatagcccaacttcctccagtaactggcgactttgtaaattgatattggaatttaaaatcagttgacgaatctttgttatagcttcatctctaacgctattgtcaagaattctcgaggttaaaaccttataaataaatgttggaccataattaccctcatctagtatctggaacaagatagaatcactagaaattggaccatcaaatattgcatggataattttattcttcgacagtgcctcttcttcaccacctcttaaattgagaatctttaagacagtaagagagcctaatttatgacaacatagtttaaccagatttttatttaccagtttatcacataaaatcaagttcttgttaggtaaagtgcaagtatccaatagccaagtgatcagtaaagtgccattcgtatccgtagctagataaggagaaagcacaattatcagtgaagtgatagtcagcaattggcattgggtaataatggaatctgcttctagacaagcccttacagcacgagatccatacctgttttgaactattgtccaaaaatgagataaaacgctttcaaaaatgaaactattccagggaaaaccaaactttaaaataccttgaataacataatttccaaactggtcgttgaagagtggagtacagtaatcgcttacacctgaagttacaagatttatctgccttggcgtgtttgccattttgatgatcttctgacaaacccaagtaccgtttttgtgaacacccatagatgtgagatatttattacacttcctcaacataatatccctgatgatatttgacgagttttcaaacaatttttgaataacggtattacccaaatagtctgaacttaattctggtaattggtccagcatgacgattgccaattgctccatttcaatagtagataatgagttcgagtcaaactgctttctcagttcccgcaattttggtgcatcgaacgtatcctttctctttggaactttggagttgtgctcaggcaggggaccaaaataatttgtatcagacactcctttatttttcaaggcattctgcaagagatgattcaactctagatgatcatattctaacttaaaagaacttatagtgtgtaatatatcctttttactatccgataatgatggtggaggcaacgggaaagggtaaggttcattttcgtttgaagataattgcagatggctcaaattctgagtgggattacaatatgtaagatttggttgattaaatgaagttggttgttgttgtagctccggctgttgtagcgattgttgcagctgataattgagcaccccgtgattcaactgttcttgcaacagcggttgcttgggagtgttgttgaagccattaacgttaagaggttgttcatacatgggtaagactcgcgcaaaagataccgtacttggtgcccctactttagacagttccttaccttgtagagcttccaaagcacatattgcactttcaactgtggaaaactctactaatgccatattcaggcctcttagtgtcctcgcagaaagcactttaccatactgtgaacataaagtcgctaaggaagtactcgtcaaatttacagcgttctgttgatgttgttgagtaggctgtaatggaaacacgtttgaaatagatattgtgttagtgggcaaaagcgccgatatttgattgactagtggtactttttggtttgctgtaatccaatttatcgaggctggatcgacgtcatcaaggataacaggggatattgaagtactttttggaactctaggaggcacttgaacctggtaattctgtgcaggctgttgatagtagggcgcgtcagtataaaccctgtttgtggtagattgagattgagagcgctgcctgttaactatcggagtattaaggtggtcagtgttactatttcctgcactcgaccatatgtttggattcccatttttctccagaaaactgtttagttgagctgtttgaggcagcgtataattatcagtggacttgaatctagtcaatggctcaaaataagaagtggcgagaggataatcaaacaaaggactggaagaagtattactttctgcattagcactccaaatatttgcactcgtggcattgcccacatcagtagtcaaagaagaacttgcagtgatctgagaagatactgtgttatttcttgttcttgttctggtcgtagtagactgtaatgacagcggagtagccaccgtaaaagaatcgctagacactctgggagcgtatgtcgtggaatttaaactgtctggagtactgctcgtaggaggcacaacaactacaggggtactcttctttgaatggtgtagcttagcgctaatcgaagggagtagattggttagagtatctgaaaacctgcccgcacgagtacgataggagccaattttctgtggggaagtggagctagaacgacctctcttgtcagagactctcacagaacgagcatttgtattcatgcgtgtatcatttctaatatcctcttcataaattggaattgtaattccaggatctataacctcaggaatgttggataggttaccgttatacagtcttttgttgtccatcagaattcagaaaacagtagcaagggacagcgatagtagatatatctctctaacaatgaatatacacttaagctagtaacaaataattgaatggttagtatagaggaaagtaagttatgccgttgctctgtgccattcagcagtatatgcaccatcgcttgctctttcgaggggtggtttcatactatttcacaatttttttacttagttcttttttggaacaacagccgggttaccaaaagatctcaaacgaaactaagactgttcaaattttcaaagaatccgtacatttagaaattttttttttttccgcaagaaatatccttgctttttttcacttttgttaactttttctaacgcaacgcacgaggcggctcactcagtgttatgtgagatattgggctatatgggatgttagagttaggtatcatatatagtatttggcacgcctttttttagttcagacagtagtagcaaacaacaggaagacaactgagacaaaaatgtatgatatattacgcacacgatttaccgtttgcttggaggagtagtgtttcgtgatgaaatagactgatatagacagaattccacagacttttacgatataaagggaaaaacatgaagttgaacaccatatctcaaatgaataggatcactgtaattcgatagggtacaattatgtgaaatgtctgctttatgggaactttcattcatatacctgaaggtggcaaactagtcttacgaaactgttcagtgcagagatagaattttgtggagatgcatatagggaaacaaagtggaatttatgcttgtataatcaccaattcgaaacactaaacctcgacctatttagaatttccttcaagatttactaacatattttgatattttttcttttttgaatacagggctaaaagaactaagaaggttggtatcactggtaagtacggtgtccgttatggttcctctttgagaagacaagtcaagaagttggaaatccaacaacacgctagatacgattgttctttctgtggtaagaagaccgtcaagagaggtgctgctggtatttggacttgttcctgttgtaagaagaccgtcgctggtggtgcttacactgtctccactgctgctgccgccaccgttagatctaccatcagaagattgagagaaatggttgaagcttgattttattttaattatatgtataaaaatcataaaacaactatataattaattataactcaaaaacttttccagtaaatgtctgttttttgggcaggaacaatggccaatagctcacgtactgttcgtgggggccttaagcctggtatctaggctctgatttccagaagaaagtgacatcgatgaatgcactcaagagattttatgtgttgtgaatatgtatatatttatttagaaaaaaaaaaaaaaaaaaaaaccaaaatcatataccttaggcatcccgtttccctcttcatcatttttgtccctttatatcaatttttttagacttcatataattttgtatcaactgtaccctacatcccttggtattcaaaatcttgatattactacttttgccattactgtcagtgatttgtttgtttaatatgaactccgtcaagttttgctcattcaagaaatttgttgtctcttctatactgttgaaattaaactcacttttaacaaaatctaaattgacctggttataactcttacaaattatggtcaaaaatatcaacttttctagatttaagaatgaattaattagacatttttcaaatttgtgcagttttaggtagtttttcatgaagtagtgataattgccgactagtttcatatcgctcaactcaaatatcattttgacatgttcgtcctccaagatttccgaagagccatcgtctattaacttaagttttaaatgagaaatcgacggatagtcttcggttaacatcgaatacaaaacagaatagcatataaattcggaataagatttttttggtattgtagggttttcgaataacgccataatcctattttgacattgattaaattccccaagatctccgttctccaaggcaatacgtgcatgcgtttggtacactttaatagtgaaagagttctcgatcatttgcactcttaggtcttgtctcattgatttaaactggtcgcaaaggtaagtataagtggctgttttagattggtatttgtccattaacaagcaatacattttttgtagaatatttgggggtctgatcaagtcaggattaggctctgaagttagtctcagataagatttctctagagtttggcaacgccctaccacatgaatctttttgtcatattgatgagatttgctactaatggcatttaggttggcaaagtcttcattcaaattatcgttactattcgtcgtcgctgatggtccctgactgaatctttctgcccttctctttcttctctctaattcatcactgccacccatttcaactttccatcccgatgccgaacctacagcaccatgccctactatattactgttgctcattacattgccggataccccgttagaaagggctgatgccttcttagatactcttggtaatttctttttaatgtttttgttcatacgtttttgtaatcccggaagcggtgttaccatcaaagggttagaaacctggttgacgttgttccaagataaacgtggttctggcaaaggcagagaaggttgttgattggcaatgaaattattattattgtatgtcagagaagggaaagatccggcgtaatctaggggcctattcaggctttggccgaatggtcctccttgagatgaagcttccctgtcctccgtggtattgttagtaaagtgaccgtaaggattctgcataatgttattggaaactcaactactcgctgccgaacggttcctactccttgtattctatggtttctttacgagacagccaaatctctattttttgtcatgttcagtccttttttactcaaaaattccaaaccgtgaaggatgatgcatgttgacaataaatgatagccgtcatcacatacagtgtgcaatatctagatacttctaaccatttcttcctgtcgtggggagttcataccattttgacagatgacaaacagtagtgaaaaacaatgggaaagaatccagcaattagaaaaggagcacgtggaggtatatagagagttgttgatcacgttggacaggttgtacttgattagaaaacacaatcatgcggtaatattaagccatactcaacagcgcctcttggaaattagacaccaacttcaaattaatcttgaaaagactgctcttcttattagactgttggagaaaccggacaataccaatgtattattcaccaagctacaaaacctcttagaagaaagcaattctctggactatgagctcttgcaatcgttaggtgctcaatcttcattgcacaaacagttgattgaatcaagagcagaacgcgacgaattgatgtcaaaactgattgagttatcgtcgaagtttcccaaaccaactataccgccagacgacagtgatactgctggaaaacaggttgaggtagaaaaggaaaatgaaacgatacaagaattgatgattgctttacagatacactccggatatacaaacatatcctacacaatttgatttttatcttctaatgctatttatatattcaaataattttaatactgacaacgctaataataatagttacttaattaaggtttgaatcttcgagaaaaaaaaaaggtaggaaaattaaggaactactcacaaattcagagagagagaagggataaaaaaatatctgccaatggaggtaacttcaatgtttctcaatagaatgatgaagaccaggactggtctttatcgcttatattcaacccttaaagttccacatgtagaaatcaatggcataaaatacaagaccgacccacagactaccaatgttacagattcaataataaagcttaccgacagatcattacatttgaaagaatcacatccagtaggcattcttcgcgatctaattgaaaagaaattaaactcagtcgacaacacatttaagatctttaataatttcaagcccgtggtaaccacaatggaaaacttcgattctttagggtttcctaaggatcatcctggaagatcaaaatctgacacatattatataaatgagacgcacctactgagaacacatacttcagcccacgaattagagtgctttcaaaaaataagaaacgattcagataatattaaaagtggatttttaatatctgcagatgtgtacagaagagatgaaattgacaaaactcactatccggtattccaccaaatggaaggagccacaatttggaaacgaacgaaggctgatgtgggcgtaaaggagccaatgtatatcgagaaaatccgtgaagatatcagacaggtagagaaccttttaaataaagaaaatgtaaagattacggttgacgatgatactatacctttgaaagaaaataatcctaaacaagagtatatgtccgatctggaggttgatttgtgctctcaacatttgaagaggtccattgaactgatagtttctgaagtttttaacaaaaaaatatctagcatgatcaagaacaaagcgaataatacacccaaagagctaaaagtccgttggattaacgcttacttcccctggaccgcgccctcatgggaaatagaggtttggtggcagggcgaatggctcgaactctgcggatgcggattgattcgtcaagatgtgctactaagagccggatataaaccttctgaaacaattgggtgggcttttggcttgggtttggaccgcattgctatgcttctttttgaaattccagatattagactgctttggagtcgtgatgaaagattttcaagacaattctccaagggattaattacttccttcaaaccttattcaaaacacccgggatcatttagggatgttgcgttttggttaccagaagataaaccagatattcatcaagttcatgaaaatgatttgatggaaattatcagaaatatagctggcgatttggtagagagtgtcaagctagtcgatagctttacgcatccgaaaactgggagaaaatctatgtgctacaggatcaactatcaatcaatggacagaaatttgacaaacgccgaagttaacactttgcaagacatggtgtgttctaaattggtaaaagaatacagcgtagaactcagatagggatacggactcaaactagttgcaggtgttttaccgcagctgtatatatcttgtaaatactttgtcaggttctttgtatcacttcaatctatgttcatctatctatctgtttttcttaattactaagcatttgcggcaatgcgatgactacataaaaaaaaaaaattcgaaaaatttcatgagccttattaacatgaagattctagtcaacagtaggccatctgtgtttccattaatcgctgcatgtcatcgagcaagaaaatcgtcatcctctatggatcggagacaggtaacgcgcatgattttgctacaatcttatcccatcgactacatcgctggcatttctcccatacattttgctccattggtgattatgacccacaggatatcttgaaatgcaggtacctttttattatatgctccacaacaggccaaggtgaattaccaaggaatgtcaatgcattaaaaggtgaaagacccgtcacgttctggtcgtttttaaagagaaagaatcttccgtcgaatttgctcaaccatattcaaactgccatgcttggacttggtgattcatcttatcctaagtttaactacggcattagaaagctacatcagcgcattgtcacacaattgggtgctaatgaattattcgatagattggaggctgacgaccaggctatggctggtagcaataagggtacaggtctcggaattgaatcagtatattttgaatatgaaaagaaagtcctaagctttcttttaagtaagtaccccaacagaaaggtcaatggccaaataattaagagggaagaattggaccctgaggtttacctagagccagcatcctacctacagctttcagacgaacatgccaatgaaaagttcactagcaccaaggttatattcgaaggtgatgaatcgttaaaggttggcagagttaatataaacaaaaggattacatctgaaggtcatttccaagacgtgaggcagttcaagtttagtaatgtggacaagattcaagaaaactatgaacccggtgatacagtaaccatatatccttgcaatacagatgaggatgtttcaagattcctagcaaatcaaagccattggttagaaattgcggacaaaccattgaatttcaccagtggagttcctaatgatcttaaggatggtggattagttcgcccgatgactttaaggaacttgttgaaatatcactgtgatttcatgagcattcctagaacaagttttttcttgaagatttggacctttgcaactgatgtaactaagatggaacgtggccaagaacaactgaatgatcaaagagaaaaattgcgccaatttgctactgatcaagatatgcaggacttatatgactactgtaatagacccagaaggtcaattcttgaagtactggaagattttatctccgtaaagttgccctggaaatatgtgctagattacttgcccatcattaaaccaaggtactactctatatctagcggccctggggatcctaatattgaattaacagttgcgatagtaaaatataaaactatcttaaggaaaattcgaagaggaatttgcactaactacattgcacgattgcaagagggggaacagataaggtataagttacaaaataatcacataatcaaaaaggaatttttgaataaacctatgattcttgtcggaccgggtgtcggtctagcaccattattatcagtggttaaagcggagatatctaaagatatcaaactcctcttcggttgtagatataaagataaagattatatttataaagatatgctggaagattggttccgtaagggcaaaattgccttacattcatccttttccagagatgaggaaaattcaccaggtgttaaatatgtccaagactacttatggagattaggtgaggaaataactaatttggtagttaataaagacgccgtttttttcttatgtggctcatcaggtaaaatgcctatccaagtcagattaacattcattgaaatgttaaaaaaatggggcaattttagtgatgaagaaactgccaaaaaatacctgaaagaaatggaaaaatctgatagatatatccaggaaacttggtagtcgataacaagacttatcgcattataatgttaaatagatacataattaaaatcttgtcatttgtgacaaacgtttagcactgttcaaactccctggtatgaaaccacaaccgcagtgacctgaaaccaaactgagccctttggtagtctaaatggattattagaggggctatctgctacgaaatgttccaaagtgacaattctgcctacaaaccattctttccccttcgtcaatcctttttcgtcctttaaaaaatatcttgtgctttcttcaaaagctgtaaatgcagcccaaggcctcatcagtttattcttgtccctgccagatatactggcttgattgattacattactatgtatcaccgagggagacgattgtatagacatagcatccaaaggcggtggagttgataaatcaacagatgaaaatgatgagctcaatgatgaggtggaagacgacatagacccgacagaattaacgttttctcgtgttggcaaaaataatgctaaatcgccaatttgaaagttcctcaaagtcaccttttccctttggaatctctccaatagcgttctcttgatcttattttctttagttaattttttggccaaggtctcaatatccttgaatctcctgataacggcaacttcataaagcttattgtcatataattgagtgatattccccagaaaaatgctttgctgtgtatccttttcagatccattggcaactgactttattaattcatactcatctttcaatttctggaaaaccggactttttattagagaattatcatgtgcgtccagcatttgtgtgctttcatccagtatattactttgggcggttccctttttcaatcccttgactcgtctaatttggatgttattattattgtcgaaggttaacagcaacccaatgttctccaaaatgaaaatatttgtcgatattatatcaaatattctatcttgcagagtctgtgtgtatgcagatatctggttttccctacctgggtcctcagcaagaggaatggtttcgaatttctcacctttttccatcgagcttgagttagtctcagcgtaacttttctctgaagtcacaatttgtttaccgagcctttcaatatcagccttcaacaaattgacctcttgttcatgcttcttattagattcatccagatccatttgcaatcgttccctcgatttgctaacatcatcatagtcacctgttagcttttctatcttttcattgtcttggctaattatatcattcaattgctttttgaaagaggcattgagggtaaaaatttcagttctatgcgattgttcttcattagttaaccttgccaattcttgattcaaattagtcaaagtttcgcgataagctgtcttctccacctctagatcacttatttttttccccatttccgaaatttgcattgattttcgattattttcttctttcaatagttgaagttggtgtaatagatcatccacattactctctaactcttgaatttgatgattattagcttgcgaaacactatcaatgttcacttcagaaatattggcaggctctagtaatacagatgctcccaggaatttcttcttgtttatactcgtagcagaaccacgaaatggcttaagatgggtattgagaacaccttgaggccaatggcctatgtcggaatattgaaactcatgtaatagcgattctaatttttttattcttgttttgtatcctttgactacatcatcacttttcaaggcaatagacccttcaggggaaatgctattgccattagaactattattgttattatttttgaaattggaatatattatatgaaatctcttcgtctcaaaaagtgttttcgaaagtagatcaatgatcggttcagaaacatctgtttctttaatttgcgtcatataattatcaatggcttgcgatacttttaccaggtcttggcggtaatttgctatagaattctcattttcatcttcctcatcttcatttggtggagaagtatgagagtgatattcgtttagacgtttgaaatcagaggaagacaatagatcttcgcaaaaaacagtcgcgatggaaccgaaatttttaacccatttatttcttgttcgtaattcattttgtttgaacaactctaaatcttgattaaaatttgagataaatgacaaaatttgttggaaccatgatagcctacgatatttttcgattaaataaagcccatatatcagaggcaaatcttctacctgtgcaaattctacctcatatttcttgtatagctctaaatctttattacattcattcaataatagtcttttaatacctaggatttccatctgggtgaatgctatgttacccaaaatggctactgcatgcttttgtagacttttttttaaatctattagttctcctatttgtgaatacagcgcttgtgatatagtgaagagagttttcactgattcttttttatccttttccaacatcacattcatgcttttcaaaaattcttgactattgaattcttcttcttctttatcaagtacatttctgcttcttgttcgcatttctgataccagtacctcaaagctctctgccatttggtcttcaagctcgaatttagattcattcggggtaaacatttgccgcagtcgatcgatgtttactgttataatatctctaaaacttgcattttcgtcaatttccctcttaattttattcagcttaccattgattgaatgatttagaatctttacagatttttcgttctccaggagagattcaatattaatgaacttttgtaaagaatcaccctctaaagcagtcaacttactcaaggtgtcattgaagcatttttcccattttgaagtcataccattgtctaccagctgatttaaaaattgaacgtttgagttatacaaactttctacatcaaagcagtacagcttcaaatattgtgagcaaacggttaagccatcaaaaatacgcttaatatgggctattatgtctggtatgaggctcttaaaataatgtacatctatttctaaagcgcttagccaaccaaggttcgtcgtcagtaagctagttacggaatggtaatttaaacgcgaaagatctacgtctgcgtcctccaaaggcgagggcataggcttgatcataatagtatcgctaccttggtattgagatatatgactattcttaattaaatattccagagtctctgtcaagtcgttggaattaggggagttcatgggattagaatccttagacgttaaaagatttgttggtgtcggtttactaacaagtgagaatagtcgtctgtcgtaaacgtaaaaatcatttagagtaaaagacctattaataagcagctctttaaacatcgacggttttagtttgttaccataaggtagtagaatcagcagctgatcgggaggaatcttccatttcctagcaatgaactgtttaaatttgtccagggaaacgaaaaaatcaacattcgtagttatacattctccagatattgcatttatgatagtggctgttgtctgcagtggtgttatttcttgctgggtaggtgcagtgctatattcatcagcgtctgccatgatgtataaaagaaaataaaagaagtactttccgaacaacaacagtacactaaaataatcgttgttcaaaggaggactactttggttctgatttgagaaaatggtactcaaataagggcatcgctattatatagttccattcctaccaagaaaccgggtagccaaaagcgataaaaaggctctccatggcaagccttattaaaaataataatcatgaagaacaaagtttcacaagagattacaagataaaaaagccactactacagaaaaggcgttgggtcaggacatggaaatagtgtacaagccattggacatacgtaacgaagagcagtttgctagtattaaaaaactaatagatgcggatctatcagagccgtactcgatatacgtatataggtatttcttgaaccaatggcccgagttaacgtacattgccgttgacaacaagagtggaacgcctaacatacccattggttgcatagtgtgtaagatggacccgcatagaaacgtgagactgagaggatatataggaatgctagccgtagagtccacataccgcgggcatggcatagcaaagaaactagtggaaattgccatagataaaatgcaaagggaacattgcgatgagatcatgttagaaacagaggtggaaaattcggcggctctaaacttatatgaaggaatgggtttcatcagaatgaaacggatgttccgctactacttgaatgaaggggacgcctttaaactgatattgccgttgactgaaaagagctgcactcggtctacgttcctaatgcatggccggctggccacataaaaggaaaaacactcgatgatgataaaatatatattaataatacaatttttttatttatttatttaatcatatgtatagatatagaaaaagggcagtagagaaaagaggaatagaaaggagagagataataaagcaagtttcaaaaagaacaagaggaaaagaaattaaatcacacagacaaaaacgcggggaggaagtatccctaagccaaagtggcgttatataactccttttcggattcatatctcttcttatcggcctgggccttggcctcgtaaggctgcttttcctctggcgttagagccttccacttctcacccaacttcttgccgacttgtccaaatgtgatatctggattttcagaacgaacaatatctctgttttcgttagcgaaaaacatgtaggcggacaaagccctcttaggggcatttgggtccttcttctttctagtggttctcttcttaggttctcttggggtgaccattgcgactgtgctttactatgtatagggtagtcaattgagcaaaaacaggaaaaaaacacgtcccaaaacagtccttctttaacagtcggtaccagtaataaatactgtgttgtttgtttgcccaccgctaaataaacgaacggcgaaaaaaataggcggcaaaaggcgggtgattcgaaaagtatcgcgcgcgacgaggcgtgagggtagaattcggcgccactaatttgtgacacttgaacagtatttaacgtcgtgcgatacatcatatcgatagaaatgtagacgtgctcaacgctccaagaatgaattgcacacttacagataataccagagccataaatgtggcctccaacctcggtgctcctcaacagaggacgatttttgccaaggagagaatatccatcccaggatactacgagataatccaattcctgggcaagggagcctatgggacagtgtgctcagtgaagtttaagggtcgaagcccagctgctaggatagcggtaaagaagatcagcaacatctttaataaggagatccttttgaaaagggccatccgtgagctaaaattcatgaacttcttcaagggccataaaaatattgtaaatctaatcgatctagagatagtgaccagctcgccctatgacggactgtattgctaccaggaactgattgattatgatttggcaaaagtcatacattcgtccgtgcagctctcggagtttcatatcaaatactttctttaccaaatcctgtgtgggctaaagtacatacacagtgcagatgtcatccaccgagatttgaagcctgggaacatattgtgcacattgaatggctgtttgaagatctgcgattttggtctcgctaggggtattcatgccggatttttcaagtgtcattccactgtgcagccccatataaccaactacgttgctacaagatggtatagggcgcctgagctgcttctttccaaccaaccgtatagtaagtccgtagacatatgggctgtagggtgcattcttgcagaattctatgctcgaaagcctgttttcatggggcgtgactccatgcaccagatatttgaaatcatcaaagtcttgggtactcctgataaagatattctgatcaagtttggcaccattaaagcttggaatctaggcaaaaacagtaataaccctgtatataaaaaaatcccatggtccaacattttcccctttgcctcgcatgaagcaatcaatctcatagagtcattacttcattgggactcaacacataggttaaacgtggaacaagctatatcacatccgttcctaaacgaggtgcggaagccagacgacgagcctgtttgccttcagggtcctttcgacttcacctatgaatccgagttgaattcaatgtccaaattaagagactacttggttgaagaagtgaaaaatttcaaaaccgatttgtcctcctcgtctttatagtaaccactacacaaataggtatatcatgaagttatattctgaccgtaacaattcttctttctttgacgtaaactttatggcgggtaacgctcaaatagtttcttgttaaccatttcaaataacaataagtatacaactaaacaaagtctgctacttgttaaatataggagtataaacaagataagcttgctactttttcagcacaaccgccacctctcgattgcatacaatggattacctaaaaccagcgcagaaggggagaagacgtggtctttccataaacagtctttcggagactcagcaatctgctatgaatagttccctggaccatcttcagaatgacttaaacaggataaatcttcaatggaatagaatactgtcggataacactaatcccttagaactagcgctcgcatttttggatgatacatctgtaggtctgggccaccggtatgaagaattcaatcaattaaagtcacaaattggtagtcacttacaagatgttgttaatgaacatagccaagtgttcaacactaatgtggcttcttacggaaaagcagtcagttcgatcatgcaggcccaagaacagactttaaatctgaaaaattgtttaaaggaagctaatgagaaaatcaccactgataaaggttctttacaggaattaaatgataataacttgaagtatacaaaaatgattgatgttttagtcaatattgaggagttattacagatacccgaaaaaattgaggagaacattagaaaggaaaatttccatcaggtgcaaattctcctagaaaggggtttcatattaatgaacaacaaatctttgaagacagtggagattttaaagcctataaaccaacaacttgagttacaagaacatttacttttcaacaatctgattgaagaaattcacgacattatgtactccaaatctaacaaaacaaattttactcgagtaaccaataatgatatattcaaaatcataagcatttcacataatggatttacgagtttagaaaattacctgtacaacatagtcaatattgatattatggaacactcaaaaacgataaacaagaaccttgaacaattcattcatgaccaatcgttaaataaaggaaatatcatgctacaagaaaatgctgcgactcaagcaccattggcaccatctagaaaccaagaaaacgaaggatttaacagaatagggttcctactaaaaaccataaataacatcaataaattacctgttgcattcaatataataacagaaagggctaaagaggagattcataatataattgttaaaagtaccgaatcaatacgttcgaagcacccttctctgcttaaaatggctactagtttaaagaatgacaaccattttggcctacccgtacaggatatactatcgatcattttaagggaatgcttttgggaaatatttttgaaattactgtatgctattcagtgccatagggctatttttgaaatgtcaaacattttgcagccaacgtcttccgcaaagccagctttcaagttcaataaaatttggggcaaactgttagatgaaatagaattattacttgtgaggtacatcaatgaccctgaattgatatccagcaataacggtagtattaaaccaattaatggcgcgacaaataacgcacccactttacctaaaaggaaaaatcctaaaattttttctttggagtataacattgaggacaattcttctgtaaaggatcaagcttttgaactaaaggctttgttgaaagatatattccctggattttctgtctcctcaaacatggatttagactctatttatgtaaaagatgaatccttcgaacaagatgagcctctagtccctccttctgttttcaacatgaaggtaattttagatccgtttttgctgtttacgcaatcgacatctacaattgttcccagtgtcttaacacaaaatactatttcatccctaacctttttcgatgattatatgaataaaagttttctcccaaagattcagatgactatggattatttattcacggttgaagtagaatccaataatccgtacgccttagagctatccgatgaaaatcataacatttttaaaacagcattagattttcaaaggttattttacaatttattgaatgttttcaacacagcaaacacatttagagaaaaaatatcgtactgcattctagatcttttgaatcatttttataattactacttggggctatttaattccttgattggtacttctgatagacatttaactaggaaaataattacggcatggttgcagaatggtattttgatggatcaagaacaaaaaattctgaatggggatgagacactctttcatgaagaatccatagagttatttaaggaaatacctcatttctatcaagcgggtaaaggtttgagcaaatctgatttattcaataacttgacattggacacaattctgcagttttcggcaagcgtgttatggatattaaactggctgccaggcttaaaaaaggctatcaatattgatgaagtaagccaagaacccatgttagatgctgatagattaaggagcagctggacattttctgaatcaatggatttaaactattcgaaccctagttccagcccaaattcattaggaaatctaaaaattttattggatgataaagcctccaaaaaatttgatgagactatcgacggattcaaaaccttgaaattcaaactaatcactatactgaggttcaacattagggccttgtgtatatacgacatcgggtctttttttcaaaacaccaaaatttggaatatggatgtgggtagtattgaattagatcaaaatatagcttctctaatttccgaattaagaaggactgaaagcaaattgaaacaacagttaccagaaaaggaaaaaaactccatatttattggtcttgatatagtcaacaactacgccttgattaagggtgccaaatccataaaagttttgaaccataacgggataaagaaaatgttgagaaatgtaaatgtcttacaacatgcctatagaaatctttcttctgaaccatcaaaaattaatatgaacgtcacaatgaatttttactctttatgcggctccagtgaagctgaactatttgaatatataaaagacaatgaattaccgcattgttctgtcgaagatttgaaaaccatattgaggctgcagtttagcgaggaaatgcatcgtcaattgaagagacaaagcactagctcaactaagggttccataaaaccttccaataagaggtacactgaagctttggagaaactaagtaacctcgaaaaagagcagtcgaaagaaggagcccgcaccaagattggaaaacttaaaagcaaattgaatgctgtccatactgcaaacgaaaaatgacatttttagtttgtgtaaaattaatttgataaataaatgaatgaaaatgatcaataataagcgaataactatatttttaattaccttatttttacaatatttttcacttgcacttttattttattttcagcgcgcagctcgtcttgttctgttgaaattcaaagatacctgaaggaacattacaacatcaatcaacacttgagtagaaatatacacgatccaataaaatatactgaagcgaagcaatcagaaatggatgcaatatctgatccaacgtttaagcatgctagatcaagaaaacaggttactgaagaatcaccatctttgcttaccgttattatagaaattgcaccaaagttatggacaacttttgatgaggaaggaaatgagaaaggaagtataataaaggttttagaggcattgatagtatttctcaatgctcacttagcgttcaatagcgccaacaaagtagcagtcattgctgcatactctcagggaatcaaatatttatacccagagagcacatctgctctaaaagcctctgaatctgaaaataaaacccgtagtgatcttaagattattaactcagatatgtatagacgttttagaaacgttgatgagacgctagtggaagaaatatataaactatttgagttagaaaagaaacaaatcgaacaaaatagtcaaaggagcacgctagcaggtgccatgtcagctgggctgacttatgtaaacagaatatcaaaagagtcagtaactacctcattaaaatcaaggctacttgttcttacgtgcgggagtggcagtagtaaagatgaaattttccaatacatccctataatgaactgtattttttccgcaacaaaaatgaaatgtcccattgatgtcgtaaagattggtggttctaaggaaagcacgtttttacagcaaacgacggatgccacaaatggcgtttatttacatgttgaatctacagaagggctaattcaatatttagcaactgcaatgtttattgatccgtcgttaagacctataattgttaagccaaaccatggatctgtagattttaggacatcatgctatttaacagggagagttgttgccgttggattcatctgttcagtttgcctatgtgtcttatcaatcataccgcccggaaataaatgtcctgcttgtgattctcaatttgatgagcacgtaattgccaagttgaagaggaaaccagttgttccaaggttgaaagccaaaaagaaggtgacgaaaccatgaacgaaaggaatgaacattatccgtttcaagcaggtaaccttcgtcacaatgcatcgtaataatacataaaaaaaaattagctttaagcacatgtatattggacattccacagaaaaaaaaaagcttttgatgtgattagcttaagacgttgtgtcatctttgaactgttttgacttcaatcatatcgaatttgataatataactatctatgtactgtctgggtgcatcgctgttgttgcttcggtagatttattagttcgctttggataatgtatcatacaataacattgccaacatccatcataacagaaacattaggtgataaacaatgaaaagaggagaaagccaggcgcctgatgccatctttggtcaatctcgtgcatttgcactatctgattcttcagtgaatcctgatgtcattgaatatcttaaaagtgttaggcaagaagcactaagaaccaacgccatatcgattaagaatcatatgaatctgcaaaagaggacgcgtcacaaatcaagcatgtacgatgatgaggatgagggggcccttaaaaggcacgccatctcgccatccttgattaggcttcaaaggaatgtagaaatatgggtaaggtggtttaactctgtgaaggcgacggtgttgactaatgcctacgagtttaccggttatgaggacgaaacactggatcttttattgcttttcttaaagaattatctcgaagatatgcccagcaaatgtactacagttgaaaaaattataagtgtcctaaatcagcattcctttcctgagaaggcagaagagaaggaagaaaatcttcagattgatgaggaatgggcgaagaatattttggtacggctggaaaaaaccaagattgacagtgttgaggatgtaaaaaaagtaatcactgaaggagataaacatgaactagttggatacaaccagtggttccaataccttataaacaatgaaccgcagcatactacttttcatgaaaagattacctctaagcaactttgggttctgatcaagtatatgtcgaatacatggataaaagaaatacacaagaaaggaaggcattatcgtcggctgcaagattggctattctacatactggtacatacacccgaaagagtcacggcagaatatacaagcatcttgagagatcttggaaagaaatgccttgaactgattcaaaagaagccagttgaagcacatgagaataaaataacactcccgaaggagatggcggaattgaatgttgagataccagccgcggtggagaatatgacgataactgagctgacagtgtctgttatagcagtgaactatggtcaaaaagacttgatagaataatgtaaataaatttcttatgtagttttttacaggaagtaaaaagtgttattactttgattgactcattcttacatttactgataggccgaagataagcggcgccctaagaaaactcgagcgcaaattgtcagcgatgatgtagccatgctatagcatcaatcaatgtcaataagctaataacaactatcatctatactccaacgcagctctcttgtttaggtttctcgtcaatcaaattcgcatcacgaagaagtatgtctgaagaatttccatctcctcaactaatcgatgatttggaagaacatccacagcatgataatgctcgagtcgtgaaagatttgcttgcaggtacagcgggtggtattgcgcaagtgctagtgggccagccctttgatacgacaaaagttaggttacaaacatcgagcaccccaacaacagccatggaagtcgtcagaaagctgcttgccaatgaagggcctcgcgggttttacaaaggaactctgacgccattaattggtgttggtgcatgtgtttcattacaatttggtgttaatgaagctatgaagagattttttcatcatcgcaatgctgatatgtcatcgactttgtcattgccacagtattacgcatgtggtgtcacaggcggtatagtaaactcattcttggcgtccccaattgagcatgtcaggattcgcttgcaaacacagactggctcaggcaccaacgcagaattcaagggtcctttggaatgcatcaaaaaattaagacataacaaggccttgctacgtggtttaacacctacaatattgagagaaggtcatggatgtggcacatatttcttagtgtatgaagcgttgattgctaaccaaatgaacaaaagacgtggactagagagaaaggacattcctgcatggaaactttgtatttttggagcattgtctggcactgccttatggttgatggtatatccattagatgtcatcaagtctgtcatgcaaacggataatttacaaaagcctaaatttggtaattctatttccagtgtagccaagactttatatgccaatggagggataggcgcttttttcaaagggtttggtcctaccatgctaagagctgctcccgccaatggtgccacttttgctacttttgaattagcgatgaggttattgggttgataattcctatagaatttatgagccatcgtttaagaaaatagtacaatataatgtataacttgaaactctatcttcttatattcaatagatgctactatgcgtacatatatatggtgagtgtgtgtgtttatatatgcgtagtaatcactcggcaatgtggaattgttaccgtgatagccttcatgcttactcttccaaccttcttagcaagtattccacctcaacttccttagtgataggtataacaatttccttataaatttttaccaaatattctggagtaatccttctttcacctgactcgttggtagggtccacaccatagacttcagccttcttagttaatctttctagaatcttttcttcaacggcagaattggtgatattcttcattatcccctcgacatctttacttttgatcagctttgtgtatagcgggatatccgattggaacttggcttcagcaacaaacttgccaaagtggattctcctactcaagctttgcaaacattctatatctctagtggcaacagaaccgaagttattcttatcatcaccatctcttttcgaaattaatggtataatcttttcaatataaactttttttattttatcattgtaattaacttctggggcataaggcgccaaaatttgtgggtagttaatgctcggtaagaatgatttctgaatcttgtcaggaaagaagggagtttcatcaggtgattcgaatcttctgatgcgagaatgcgcaatttcaagatttgaaagagcccaatccaagaaagatcctttaaaattcggaatttctaaacctggatggtttgcctcataaactgaaggacatgtggcgaaatgcgacctctcaataaatttgaagatgatcgaatcctccattctaactaattcatctctaatattttgtagatttaaaacagtttctggttttgtgaaatccatatcttataccaattttatgcaggatgctgagtgctatttgttagcaaaacggaatcgatgtttcaacttttcaatactttttttcttcttttcttcgaacttcgaagattatagagatccattgaaaatttacgataaaggaaatgcaacacgaagtttgaaaaaaagttgatattgaaaaaaaaaaaaaaagagaaccaaaaaaaaattaaaaaacgtgaaaacgatggtttaacaacttttttcgaatttggtatacgtggaaaaacgaatgtatagatgcatttttaaagaatatatataaaatttagtaattgtattccgcgagcggcgcaataggtgatttcatttagctgctttcagtttgcgtatcatttcttcattgatcttggcttctctatctaaatcctctttcgacttgtaaagtccccaagttctaaaccataagaaccgcctcaatctggaaaatttgtcagtatcaagaccataattcgtgtatgactgaatcaaatgtaatccactttcgtcatgagtaaattcggccttgctcagagactcctggattttggctaacaacgcagtcccttcgatgcatatagctaggccacaaattatgccaataacggtccatgggttgatgttttcttgaattctttcgtttttcatgctatttgcgtcttcccaagtcccagcgttccagtattcatactgcgcgttagagtggtagccataagagccggcatattggtaattttcagtattaacgttagaacgtggtgaatacgatgtggtccagccttgcctcgttgtgtcatatacgatctttttctttgggtcacaaagaatatcatatgcttgagagatgactttaaatctatgtagtttttcgcttgatgttagcagcagcggtgatttactatcactgttggtaaccttttctgagctaaatatttgaatgttatcggaatggtcagggtggtacaattttacataacgatgatattttttttttaacgacttcttgtccagtttaggatttccagatccggcctttggaatgccaaaaatatcatagggagttggatctgccaactcaggccattgttcatcccttatcgtaagttttctattgccatttttatcgttcgctgtagcatacttagctataaaagtgatttgtgggggacacttttctacacatgataagtgccacttgaataaaaatgggtatacgaacttatggtgtagcataacaaatatattgcaagtagtgacctatggtgtgtagatatacgtacagttagttacgagcctaaagacacaacgtgtttgttaattatactgtcgctgtaatatcttctcttccattatcaccggtcattccttgcaggggcggtagtacccggagaccctgaacttttctttttttttttgcgaaattaaaaagttcattttcaattcgacaatgagatctacaagccattgttttatgttgatgagagccagcttaaagagttaaaaatttcatagctaatggtgacagggggaatggcaagcaagtgggatcagaagggtatggacattgcctatgaggaggcggccttaggttacaaagagggtggtgttcctattggcggatgtcttatcaataacaaagacggaagtgttctcggtcgtggtcacaacatgagatttcaaaagggatccgccacactacatggtgagatctccactttggaaaactgtgggagattagagggcaaagtgtacaaagataccactttgtatacgacgctgtctccatgcgacatgtgtacaggtgccatcatcatgtatggtattccacgctgtgttgtcggtgagaacgttaatttcaaaagtaagggcgagaaatatttacaaactagaggtcacgaggttgttgttgttgacgatgagaggtgtaaaaagatcatgaaacaatttatcgatgaaagacctcaggattggtttgaagatattggtgagtagagcacgcagcacgctgtatttacgtatttaattttatatatttgtgcatacactactagggaagacttgaaaaaaacctaggaaatgaaaaaacgacacaggaagtcccgtatttactattttttccttccttttgatggggcagggcggaaatagaggataggataagcctactgcttagctgtttccgtctctacttcggtagttgtctcaattgtcgtttcagtattacctttagagccgctagacgatggttgagctatttgttgagggaaaactaagttcatgtaacacacgcataacccgattaaactcatgaatagcttgattgcaggaggctggtccattggagatggtgccttattttccttataggcaacgatgatgtcttcgtcggtgttcaggtagtagtgtacactctgaatcagggagaaccaggcaatgaacttgttcctcaagaaaatagcggccataggcatggattggttaaccacaccagatatgcttggtgtggcagaatatagtccttttggtggcgcaattttcttgtacctgtggtagaaagggagcggttgaactgttagtatatattggcaatatcagcaaatttgaaagaaaattgtcggtgaaaaacatacgaaacacaaaggtcgggccttgcaacgttattcaaagtcattgtttagttgaggaggtagcagcggagtatatgtattccttttttttgcctatggatgttgtaccatgcccattctgctcaagcttttgttaaaattatttttcagtattttttcttccatgttgcgcgttacgagaacagaagcgacagataaccgcaatcatacaactagcgctactgcggggtgtaaaaagcacaagaactaagccaagatcacaacagttatcgataaaatagcagtgtttgcatggccattgagaaggacaacattggcgtgcgcgccaatgttgtctcaccatgtagctccaaacgagttgtaagagacggaccgctcacgcttccgaagcggtcagaaaacgcttcccagtatgcagttgacctacattcaacctgcaaatattgctttgcttcaagaaatgattacacagacgtctattttcttctacataatgcacgaaacttgggcatttagtcatgtagccgcctagcgagcctgggtgccgtcctatctcctttgttcgtgcaaagagacaggaacacacactgcgttctcttgcggccggtctggcggactcaggggtgcggcgtttgcttaaccggagggaataataaaatcggggtgacgcaagtatgaagtcatgtgtgcttagcaattacgtagagggattagaaataatagtgtgcggttatcggaaccggctcttgttcccgtttagagcaacccaggtgcaggcgtactttaaagtattttctttcttttttttcctgctacttacgctaggagctgccgcagctgcaaagccgacgtcggagaggcaggtgatcttcggctcggccgacaaatcccctggatatcattggcctgtcgaggtatcggccgcgtggaactaccgggaattactatgcaaaacaattggaaatctggtaggaaaaccttgttctagaacttggcgattgctgacaaagaagaaaagggcctattgttgctgcctcttttgttgttcttcctcgtattgtcttgccggtgttctttgtgtcttttgtgtgtaggttcttactattatagtgctctttgctattatattttcttcgttttcactttgcgtaatgtaacggtcttaaacaaagttttttttttttcgctcttgcattttccttttctgctctatcttatttgctaattgtagtttcagaagttttacttaaatatagcactattttccagttttaatgtttcttctcattgctttcttttataattttcgcatataattatacatttacggtgtcttaactctccctcttcacccctcattattccagaaaatactaatacttcttcacacaaaagaacgcagttagacaatcaacaatgaatcctaaatcctctacacctaagattccaagacccaagaacgcatttattctgttcagacagcactaccacaggatcttaatagacgaatggaccgctcaaggtgtggaaataccccataattcaaacatttctaaaattattggtacgaagtggaagggcttacaaccggaagataaggcacactgggaaaatctagcggagaaggagaaactagaacatgaaaggaagtatcctgaatacaaatacaagccggtaagaaagtctaagaagaagcaactacttttgaaggaaatcgagcaacagcagcagcaacaacagaaagaacagcagcagcagaaacagtcacaaccgcaattacaacagccctttaacaacaatatagttcttatgaaaagagcacattctctttcaccatcttcctcggtgtcaagctcgaacagctatcagttccaattgaacaatgatcttaagaggttgcctattccttctgttaatacttctaactatatggtctccagatctttaagtggactacctttgacgcatgataagacggcaagagacctaccacagctgtcatctcaactaaattctattccatattactcagctccacacgacccttcaacgagacatcattacctcaacgtcgctcaagctcaaccaagggctaactcgacccctcaattgccctttatttcatccattatcaacaacagcagtcaaacaccggtaactacaactaccacatccacaacaactgcgacatcttctcctgggaaattctcctcttctccgaactcctctgtactggagaacaacagattaaacagtatcaacaattcaaatcaatatttacctccccctctattaccttctctgcaagattttcaactggatcagtaccagcagctaaagcagatgggaccaacttatattgtcaaaccactgtctcacaccaggaacaatctattgtccacaactacccctacgcatcatcacattcctcatataccaaaccaaaacattcctctacatcaaattataaactcaagcaacactgaggtcaccgctaaaactagcctagtttctccgaaatgattttttttttccatttcttctttccgttatattatattatactatattccctttaactaaaaatttatgcatttggctcctgtttaataaaagtttaaatcgcctcaaaagaacaattgaaaaatatgtaaaataacagcaaataaaagtcaaaattaaaacaaagtacccagagacaaaaaagaaagaaaagaaaaaagaaacagtctacaaattctatttgaatatataaaattatattctcaattttcacgtatatattcacctcacaaataatatcattcctttaaaaaaaaatatgtattattgtataatgtttcagcatagtcgttttttaagcccttttttttaaacttaaaaaacaaatcaatgagatattgtatacctatattatcgataataaagcgacgaggatggactgcaagatattggtgttaggcgcaggtggtctaggatgcgaaatcctgaagaatttgacaatgttaagctttgttaaacaggttcatattgtagatatagacacaatcgagctaaccaaccttaatagacaatttcttttttgtgataaggacataggcaaaccgaaagctcaagtggcagcccagtatgtaaacacgcggttccctcaattggaagttgtggcgcacgtacaggacctgaccactttgcccccgagcttttacaaagacttccagttcataatctcggggctggacgccattgaacctcgtcgcttcatcaatgagactctcgtgaagcttaccttggagtccaattatgaaatttgcatcccgttcatagatggtggaacagaggggctcaagggacatgtaaaaacaatcattccaggcatcactgcatgctgggagtgctccattgataccttgccctcgcagcaggatactgtgccaatgtgtacaatcgccaacaatcctcgctgcattgagcatgttgtggagtatgtctcaactatacaataccctgatttaaatattgagtctacggcggatatggaatttctgctggagaagtgctgcgaaagggctgcccaatttagcatctcaacagaaaaattatcaacaagttttatcctgggtataataaagagtatcatacctagtgtaagcactacgaatgcgatggttgcagcgacatgctgtacgcagatggttaagatttataatgatttaatcgacctggaaaacggcaataatttcactttgattaactgctcagaagggtgttttatgtacagtttcaagttcgagcggttacccgactgtactgtttgttcaaattccaattccaactagtattactaatgaataataccatccgccggtgtcacttgtttaaacatcttgcaagtaagtcgagatcctagagagccttgtacatgtgattgcacagtaaagaaggtatgcaggctaaattattgtttaccagactaaactttagacgtccctccacaactttacgccagtttcccctaacatgttttttatttcatagcaaagcattttactcggatctggtcactaaggagccgttgatcacaccgaaaagaataataaataagacgcctgggttaaacttatctatttctgagagggcttccaacagactagctgagatctaccgcaatagtaaggaaaatttaagaattagtgtggaaagtggtggatgtcacggtttccagtacaatctaactctagaacccgctaccaagccagatattaagaatgatgtcaaagacaaggagttttcagacgaccttgacgatgatgattccaaggatataatatacgtgttacccgaagataagggtcgagtgataattgatagtaaatcactaaacattttgaataacactacactgacatacactaatgagttgatcggttcttcgttcaaaatcatcaatggtagcctaaaaagtagttgtggttgtggaagtagttttgatattgaaaattaagctgtattatattcatccctgtatatagcatgcccagctgccaagcatttttttacttaattgtctctattatatatttgaaaacctagcaagagcattacgggataaaacgctgcggcgttcgcattattaatttgtattcaaacgactaattaaaactatcttacagttcgtaaaacttcataagttcgaccatatctctatccttattgtcattccttaacattttcattcgagaacttccttccatctcatatatccaatactgatagttctcttcattatacatttcaacaagatcatgttcacgtataaattgttcagaatcatcaccatcacagacatcaaatggatcgatttggaacgaattattgtcaccacatcttaagttggaaaactgctttgtaacacaccaagtcaagtacgtataaaatctactcattagtaaatcgttgtacccaccccctccaagtaggaatatgtgcgctcgaggataacttttcatgatatttatgatgattcgagaaagccctcgtattgttagctgccattcattgaatctatcacccagaagcccatcaccaccacattcaattattaaggcctcaggttcgtgtctttctattagaggattgacgattttggatgcgatcaattccaagtagttgtcatcacaaccatgctttaaaggaatattaaccacgttcttatcctttcttgaatcacttaaagaaccagttccaggaaaaaaaccaggctcgtagagatgtactgaaattgtctgtatttgtttagaatattggaaagccttttctacaccgtcaccatgatgcaagtcgaagtcaacgtacgtgattttatttagctttgctttgcgcaatctctgtattaacagtaccacgtcatttatatagcagaatccgcttgccctctgtttaaaggcatgatgtcttccaccatcccaatttataccgataagacgttctgtaggcgatagatgatccaacaagtttaaagtcgcacctgtaataacttgacagtacataggaaggtatgaaaaaatcgggcaatctccctctaaattatactgttttgtttcagaatttaaaatataagtatctgttggtttatcattggtgggcacctcactgttattaatacagtccatattattttcgagcgcttgtgagtgattcagataataattatagagattctctctagtggtgaatctctgaagatcttgcgatggattgtagtcgattttttcgttccaattatcggccaattcactcaactcactccatttggactctaccatgggattatttacatcttgtgccatcattttattgaatctgccatttatcaaataatcgatatatgatttcgaatggaactccagcagatcatcctttctggcgtagggaaatgttagcacttcgtcaaagtgctggagaagatcgtacgcgtttattagggaatatgtcagctgcgatttttgatgattgttacatgggagtaaatctgctacttgagactgaaatattgacgttgatatgaccaatttcgacatagcgtttttctaaaatggacaggtgtttattaattcatattacagtacatacaccttttttttactttttgtttctttattaattttttagtttttttcatattctattttattataagtagtaatatgaagaaatttcccaagcaaagctcaataaaattatttagctaaacaaacatatgcatatatatgtatattctccctaatttaattccttggctgcccaggttggtagaacaaaggaagcttcgtgaattttcttgttatagtatctgtataattcagcctccttctcatcagagatttcacgtagtggcttcttgacattgcaagttttatctttggagcaaaccataaaaccaatcgtaccagttgggtaagttggaatagtaacgaaagagtattctgcaactgggaaaacttcagaacaggctttctttaagtccttaatgattggcaagtgaatccacatactttctgcttgtgtagtgattacacccttttctgtcaacgcactgttcaacaattggaaatattccttttggaaaagggtttcagctggaccttctgggtcagaagagtcagtaatgattacgtcaaatgtgttttggtaatctcttaaaaattggaaaccatcaccaatgtgggtcttaacctttgggtgagaataagaggcagccatttctggtaggtactcctttgatagtctaataacagcttcatcaatgtcacataaccaggcttcctcaacggaatcatgcttgacaacctctctcaaaacaccaccatcacccccaccaataacaagaaccttcttaggatttggatgggaattcaaggcaagatgggcaatcatttcttggtaggcaaattcatccctttcggtggcttgaattacattatctaaaactagaacattaccatatgtagtggatttgaagatcaaaacgtcttgatattttgacttctcatggtgtaaaactttctccacttttaaagtcatggcctggcctggccacatggtatcagaaatttctctgaaccagccgtctacaatagttgggtgagtgatttcttgtgccattagatttattgcttattagtgtttgctcttcttgactgaactactatgtgaagcgtacaagatactaaattactaagtcagttttatatcacagctattccttatctcatgccaatagcatttttagagaaaaaaatgaaaggtgaaaaaattttttttctcaagcaaagaaatgaggagttcctgaaatcatgcaggtgcagaatattggtgtagagaatcgcgtttgtatattgtcttaatcctgtacttacgagtaggtatttgatgttttaaaaattgcaaatgtactttttgcgaaatcttgcaacattttttttgtcaggatgtaattgcaactaattaatttttcaaaacttaaaatgaaggttacctattaaggaacgtttgtgtttgaaaaagaactcctaatcaaaagcaaagaaaacatagaacaaaagccaacaaaactcttttggagatggtagaaggagactcttatgtggagactttagactccatgattgaattattcaaggattacaaacctggttccataactttggagaatataacacgactttgtcaaactttgggtctcgagtccttcacagaagaattgagtaatgaactttcaagattatcgacggcatctaaaattatcgtgatagatgttgactacaataagaagcaagacagaattcaggacgttaaactcgtactagcatctaattttgataattttgactactttaaccaacgagatggagagcatgaaaaaagcaacattcttctaaattccttaacaaagtatcctgatttgaaagcttttcataacaatttgaagtttctatatctgttagatgcatattcccacatcgagtccgattctacctcccataataatgggtcttctgacaaaagcttagattcaagcaacgcatcatttaacaaccaaggtaaacttgatctttttaagtatttcacggaactatcacactatataagacaatgtttccaagacaattgttgcgactttaaagtcaggaccaatttgaatgataaatttggaatatatattttaacccagggcatcaatggtaaggaagtgcctttagccaaaatttatttagaagaaaacaaaagcgattcacaatacaggttctatgagtacatatattcacaagaaaccaaatcttggataaatgaatctgctgagaatttttctaacggcatttccttggttatggaaatagtagcaaacgctaaggaaagtaactatacagacttaatttggtttcctgaggatttcatatcaccggaacttattatagataaagttacatgttcatcaaactcatcttcttcgccacctataattgatttattttcgaacaataactacaatagtagaatacaactgatgaacgattttacaacaaaattaatcaatattaaaaaatttgacataagtaatgacaatctagatctaatctctgagatactaaaatgggttcaatggtcgaggatagtacttcaaaatgtttttaaactggtctccacacctagttcaaattcaaattcatcggaacttgaacctgactatcaagctccattctccacctcgactaaagacaaaaattcttcaacatctaacactgagccaattccaagaagtaacagacatggaagtgtagtagaggcctctagaagaaggcgttcttcaactaataaaagcaaacgtcccagtataactgaagcaatgatgcttaaagaagagggtttacagcaatttaatttgcacgaaattttatctgaacccgcaatagaggaggaaaatggagacagcatcaaagagcactctacaactatggatggtgccaatgacctcggattcaccgcctctgtttcgaatcaagaaaatgcaggaactgatattgtgatggaagatcatggtgtactgcaaggcactagtcaaaattatggtactgcaacagcggatgacgcagacatagaaatgaaagacgtcagttctaagcctagtaaacctgaatcgtcggtcttacaactaattgtaagtgaagatcatatcattctcgacactatttcagaatgtaacttgtatgatgatgtaaaatgctggagtaaatttattgaaaaatttcaggatatcgttagctaaggaggtacggagtggctcaaatacacattgtggaccgtacactcgatggagtttaggtttacgtacaccttctagtgcaaggtgcatgcttttcatacctcatatgactgagtttgtttagtgtggcctatattctaaaaaagataaacgttagaataaatgagcttgcgaactgagccatttaccggtcatttgccaatatatataatcaaggacatctctatcattgtgagaaatactaaaaatgtaggaaaaaggttaaaacaagaaccactaacacgctagataggtagataggtaggtaggaggaggtcgatattattactgcatatatatatttttttccattctgcgttttcttgctgcagcgtatttatgtatcaagatcccggggcagctgtaagtgtactgtctagaaaataaatcagcaggccgcttgctacttcagtaaaaaagagagtagaaactggaaatttttttggcagtcaaaaatttaatatataaaaaaggccctttctgttttaagtgcatttattaaatgtttccagttccaagacgattggcaacggaattatgcaaaacggcacagaagacaaaagcaatattcctgctcgtagtaatgatgatgtattgccgccgttagccgtcagacttactatgaaagtaatgcgattaattttcatcggaaaaatgtttgcatattcatttgtaccctttcccccatttaaacttttgacatttgataatactgtgggctggttcgtagcatattcagcgatcgtttctatttgggggtttgctgtgtggatggaaagaggatatagacataagattaatctactgcctccaagatgtacgaagataagatgctctcgctgcaatacaagaataagatcccccaattggttcaaatataagaattggttatattttttcctattatacgtttctctaaccacttctaacttaataattcaactggcctcttttatgacagaaatgagtcgtcggggtataagcgttcctggaacgaaggatccaggcaagagagattatttagggcttatcataccaatgcgattcattggtgcatttatccattacatgacggctaatttattcaaagagtattatttacataacggcccactagaaaagaatgatagaccttctaccgatgagaagacatcagagaatgaaacgctatagcttaacctcgattaaaattaagttcagtatgccataggtgcgtttattacatgttttttaacaacacttcaatatttctttctctgtatttttcaatagggaacaaaatgtactattttctccatgaggcctgaaatagcaaatgtactcccgcagttaataaatgtacggacagcttttcatagccaattaaaagcagtttatatctctttcctagcggatcacatctaatggttgtccaacttcccttggattaagaaataggtgaataacgggatagtttttgaggatccattattgatagaggttataattttagacaggcaaaatattctagcacttctcgagggcataggcatccctaaaagggaatcaataattttacataatgatattaccatatcttttatactttcttgagatctggagaattttgtaaaattgttgggattccatagtcgataatattatatatacagaatatgctagaagttccaatcattacactttaacttcaataaaaaatttggcgactacttcccaatctttatgtcatcttcttgcatcgtatatgacaatatgtaacagtaatatgaataatagtcaaaaaataatatataatattcattccaacactcttagtgtccctagctagaattacttctgctagtgaaacactcatcatcaatataaggaaattaattttagtcagatgtttttaataccttccgttttctaacactaccagattattttgggcactatggccgagtggttaaggcgacagacttgaaatctgttgggctctgcccgcgctggttcaaatcctgctggtgtcgtattattttttgaaattatttttcaataaccaccatgtcagcaccaggttcttttacaattatacaaacacacatatctcaaaatcactcaagaggtcatggaccaatatggcaacttgctacgaaagtcatacggtaacatatcagcttgtctaaacataccatactttacccatttttttgtgcttgttatatggcgccataaattgctcgaacatggtcatgtgatgcaaaacattgtattacccttctttattgatttttcgacaatccaccaattctaactacgaaactttttatagcataaaagtacttccacatttttggtgcaatgaactaatttagataataacaagatcaaacagcgtcccttccgcgtcaataaataattaggaactgtaattgaacctctattagtatatttttttattgattgcatgaaacatccgctcattctgtcatgtctcaaagaaagctacaacaggatatcgataagcttttgaagaaggtgaaggaaggtattgaagacttcgatgacatatacgaaaaatttcagtcaacagacccctccaattcttcgcatagagaaaaactggaatctgacttaaaaagagaaatcaagaagctgcaaaaacatagggatcaaataaaaacatggctcagcaaagaagatgtaaaggataagcaaagtgttctgatgactaataggaggttgattgaaaatggcatggaaagatttaagtccgtggagaagctaatgaagacaaaacagttttcaaaggaggctttaacaaatccagatataatcaaagaccctaaagaactcaaaaaaagagatcaggtcttatttattcacgattgtttagatgagctacaaaagcaattggaacagtatgaggctcaagaaaatgaagaacaaacagaaagacacgaatttcacatcgccaacctagagaatatcttgaaaaaacttcagaataatgaaatggacccagagcccgtagaagaattccaagacgatataaagtactatgtagaaaataacgatgatcccgatttcattgaatacgatacaatttatgaggacatgggttgcgaaatacaaccttcatcaagtaataatgaggctccaaaagaaggaaacaatcaaacttctttatctagcattcgctcatcaaaaaaacaagaacgttctccaaagaaaaaagctccgcagagggatgtttctatatcagacagggcgacgactccaatcgcgccaggtgtagaatcagcctcgcaatctatatcttctacgccaacacctgtgtcaactgatacgccattgcatacagtgaaagatgattcaataaaattcgataattctacccttggtacaccaactacacatgtgtctatgaaaaagaaggaatcggaaaacgactcggagcaacaactaaatttcccaccggatagaactgatgaaattcgaaaaaccatccagcacgatgtagagacgaatgcagcttttcaaaatcccttattcaacgacgaattaaaatactggttagactcgaaaaggtacttaatgcaacctcttcaagaaatgtcaccaaagatggtatcgcaattagaatcttcgctattgaattgtccagattctctagatgccgattcgccatgtctatacaccaaaccattatctttgcctcacccaacgtcaatcttttttcccaatgaaccaattcgatttgtttatccgtacgatgtacctttaaatttaacgaataatgaaaatgatactgacaataagttcggtaaagatagtaaagcaaaatctaagaaagatgatgatatctattccagaacctcactagccagaatatttatgaaatttgatcttgatactttatttttcatattctatcattaccaaggatcatatgaacagtttttagctgctagagaactttttaaaaatagaaactggctattcaacaaggtagatcgctgctggtattataaagaaatcgaaaagttaccaccaggaatgggcaaatctgaggaggaatcatggagatactttgattataaaaaaagttggttagcgagacgttgcggtaacgacttcgtatataatgaagaagatttcgaaaaactgtaaacagtttccttttacttatataattctcatcgtgatttactaggtaaatgtagtattcaaaatctccaatttgtactctttaacttcaccttcacatattatctttttactcgatgtagaccgcaccatcattacttgctagcttataactctttttttaaaaactgtttggagaaataggtgatttgtttgaagttgtactcgaaatcttgtatgtcaccataccaaggatcttcaataatggtctgcacagtgccatcattagtattccaatcaccaaaaaggcaaactttagctttagaaccttcaggttgtattttttttaggttattaatgttggattcatccataccgattatatagtcatattcatcgaagtgtttggtctttatttgtttccctttatgattaatcttgacgccatgttgcttacaaatggacactgtacgatgatcagggctttcccccacatgataattagaagtgccaaatgaatcaatcttgttgaatcgattttctagattagccttttcgacttcatgtttgaaaatggcttccgccattggtgatctacagaagttacccaaacaaatgaatgcgaccgatatttttggtttttcaattgtcattttcgtgttaactttcccttctcagttttctatcgcttatcaaaaatcacagggtttcaattagccttttaggagttatattctttattggctttatacttgaatggtgtgattctctcgaagggtttaacattcaagctcggccatgtgctggtacaaggaaaaagaaagaaaaagtaatcattgaaatttttctataatacgtacacctataatataagaaggaaaaggactgagtgtttggaatattgttaaaagtttgaaactatttttttgcttaatcgtttataaaaaaagttgtatttaagttgtataaagttttatttcattttttcacaaataatatcatatcaaatctgatgatctacgatcagaatttagaaagcttttttcaaaggagaaattagcttgtcacccttatagaatgcaatggtcttttgagctctttcagcaacaccttctggggtgaaaccgaagaacttgaagacttctggtgccttaccggaggcaccaaatctgtcaataccgaaggattgatgagcgtatttgccccaacatgtggtagccaaaacttcaacagacatgattggaacgttgtctggtaagactgatagtctgtattctaggggttgtttgtcaaaagtgaagaaatctggtagagaaacaacacgagccttgatgttctttgcggccaaagtcttagcagcttcaacactcaaagacacttcggaaccagtagccactaaaataatatctgggttagcaacatcttgtagtacgtaaccacccttagaagcgctttcaatagagctaccttccaattgtggcaagttttgtctggacaaagcaatgatacttggagtatgcttggattctaaagagttcttgtaggcggcagaaacttcgttaccatcagctggtctccaaacttgaatgtttggtagggatctgaagtgtgctaaagtttcaataggttgatgtgttggaccatcttcaccgacaccgatagagtcatgtgtagcaacccaaataactgggtggccagacaaagcggacaatctaacggcaccagcagcataagaaacgaagttcaagaaagtaccaccgtatggtttgtagttggcaccgaaagctgaaataccgttcattatggcacccatagcgtgttctctaataccgtacctaatgtatctaccagagtagttacctgaaccggaagaaggaggttggaagtcaagggcttccttccatctggtcaagttagaaggtgttaaatcggcagaaccaccaatcaactctggcaattgattgtaaacatcctcaagaacagtttctgataattttctagtggccacggcagagtccttggcggtgtaagttggcaacttagattcccaatttgcgggtagttggccgctcaatcttctagccaattcagcacctaattctgggaatttcttttggtattcgctgaacaacttgttccacttgttgttggcttcgacacctggctttaaaattgtcttttggtagtggtcgtaaacttcttgtggaacaacaaaggacttgtctgggttgaaaccgaatttgctctttagttgtttaacatcatctgctttcaatggggcaccgtgcacagagtgagagccggcatgcaaggaaccgtaaccaatggttgtggtcattttgatcaaagttggtttgtccttggataacttagcttgagcaatagccttggcaataccggctagatcttcgttaccattttctacgtacaaaacttcccaaccgtaggcttcgtatctcttagcaacatcttcatcgaatgagatactggtagcaccatcgatagtgatcttgttgtcatcgtagatggcaatcaagttacccaatttcaaatgaccagccaaggaggaagcttctgaagaaataccttcttgcaaacaaccgtcacccaagaaaacataggtgtagttgtcagacaaggtaaagcccggcttgttgtaagtggcagccaggttagcttgagccatggccataccaacagcgttggagataccttgacctaatggaccggtagtaacttcaacacctggcaactcaaattcaggatgacctggtgttctggaacccaactgtctgaactgtttcaagtcttcaatagacagatcgtaaccagtcaaatgtagcatagaatacaacaaagcgaccgcgtgaccgttagacaagacaaatctatctctgttgatccagtctgggttggttgggttcatgcgcatttgactccatagaacgtgtgcagctggtgccatacccaatggagcacctgggtgacctgagttggccttggatacggtgtccacagccaaaattcttatggtggagacggctagcttatcaatgtcagtgaattgagtcattttgtttgctaaagaggtaactatgtagagttgcttgggatgagcttccttctctgttgtacttcagtttgatctgaaacttaaaaaacgaaatttaaaaggaagacaacggtgagaacaagaaatgaatgaatcaagaagtcacgatcaagtatgtaggtaaaagatcaggggggagtatgtacgtaaccaaaaagattgggaaagagtttatatatgaatcatgcctacgatcgtaccttcttggctttcccaagaaaatttttcatctctcgaacttctcgagagattgcgaacggaacggcaaacgccgccggcatttctcggaaagaagactagaaaataaatgacggtgggaaaaaaagcaagaagctacggttacccgcagcggcactatagtagatgggcttttaagcccgttttcagggtcaggtaatatgtaatgtagtagcacttaaacttgctaaccataaatgaccaaaatgcaagtttgctgtattttagtcccgttggcgttttcggatgcttcattccccagagaagtgatgtgtatgcgaaaaatgtctcaatgcagctttggctgctgcggaacttatccgctttgtaagcacatcttgttttaatgtgtatgaatttttatatttggttcgaaaattatgacattcggccaagaaactttcagaggagctgtgtattagcagatggtaagcgcacgttgaaaatgctgaatattattaatttagacataccttgatggctgaacagtagtcagaaaattaaaaaaaaaaaaaaagcgcttattacggcgtatacacgtaactatatagacgtagatcattgaatattgatatgatataatattttccccgggattgcagaatactgacacgccttttatttatcgttcatcgtgtatttcgaacttgtcctcaaacgggctctcagtgcgactgccctgggtgctctcgcgtatcgattctggaatttccaagtccagtataaaacttccttcttcatcgtcatcttcgtcgttattaccatggcttgcctcgctttttgccatgtgtgaaagatcatccgcctctgtctgttcttcaatgacatccaagtcctgaatctccttatcactctcttcctctgcgatttgaaccagtttaggtttagcacgaatagcagttatgaggttatcgtctgcgtccttattgagtacctggttatgctcgtcatcttcgtcatccagaccatccaagatggaagaacctaaggttatatgtgacctgatatcaccagctgcattttgtctcttagagctcgagcgtagttttgattgcagtttgtcggtactcaaaccgcttgtcacaccaggaatgtaggcaataggcaaaatattagaagcccttgtacgagtggtagatgctgaacttctgtttcccggcacgttgagagttggaggtaccagtgacgtattgaacagggtgtgactttcatcttttctcataccgccatcatcctcatcgtcttcatcatcatcgtcttcatcgtcgaagtattcctcttcattcccgtaactttgcgatgcctcttccaatttcaaagctttatttttttgccttttgggcttccaatatctcttgttgatgaaatacaacgccaccaaggcaataagcatcgcaccacctacaatacccacggtgaaccccacaatcaacgaggttttctcatttgaattactggaactagaactagaggaggaggaagataaactactcagttgtgaatcggactgtttcgcacagtatgtggatgggcacttgtcacatgttaatgaagtcataacacaatattctcctgaagcgcaaacagggcatgatgcagttgaatcgcaaacaacacatccgtcgctgcctctagttgcagaagttgaagaggtggctgtgcttgacaaggatgaacttgcagaagccttggaggagctcgacattttttgtttgattttcagaaaacgaacgtaaccagtttgataaatgtggtgcctctcttattcggcctgggaagcagtgcaacaatagcgcacattataatcatttgattttaaattcaccccaggacaatggggcattattttctgttgagagggtaacgcgttgtttattgagaacttaacgcgtttcgatttcaagaatgcactatagtgcggaaatgtaaacagaatttattgatacttggcattatttgaattttatttatatcttgcccgaacatgtcttgacacaagcaaggaacgtttgctcattaaccttttacacggttatgcttgtaccaaaggctgatcacctggttcgggcacaaaacagagtttagtttccaactgtgtttcctttcccggatcagatgatggtaagggaacggtaacggcgtcttcatctttacaaggttggcccttcttaagattttgatgctttgtagtccattttttgaatcttccttgcaaaagataaatttcccttcccaaattatttctaagtgtgtcccacactcgtggcacgttttcttgatttttgtcgccaaaattagcactcttatggaaaatacggaacataccaccgctgttatttttagaactactcttttcagagccgagcatatcaagagaagtcctgacatatcggtatttcaaaagagtctttttattctcttgcaaaggaggcccgctaataatgctttccgtatcatcagttactagctcctttttgatatttttcccaaatgtgggacttatggaggtcttctcaggttcagaagcggagtgaatttggcaggtttcatcaattttaactaatgtatcgtcattttcaaaatcgtcaggtgttaagggtgatataatattcaatccattcataaaatcatcaatatcactaaaatatggtgtcttgccccgttccatcaagtcctctccatatccatatactttatcatcgtttacctcttccagattattatcagatggtagggctaatttactcttattttttctaaaccacttattcaacctctgtctccaatcacgatcatagcggccatgcaattgagaaagactcttcagctgcgtatttgaactgctttcactgtcagaaaaattcttattggttttaaaccagccagaacaagatcggaaaaaagtatcactttcagtaacttctttaatcactttttccagcctggcaatttcttggtcagttttatcgtgaatatgatcaactctgacacctaattgtgcagtctcattgattaaccttcgtaaatcttcgctttcagtcaaatgcgttgttatttcagcttcttcgtcaaactggaaggttcgttcatcatcagacctaagctctgaggggcttaatactgttggtaagactccagaaatcgtttgcatgattgatattttatctttttatatgattttgttttttagttatacttacgcttgctacccttacttatgaagtcagtctcttttgttagcttttattacaacacttatgagaaatttataaaaaaatcccaggaatgctttcacaaattatccattctacataaaatctttttttatagtattacttttttgtgacatcaaaatgaagcactaaataattatagaaaatattcagcaaaaaaaaagaaaaaccttcttctgaaaaaaaaaaaaaaaaaattcaaaaaaagacacctttctaccttggcagtaaatttcaaattaattatttaccaaactgtagttcccgctcactaatcctttcttatacttattcacattactgtcactttgcggctgtatttggccgcgtttccctttcgggtgcaggtacaagaggtatccgaaacaagaagggttaagttttgaagaaaatgccaagtatttcaatttcaataataagaacgcaaaactacaggagactcttactaagcatactacttctcaaaaaagggctttattttatagaacataaaacatactgtaggatcgcacactggaaaatatgttgaaacgatcatctctaatatatctatcatgtgtcctaatcattaccataccaatacttttgcatgtatacaatggtccaggactgtcccatgaagccaatgaacatagggcttctcacaagcaaaaaagaacgttagcaaatccggataaacccaaaagcgaaaacgatgaagatctattttgtgcggtaaccaacccagtcaccggatcatacatagatctatcacagctatcttcaactcccaacaaattaagggagggccaaaaacagatttctggcaataacaagcatgaatcctccaagacgaagtggtcagtgagaggttggggctacgatacaaacttcacgttaggcatctgctctagtcctgtcggagaagctgagtcgcaacaactgtccaatctaacgggcgctttttacgtagaccagttgaacgaaaataatttagtatcgattggagacttcagtacaaggcctgcgttagtcggcggctctactgccaagaaattaactctcaaatacgaaaacggctctatgtgcccgaacgggaaggacaagaaggcaactttattgaattttgtctgcgataaagaaattcaatcaaaggcccagatatcatacattggaaacctacacaattgctcgtatttcttcgaagtccgcagcattcatgcgtgccccacctcaaacaaaaagaatgaagttaacgttttgggtatcttcatcggtatcttcgctatattctttttagtcgaatttgcggggagaagatggatctatgctaaactaaataggcatttgaaaaacgacgacgagttacacgacatatcgccatctttaaatgagcaaccacactgggacctcatagaggacgggtctcgctggagtaaatttttcaacgggataattaagacgacaagaaggttcacgaaatctttaatgaggtctttagtcagaggcaggaacagccgtcaagggggcataagactacggtcatccccatctgcctcttcgtccagccttgccaacagggagttcttcagagacatggaggctcaaaacgaaattattgacagcctagacatcaatagtcatacaacagaaagcgaccacccaactttggctgataatagcgtataaacaatgcatactttgtacgttcaaaatacaatgcagtagatatatttatgcatattacatataatacatatcacataggaagcaacaggcgcgttggacttttaattttcgaggaccgcgaatccttacatcacacccaatcccccacaagtgatcccccacacaccatagcttcaaaatgtttctactccttttttactcttccagattttctcggactccgcgcatcgccgtaccacttcaaaacacccaagcacagcatactaaatttcccctctttcttcctctagggtgtcgttaattacccgtactaaaggtttggaaaagaaaaaagagaccgcctcgtttctttttcttcgtcgaaaaaggcaataaaaatttttatcacgtttctttttcttgaaaatttttttttttgatttttttctctttcgatgacctcccattgatatttaagttaataaacggtcttcaatttctcaagtttcagtttcatttttcttgttctattacaactttttttacttcttgctcattagaaagaaagcatagcaatctaatctaagttttaattacaaaatgggtaaagagaagtctcacattaacgttgtcgttatcggtcatgtcgattctggtaagtctaccactaccggtcatttgatttacaagtgtggtggtattgacaagagaaccatcgaaaagttcgaaaaggaagccgctgaattaggtaagggttctttcaagtacgcttgggttttggacaagttaaaggctgaaagagaaagaggtatcactatcgatattgctttgtggaagttcgaaactccaaagtaccaagttaccgttattgatgctccaggtcacagagatttcatcaagaacatgattactggtacttctcaagctgactgtgctatcttgattattgctggtggtgtcggtgaattcgaagccggtatctctaaggatggtcaaaccagagaacacgctttgttggctttcaccttgggtgttagacaattgattgttgctgtcaacaagatggactccgtcaaatgggacgaatccagattccaagaaattgtcaaggaaacctccaactttatcaagaaggttggttacaacccaaagactgttccattcgtcccaatctctggttggaacggtgacaacatgattgaagctaccaccaacgctccatggtacaagggttgggaaaaggaaaccaaggccggtgtcgtcaagggtaagactttgttggaagccattgacgccattgaacaaccatctagaccaactgacaagccattgagattgccattgcaagatgtttacaagattggtggtattggtactgtgccagtcggtagagttgaaaccggtgtcatcaagccaggtatggttgttacttttgccccagctggtgttaccactgaagtcaagtccgttgaaatgcatcacgaacaattggaacaaggtgttccaggtgacaacgttggtttcaacgtcaagaacgtttccgttaaggaaatcagaagaggtaacgtctgtggtgacgctaagaacgatccaccaaagggttgcgcttctttcaacgctaccgtcattgttttgaaccatccaggtcaaatctctgctggttactctccagttttggattgtcacactgctcacattgcttgtagattcgacgaattgttggaaaagaacgacagaagatctggtaagaagttggaagaccatccaaagttcttgaagtccggtgacgctgctttggtcaagttcgttccatctaagccaatgtgtgttgaagctttcagtgaatacccaccattaggtagattcgctgtcagagacatgagacaaactgtcgctgtcggtgttatcaagtctgttgacaagactgaaaaggccgctaaggttaccaaggctgctcaaaaggctgctaagaaataaggagattgataagacttttctagttgcatatcttttatatttaaatcttatctattagttaattttttgtaatttatccttatatatagtctggttattctaaaatatcatttcagtatctaaaaattcccctcttttttcagttatatcttaacaggcgacagtccaaatgttgatttatcccagtccgattcatcagggttgtgaagcattttgtcaatggtcgaaatcacatcagtaatagtgcctcttacttgcctcatagaatttctttctcttaacgtcaccgtttggtcttttatagtttcgaaatctatggtgataccaaatggtgttcccaattcatcgttacgggcgtattttttaccaattgaagtattggaatcgtcaattttaaagtatatctctcttttacgtaaagcctgcgagatcctcttaagtatagcggggaagccatcgttattcgatattgtcgtaacaaatactttgatcggcgctatctgtaatggaaaagagaagaagcctcttgactcactatccactcgaacttggaaacaatggtcgaagatgcagtatatgatacgacctaaaccgaacgagggctcaatgacattaggaatgtactctcgtatatgttgcaaagttgtcttcattttgatagtaaccaaactgctatctagttttacgatctggccatttacttgacaggtaaattcaccgttcttttccagttcttcatgcctcctaatcaattcatcctgggaaaattttgacaaaacagattcgattaattttgctttctgtttgaacttcgatccgaaaaatttcttattcacttccacaacccactcggttctttcttttggtgtatctagcttttgctttaccgtcagacttcttcccgttttcttggagtgtacagttaaatcaaaagccgccctgtcagcacaaccgacacattcaatccaaccatacgatgttaaaatttcaccgtcccaacaatctgtggcatagtgtgccatttcattcttcaaatgctggcgaaatctgaatttgtccttgttgatcccaatattcaacaaaaattgatgaactcttgccataaaatatcccaatgtttcattttctaccattccagaattcactgcctctcctatagtcattttcacaggcagttggacttcaccactttcctgtaatctgcgtgatagtagtggaatctcctcatttaacacttcattgaattttgcatgtgacttattcaacggatcaacaaagtgctcaatttctgccattaaaaactctcttacccttaaaagcccacttctgggggaaatttcgtttctgaatgacttaccaatggaagctgaagcaaacggaattttcccttggttgatttccaataatttgttgaaattgagaaattgtccttgtgcagtctctggccttagaaaggccttcaattgtcctgaggctccaattttagtttcgaacatcaaattaaaggaagttagtgcgtctaaaacatcgttagtgactggatcattaatgttatattcctgcatgacgagattcaactcaggacccgaaaacccgtcaatcgtggtcaatattttctccatatttttcatatcctgtggattgacatccttgtccaacagccgttttttcaacgtctgttcaatcaaatggtctgctctgtagtattccccagtcttaggatttcggcacatccaatcagtaaatttgtctacatgcccagaagtcttcaacacatcgtaaggagttagcattggcccatcaacctgaagcatgttttcttccataataaaatgttctcgccacagtcgaatcaagttattttgcaactgacaacccggaggccctaaatcaaataaacctgacacaccaccatatatctcaaacgagggtgtgtagaaaaaccttctcctcaatgtactttccaatttatctctttccgaattggacattaacggcatgttgatgtgatatgtctttcaacagtccaacaaaatgttctttaatgtatcacatttatcgtttttcactttcattgtctaaaagaaaaaaagggttgcaactactatcgcaggttcataaattagacctcatacgaacagttcatcagaactgatcaatatgcttcgaccttttatattctgtcaaggttattcattacttactcactgaattgttaagacatcgtgcgcctagcctacatagttattatgaattatgaaacacgcttatgattataatcgtatggagagaccaccagccctttgttcttcctggcacctctgaatatagtttctaatatgtcaatcatttcttgtttgtcgtctacaataaagttcaacttgttgttgttccctgtaccaaaatcacacatcatgtgcttattgtggtagaaaaacattactgtcatgggatccgtcagctcgtacatctcatcaaaatctgaaacttcatctatatcacataaataaataactgcaaagttccttactctttcagcaatcgaagataacaactcgtccatgatcatacattgtctatcatttttgcgaccaaaacgaatgacaacaagtcgtttagtctcggtaacaatagcctgatccacatgccatcccgtacgcaattgaggcaacaaaacactagccatcaaaacttgacttcttactctttctctacgtactatttctatccgatgatcgaatttggtatgtaagttctgtttttccactttgcgaagcggtcattggcccaaaagaaatacaacgagtcatctcctcgcagtaaactgtacaacagcaaagaaacagttaaaaaccctccagagagaacacttactactatagcatggatgaaaacggtacagtaaagcctggctatgaattaaagggactcaattcgggaaattcgaggtcaaatatggataaggatcccatcgttagcaaatttcatagggctggtctcaatgattctgcagacgaggaagatactgatatcaatggtaatcgcaacactagctggataacttcaatgattagtgaagaaaaacgcaaggtggagggaaaatctatgctgaatgatgaggaagatttgcatttatccaaagctactttgaacaaatgcgatgctctagttaagatattagcggatattatcaagctagagtttgttattcaccaatcatggtatatcagatcccttcacaagagtgtcttaattcaatttgaagtagaaacgtctggtggaaataagaatagcgccggtgatagcggcgacgatgatgatgataatcataatggtaatctggacgatagcttttataaagatttaagcttaaaatgcatcaaaaaatgcgagaagtcttcccttgcacttgagtcgctgtcaagggacattgaccaaattagagatttcataatgtccaatacaatagaagacaacagggttgacaggcttttgcagaattcgatgaccctgttattagagtgttggatctactctatgaagagattgcgccgtctaaggatgaagattgcaggtatctttgttaggtccaaacttttgcttattgatcatgaattagtgaccatatggcattttttacaggagcaaaacgagcacgaaacggttaataatgagaacgaactgaaattggcagaaacaataaaatcatacagagcgttcattaagatatttattcaacaattggaggactccgaatcgggatctccatcctcctctttgtttgaagaatgtttacacgtttttttggatatagaatcgatgtacaactctttaaacctgaattggcttttgaacgaaaacaaagcattacaagaaagactactatcaccatcgtcgacatcggagaacgatcatactaataaccttcccgttattgatgagacaaaggaaatcgaagatatcagctcatttgtcaatagcattgtggatgcatccatgttgacacatgatttgactcctattaactcatcagatagcgacaatttatcaaacggagaaatcgatcgtctagatggaagaaggttatcctcttccacgtcagatatgtcattgatgatgcaaaggacttctctgcagaaacaacttcctagcttattaactgccttcaacaacgcaagaagactagaacaagaattgcaaaacgcatgcaaagtaaacgataacaaacatagcacgaaagatactgattcaaatatacgacggaatgaacatgctatgtcttcaagtgtatcctccatcatctcccaaaactccacattagcatcaccgtctcctccgatgtcatcgtcctttatatccacggcgccatcacaatcaagttctcgtatgagtacattaccactgtctccttcctcttcattattggaatcacaatcgcaaacgctgaagaacaatatgtcgcaatggttgaaccaatcgcgatctggcctcaacggcacaaaacttattccaacaaaccacattgggtttcacagcaatgttctgaatactttgtatggtatcggtggtggtccggtatcgaaatcttataaatccaatcaaccttcttcacaaaatacttgataagaataaggatatcattgctatgtaaacaaactaaatgcgagggttgagtacataaatacaaagcaagacttttatcatacataacacatataacaaccaatgcatgcatcctctcgacaatagttttgtgcgtatgtctttgcgaagtccaaatactactcacatccatcttttattttttaatcccatcgcagcgagtttaagcctgaaaaatagtgaaccagttgaaaaacactaataacatcgatgcaaaactaactatcaataaactgttgtgtttttagaactctgtacgttgtttcctatcccaagagttcaataagacgcagccaagcttttattctcttgactcgtccatcatagagctttatagaaatgtcagagaaggcttctgaagagagacccatacggctggccgttctggggggcacttctaccggaaagacctccctggtatctaggcttactgttaatatcgtccacgaggttcattatccaacaagaaaccaaactaactggcttttcggctttgttccgtcatcgatcctggccagagctatattagacgaacaagctcacgaaagactttgccttcgttccccaagcagccaaaccttagagcctatcttcccttcacctcaggtctccaaaaatgtactgctgtcgccattggtgtttcaagcttccactgataattttcaatcagtgaggttacacaacaaaagccactccaggagatccctatctttggataaatctgattctccgctgtatcaaactttttccaatgacattaactctcaaagtgttcctaaaatcaaggcagaccagcttaacgttatcgagcattttaaattgcccctgaattacattccacccacttatgcaccaatccagattgatattattgatacgcctggcttcagtcctgataatgtggtgccgttcttagaagtttctctcttccgaaatttaggaaaatcaatcctacatggactagcagatgaaccaagacgacctgtatctactacttcactattggttgcctctggtgcctctgagttgaatggtaaagttgacggttatatcttggtgtatagcgcagtccctgaattaaaccatattggaggccctccggaatatggagatgatgtgatgaacacagatacggaaaacgtcagcgatggtggatttgaacttttaaaagtgattagaaactgcatactagatgcttggactgaatttcgaaattatgaaaaaagatgggaggaaggcaaagaggatgatatttactcattggtttacagcctgagacatctatggagtaaaaatagcaaagagaaaagcgccaaaatagagcaattgagatcctataataccaaactaaaatccatcgagttagacccctcatctcccgattcaccaccaccatgcattatcgtctgttctcacgttaatcatgaactcgcaagcccaatgttgattgaaatgggaagacaactagcaacaaaatggaaatatggatttgttggaatagacagcatggatgatttaaatgtcgatgtggcggttagcttactaataaaggaaatatcagaaaagatgaagctactggtttctaattccaatggaagtagtagtagtggtaattcaagttcaatttacaactctcatttaatgaatgacaagaagaaaaacaacaatgccggcttaaacaaaaatatgttgaagaaaattataaaataattgatagagggaagaactccctttaacattcttatgaccatgatacatcgcacttttttttacttggattgaggaaatatgtatatataggcacgtatgtatatatacaaatgttctttctgaaaccatgtaaacagaaaaggaaaaaaaataattatattttattgagctttatggtaccatcttcatatccaattaaacaccagttacatttcgccagcgctttaatacgtctaagttgtcctaacctcaacccatctgactgcacatcaaacgattccaaacatgtcatggctcccactttatagttatgggatttcgagctggattcggtatttgagccgctaccgtttgttaggtctcccatagagctatcactcacgaccaggttgttctttgatttcacaaaagtttgctccacttctgaagtccgcatattataaacaatggtcatacctgaccaactactcacgactaagtaatcgtcttttactttatcaatatgaccaatattcttcaagggaagatgtacttttgatggctcactgactctcagtgagcttgggcattttatcaaaagcgcatcatctctaaggtatttcgtctcaagttgtaagttcactggaattttgtacttggttatgaaatcgtctgttgaacaactataaagttcatccccgctaacacacatatcaagtattggattcggataatgatcgttagaaacatggaccagttctgcaatgtccctttgaaggccttcatcaaaagtaattttaaatccgactacaaacccattttcataacctaaaaatatgacatcgtttaatttagcaaatctcattatgataccgaatttggagtctttcgaaattcctaaaaaattctgctgcttcaagaatctggggaaattaatattattgaatggtcttttcaatttaaatgtggagtcttctattatctgatatatatcgatagtttccgaatcatcagtatgacagcaaaccaatctataacttttattatctttggttggtttcacttcagcttcgatgatgaaattcgcaaaattcagtgtgtttatgggcatttcatagattttagtccattgtaaatgatccgttttattggcttggctaagctttctaactaaatctatagatagttgtgtagatgaatcaagctcaaaaattcgcagcatggagtctttcgaaagaatgtacagcacattggtagtttccacccaccaaaacgctataatgtgcgagttgccctcgatttctatatgtgtaatcggtctcttggtcaccaggtcccacataacgaaataaccgtagttatcaccggataacaagactggcacattcgaaactgacggtgctttgatgacctgcaaagctgtgatgccccttttatggtaacgtaaggtgaaatcggataaagtcaacgttctcttcaggattatctcattactaaagcctctcatgtgttctacgcccattgtaatcgacgctcgccttgactgcacatcacacccaatttatgcacgtgcttaaatagtagtttatagcttagtatctctgtatttctgtcttactcatcaccgtttcgtctcaatatttgcttaaaaatcgaaaaattttgttataaatttagttaaaaaaaagtgaagagaataatcatcacttataaagacaacttaatagacgctggtgtggacgatccagtgatagagaaggggagaagtagatacgcagaatgatgactagggagagcatagataaaagagcaggaagaaggggtcctaatctgaatattgtgctgacgtgtccggagtgcaaagtctacccaccaaaaatcgttgaaagatttagtgaaggggatgttgtatgtgctctatgtggtctagtactatcagataaactggttgacaccaggtcggagtggagaacgttttcaaatgatgatcacaacggtgatgacccaagtcgtgttggtgaggcttcaaatcctcttttagatgggaataacctatctacaaggatcggaaagggtgaaaccacggatatgagattcaccaaagaactgaataaggcacaaggaaaaaatgtgatggataaaaaggataatgaagtacaagctgcatttgctaagattaccatgctatgtgatgctgctgaattaccgaagattgtgaaagattgtgccaaggaagcatataaactttgccacgatgaaaaaactttgaaggggaaatcaatggagagtataatggctgcatccatactgattggttgcagacgtgctgaagtggcaaggacttttaaagaaatccagtcattaatccatgtcaaaactaaagagtttggtaaaactttaaacataatgaagaacattttaagaggcaagagcgaagatggtttcttgaagattgataccgataatatgagtggtgcacaaaacctaacttatatacccaggttttgttcgcatctgggcttaccgatgcaagtcactacttctgctgaatataccgcaaagaaatgtaaagagatcaaagaaattgcaggtaaatcccctattactatcgctgttgtttccatctatctaaacatcctgctctttcagatccctattaccgcagcgaaagtgggccaaaccttgcaagttactgaaggtaccatcaaatctggttacaagatactttatgagcatagagacaagcttgtggatccgcagcttattgctaatggtgtagtgtctttggataacttaccgggcgttgaaaagaaataatgaagtgataaaacagtaaattataggaacaagaagcacgggtactcgtgttagagggtagaaccttttccatggcagttcaatcgaatatttattttgttattttacaattcaaaaaaatagaatgaacactttataatttaacaagatttttctttttttttttattgaaggaggtattcgaaaggatgaaagctaaacaagttatttgaaatatgcatacatacatatatatatatactgtgtatattcaaatggtggcctttagcccataccgaattgttttgccatttgttgcatttgtggatcttgcatcattttcatcatttcgttcatatcaggcattcctccgcccattcctccgcccattccgccaccaaacatgttcatcatattttgcattagacctggattttgcttcagcttttgttgtgcctgctgcatcatttgtggagtcacttttggcataccaggcatattcggcataccaggcatgtttggcatacccggcatgtttggcatgccaggcatcctagcattggcaccaggggctcctggttgttgctgggttgcggtttgtgccattcttgccatcatctgctgttgcatcaatatcatttctacctcgaacacagaagtacctgaacctttagctacacgaaccattcttgtaggctcttcaatgaacattctaccatcagattctagttcttctttagtcatagaatccaaaacgtaaaccattttcttcatcttttgagaggtttcctcctcccctacttgattcatcatattactcataccaggaatcatctgcgctatatttgataatggacccattttcattattgtttgcatctgtttcttgaaatctagcaaggtgaacttacccttttggatgttttccattgtggcttttgcatcttccttgttggaaacggtttgtaattgctcaaagagactctctatatcaccaatacccaacagtttagatatgaatgacttaggcgagaacttttccaaatcatgaatgtgctcacctgtaccaataaagataatcggagtgtttgtggctgcaacggccgaaattgccccaccccctctagcgtggccgtccatcttggttaatataatggcaccaaaatcggacgattctttgaaagccttggattgttgctctgcagcttgaccaatggaagcatctaaaaccatgatagtttgattaggcttgatgacattggatatttcaatcatttcttggaacaactcttcttcttgatgatgcctacctgaagtatcaacgatgatgatatcaaacttctctttcttaaacttgttaataccttcttctgcaactttggcagggtcagtctccgtatatgacccataaaatggaattcttgctcttatagcgttttgtttcaattggtcaaatgcaccagcacggaaagtatccgcacataccaaacccactttgaaacctctcttcgagtagtaaactgctaacttggtacaggaagtagttttacctgaaccttgcagcccaacaaacatgatgatgtttgtctttctcttcttgggcacaaaggccttctcttcactaccttcgcaggtgaccaacttacacagttcatcaaacaccgttttctgaataagcttcttagtttgtgcgtttgttgtggacttctcactacggttctcactcagcagctgtgaccttatattatttcgtaacttagaaaccagggcaatattcacatccgattctaacaacgcagtcacgatgccctttaacattacatctacggatgtagtaaagtcatcctgtgtattggaaatcgcgttattcacagcagaattaatccgcttccccaaatcagccaaaaccatcctttagttagactcgatgctgtgttttctttcccttctcttctgcatccttgctgttcaaccacttttcattatcttgttttaccactattttttttcactttgttgatgtctttatcgttagcggtgatttttcgatattgagatgaacgaaaagaccatcatactataacaatatgggtagtgactgaagtataggagagccgcaattgccggtctacagaactcacaaggcattcgtgaacaatgaacagtgtttgggatgatgctagaatagaggacagaacggtggacaaaccagtaggctcctctcacgctcaggagaaactcgcgctggtaaaatcaactttgtttaaacttgaccaagaagatagaccagaatgcgattcctgggtacaactagtcaaattgatctgcgacgaagaccgtgaagaagaatttactacattcaaggagttattaagggaagtcaaaaacgttaatgataaatccgtcacaggcgttgccttgattcattatatcattgtatttgatcgtgcagactacattgagttactacatgataatccttctggtgcaaaattagatttgaatcttgtcgacgacattgtaggttacacacctttgatgtggagtttcagtctgcagagaaggaacttgttgcttggagctgttcaacgcattcgacgagataaacttcaacatgacgaataaggctggattaaccgcttgggatatggttcctccatattcaccactttcggaatttttggaacaaaacaatatgtttcgataccgtaccgaagtaaaacatgaaatacctcaaatttcccaaccgaaagacacctctcttctaatgagtaatgaagactctaccacgaaagaaacttttgataatattgacttacaagtcgccggtttgaccctgtcccctggtgcaaatgacaacatgtttctggattctgatgaaaagaacatgaatcattctcagggagctgcaaccctaatagatcccacatatacagaagactaccacggtacatttgattatgataaactatctccggaccaatacttggaattttccgactttgatataccacaaatcctgaatctattgatatcgctaccacaaaaggaacctcacatgaccacctatccagctggtttaatataccaatgtattagatatgctgatcataagataaagtccaagccactagtagaatcgttaattaacttatctctaacaaaaattctgaccagtgtttcatccaacggagctgcaggattggtctccacagaagcttctttgcaagcaggtgacattgtattgcaatcgtattggttaagttgtttatcttttctctattactacctctgtagagatgattcatttttcaagaggcatccaagcgtgttacaagagctgattaacaccatccactctattatcatagaactgacatcttccattcattgcaggttgatttctttgatagattcaactttactagcatacacaacaatccaggacgttaaacaaactttatacaaaagagactggaacttttttaaaaagagaaagcaggccaagcttttattgaaggaaaagaacagaaaacaattaaaggaacaacaaaagaaagaacttcatcgaaaaagccagggtcaagaaaatcatgaagaagaggagggtcaacaagatgggaatgattcagatgatagggcatcaacaaatgatgataacaattctagtgtttcactcttttatgataaagaaattttgagacatttatatcctccatcattcgaagagcagatgaaaccctctccactaaagattgttcaaatatttggtgccttgtcttacgttcttaatttacatcaaacgcatccgattttccaacaacagtgtctctctatttcagttaactggtttgccacgaccttattcaataagatcttaaaggacaaaaagaaaagatctttatcaagagcccatgctattcaaatcaggttaaatctttcaactctagaatcatggatacagaacaacgatttctgtgttcctaaaccgatgcttattgatgacttcatgtggcagcgctttccaatgactttaattcgcgacgttggcgagatagatttatcggatccgatactaagaaatgtagcaacttacaaacctatagatgaaaataacaaggacttgatatatgatacgtcaaactcattattttactaccaacctttccataagatcgcccaaattcatcttgagccagttttccaactattacaatggttgcaagtagctacaacactagatagtgaagaatcattaatatcaacaatgaatttattaccaagaattacaccagtacagctcctaaagtctatggaaaaatacaattacgaattgaatgaaaataaattcaactccaaactgaagaaatttttaaacaacaaaatcaaagatagtaagatgagcaaggcagacgcgtatttacaagaacatgaaataccgtatctagttttaccaactatacccgaaatgacagacttgtattcaaagggtcctgattcacattctttccaaccgtttttaccaggcagtatccaagacgatgtttatgaaattcacgatgtcaacttcaaacaaagacaaaatgaaccacagatatctcggactaactcgggtacctcagattttactggagatgaggataaggcgcaatatgaaactgaaggggtaggggaaagtatagatattaacgaaacagtcgaacccgagagcaacgcgttcaatgtaggtaatgatgattattttaaagaattaaatattccgtcttcaactgctcaacgtcctgcttggtcgaataatgatgatatggaacaaaatccgtggtaatttgtgcgttagaacagtgaacttttgtatcgaactttatataataattctacggatgtatccatcttatttcttttcaaaagaatggaagaatagaaatgtaaataatgagttaaaaggggcagttgcttgatattttgacacgaatttagttacaacattttgcatatagcttcaagtgatatttatttatttttaatatagtaccgtggactcacagtttgggctctcgctgttcttcaaattctaaatcttgcttgaaaaagccgtcattaaaacgattctgagaggtcttcttaacaaaagcttgagagctttcaagttttgaagctttcacatggggatcaccatttttgagcgaattctgagaatcatttgaggatacagaaaactttctattttctttgttcgcaaacatctttgaagcattcatatttgaagccgacggtggaactggaaaattctcagtgtctttttccttcctgccttctagttttggagatagtgtatttaacggttgtgaaggccttcttggtactggtctcctattagaaatcatttttggattggatgtaaggataggattatctgattctctctcatctgctgaatcgtcatttttcttatcttgaacatctatttcatccatatcttcggtgtcactcgaattaccaacattatccttataccatctaccgattttcttgattgaattcttgaagtatttccttgacttggtagaattttcagaactggaaacatcatcattagtcgcggttgtgactgttgtctgggttgtagttttcgttgccactccagatgcgtcaacaagatcttttaggttttctttctttctctctggccttaaggcttttttgattcgactctgggttttcattccgccctcttgaagtgcttctaagtgttccttagcactagtattattcatatctgaggctgccgcagcagtgcgagccctcgccgctgcctcaggatcctgctcctcccaaataccacctctgtatacttcattaggtgttggataaaaaacaatatcatccataaacggtacaactagggactccttcacggcttcggcaaacttactctttatagcgttagtaacgacgttgtatgataatttacttgaactgacaatgggctcaatttcaaaatccattataggttcggtgcgaaaagcataccaaattctgttagatggaggtggtttgattaaaaataaaagtggaccggaaaattctttaatttttatggacaactgcaaagaaacctccctttgtttgaaacgtgatcccaagttaatactcgcctttgtcgcaataataattgtcaagtttcccctgtattgaacgtcgatagcaatcttagtcgaaccctcaggagacaattctaataactcaggagaggtgaataatggagcactatcacccacgtcgaccttttcaacaaccaaatcatccaagaaccctggggtttttattttattcaatttcttgcagattttctcatgaataaacttattcaacgtatcagtttgttgcagagaaagaaataatctcccaagaagagcattcagccacttagtagttaactgattttcagtagagttgatatcctgaatcaattgtaacatatccttagtcttcaaatgagctgcgttagctgaaacattaggatccaataaaccagttgagagggaattactgtttttagaggcattgatcaactgataataccaatcttctttgtccatgttattatcgaaatacaagaagaactgatttgagctatggaattgtgattgatattcatgtgtagtgtcattggtagagatgtcaccgttattcgattcagcactggtaagtgggtcgaagtgtggcaggataacattatggtttttagagtctatagaaacgaggtcattcttgaaaatagcaatacaagttctcttagtgaaaagcgaggcatctggcaattcttccttacccagttcatcgaaacggggccaaatggtgataaatctgttttgtaaagatatagcatggaccaaatttgcattttgagaatcgtctttatacaaaaacaaatttccatgtcttaatactgcaaaaaacctttgttttttcttcaagtctgttctttgcaagatttgctcttgaagtgcagtgtctgaatctttattattattagaattcttcaaaattacagccacttctgaagaatgataataatattgcttagtgacggtgatccaacccttgttaaaaactttgacacctaattgctcttctagcttgcgtgctttaaactctgggtctatatcgcgagccagaagtctggttttctcatcaatttcgtctgctgtatcatgatctagctccttcttcgatgccgatttaaggttactgtacaataaatggattttatagagggtgaaaaggaccaaaggcaaaaatgtgataccgccaagcaagtaaactgcgagaaataccttcaagctagccattatggtcttttaatgctacttttctcttgctgttctgctcttcgatgtgttcaaaaccctttctcctggttattatacaagagggatttacggagaaaacttaagtgggagaaaactgaaaaatgtgccataccaattaggtgcaaaaatgaaagatctaaagggaagagaaccaagagttatttaaagggctacatagggtgcaagattagttaggttgtagaactagtttttcagagtcattaaatcagttattttttattttgtagtcatcaattagccccttcgttaaagagaccaatctagtacagtgtgaatataaaaaaatcatcataataaactagtccgcaacagtctcttttatcatccaaatcaactgataaggaataaattgaaataagaaacaaatttccgaaaaaatcagatgtcttgtgaccaatcatcaattctccactaaagaaccataatgccatcaacatcgctcctttaaaaaatttgtacacaaaagaacgatgagagtagacggcgaccctttaacagatactaatatgtccgcccggtcgacaacaaatcatcatatcaaaaggaaaattaaaaattccattgcaggcatgaaaaagataataatgaaagataaatgctttcttttcttcccttccgtggcacccctcatacaaggctgaaacttaacgaaaaagggttgtcgacatgtagttaaaccactattcagtcggaacaattggtatatgattaataatttttaatcataggggagtcacacagaaagaaaatggaaaaagaaaaaaggaactcatatattatctcttccaagggacctactggtcgcttaatctgcctctttgtagtgcagtagcactcacaatggtgctatatttgagtttgttcaactgttttctattgaagacgaagaagcaaacaaaggaagatgtgaaaaaaaaattctatgggtcaaacttgtgcttttatacgtcgtacgagagatgggtcacccgcttctgagggttttttttagggctcatactagagtattatactgtttatatcttgttttaatgttatattgcattactactcatcatgacagtaaattaggagttctgtgtgcactccagttcgggctaaagagtcgtaatcgtactggtcaggcaggtacttgttgtcagagagacggtacaacttgcgggatacttgcttgttgacgtgcttgtaggcatccttgaagcgcagcagaggcagtgggtaccggtccagtgctcgtcgcacgtgcatctggattttgtgcttggcattccgtatctgttcatacatctgctgtgtcttgacgctgtgcttgtcccgtaactcaccagcaaaaatcatggaattcctggaatcgtagctagcaagttggctactgatagcacccatgcgcagctcgagcaatgcatttgatctacaatctgtgcactcctgccacgtattgcgatcgcccacctcacaagctagcccgcgtagacatgtttcgtgatatattgcttcgcagtcttggcaatacaggcttaatcgagaaacatctgtgtctccgcatatgctgcactgaattatcttaatggtatccatcaccagcgtacctctaagcctttcgctgagaaattctatttcttggtcttgctcccctgtatcgtcctcatttctttcgttagttgtttcggcccccacataatcgatagcattcttaatcataaaccccatcttcaaatttatagaaagtgcatgttgcccttcgccaacttctaaatgggtggattcaaccctgcagatggggcacttcaagttgatactatacttgtgccactctcttatacagtttaagtggaatttatgcccgcaaacgttcaaacatccaaattgttcaccctcttggtcatctgccaaacaaataggacactcttccatctttttatatgatatttggatatttggctgagggtatggtctctcccttggctcaactccttgcatctttttttctatttttttttctcactttctgttcttccatatatgcattacttgccatatttctcacttactaaggcattcaacatagaaaatgaagatggatacaaaaaagatccacacacatacaagcctccaacaaaaaaaacatgtcccgccatcagtttgatctaataatgtgcctaaagcagcctggtgtacagacaggtcttctttgtgaaaaatgtgatggcaaatgtcctatctgcgactcttatgtaaggcccaaaaggaaagttagagtatgtgaaaactgttcgtttggtaaacaagctaaaaattgtataatttgtaatctaaatgttggagtcaatgacgcattctattgttgggagtgctgccgcttaggtaaagataaagatggctgtcctaggatcttaaaccttggcagcaatagactggatagacatttcgagaaaaagaaaaaggtataacacatacatatagaatatgtaaaaatatataaataaataacatgcatttataacccatggtactattttcttccccttattcgttactatattcgtcgtaactactgtcgctcacgcacacttgcaaactgttctcgttgaataagaagctttcctctatatcatctataccatcactatcgtcgttattgccttgcccctcctcttctcctttaccatgctctaagatattcttttcagcctgcttgcgagtcacttcttttatgatacttacaaacagctcgcttctcttaatttcgtagattaaccagtccattctgacagccagctgtcttatgcggtttatcatatctgtcttagtctttgtgctaataggaacacattttcccataagcatcagagtgctttcaaattttttcaatttctcccatttggctgattttatagacctaagtctttccatcctctgcaaaatggtaagctttctcttattacaaatagtgtttgctatactaccaatttccacatagcatccgtcatatgctgaaaatagattgatagaatcgatccagttgtccctttcatacttattagcacatttccagataaaatttcgatgacatgtatgtaagtataatagacaatcggcattttcgtcttcgaaaatcggatactcgtccttaatggaatgataatcttcattactgtcatttgaactgagttgattatctgaactagaaacactatcgttgtcactctcgccgttactcacactgctcgtaccatcagtagaattcgttatgctatcctcttcatctgaagatggctcgaagactccttcattgtgtttggcggagctacttgctgcagttgtgttgcttgtatgactcccagtagaatgatgctctgtatacgcaagtaccaaacttgcgaaatgagatttcccaagtgaatctcgctccctatcagcaaataaaccgttatacacgtcaatcgtacttcccggaacaaaagaaaatcctgatttaaaatcaattatatagtttgtagttcctgattttgggtccttcatcatctgtggatttatccagtccattttatcgcagatcaaaagccccaatgatgttaatatggcaaattcctttttccaatgaattttagcggagttaacaatagaaaattttctactgggcatccccaaattcattattgctcccatttgaaggattttgcaatacttataatcggagttcttgcatccagaccggctattatcattcaatatttcaaaattaggtaaattcagtttattcaattgacttttgtgaaagcgtaaatacccacctttagtatcattcataatactataatatttttcgtatttatgttcttcatttctcaacaaatttgccttcagagcattcttattccaatattttgagacttctggaaatagatttacttcatttaatgtatcatttataatgtgcgaataaacgttaatgtcatcttgaactaacgtagcatttccgctagaactagagcttggattatatgaaaaataagacgatattgagttagaagccggtctattgctattactgttagccgttccgaggttggccccgtttatagtacccgacgtacttggtgggcaagaagccgccgtagatggggcaataccagatgcactaattgaattcgttagcggataaaagattggggaaagggaagcttccttgggtattatactccccctttttatcatgtctatgggagaatacatcgaattcgaagataatgtgatagcaaaatttgtgtcaaatgcatctttatcaaggatgctatcgtccaacgccattggtgacatcaaaaagtaattaaatttcggcgactctttggctgtcacattctcataaaaatatgtcaaaacggccatagggatctcattacctcctgagtatttgtcattatggactaaatccacgaaatcatgctttgtcattttgcttttattgttggggttaaagtaatcagtgtgcaacattagtaaggaaaatgcaataaaatacacctggtctgcattagaccaggggcactcaattccttttttcttagaatagctcttttgggccttatagtatgcaaagctaaaagccattatcaatctatcaatttgctgcgtctcctttggaagctctaaaaacatcaacaatttcctcagggcaatatctaaagggtcatttttaaattcgaagcaattcgttaataggtagtttaaacaattttttttgaactcatcatctttttccgttaaaatgatcccaatgaactttccgtagggcgctaatttaatcaagaagtccttacaagaatcactaaattcaggcgcgggaaccggtggtagatcttccagcgagacatccagtttttgttgtagctgctgttgttgttgaaggtgctgttgcctagaggatgataaactggaggagcgaaggttaacaaaactacttaaagcattcacaattgagctacttcttcttgacattccagtaatagttgaattggcattgcttttattgttgtaaactgaagtagggcctgatccatgaggtaggcccaatttgttatggtagccttcatcttcaattgattttctcttgccgcccttgccttgaacaaaagacgtactttgagatcgagaccttgataaaacctgatggtctgggtgacttgcttccgctccatctgtatcattgcttataatattggcatcatcgggcaaaagaggtccgcgggatcccatggggtcttgcataagagaatttgtatttttctcgtcaatagtcctaataaaagaagatggagagagtggcggtttgttctttgctgtattgtttttgttaatatagtcaaatacgtcaacagttctactgcgccttcttccgaacctccttttggagatctcatcttgttgttttgccaattcaatttgaggagttgcatcaagtggtattgcgtgcagcgaattgaattttattgacgacgacgatgatgatgatgatgcaacaacagctcttttggacggattgaaatatcttgaagccgctgtagaggaaccgacggaagaagatgtcgatatcctactcacagtaggaagagtaggaactaatctatcaccgttaaacagggtaggctcttgtgattttctgtaatctcttgacaatctattagaagaaggaaatttttctagagcaggtttcacaggaatgaatggggcgtgttttgaatttctctttacgttatcagacccggagctagtaagcgtgactctctcaccatcgggcttgggaactttctctatcgaatctatgttgttttctgatttgaaaggcatttcttcaggatcttgtccattacggaggtgttgtgcaaccaagatttcatcatcttcagaacccttttcattggctgacctgaaattcaagtctaacctacccatcttacgccgtatcctgcttagtttgctgtgtttttttgtgggctcgcattcttttacatcaagtttatcgtcgtcattattagtgtgttcctgtatttctgcgagttgaagaaaaggacttctataactttccgactctcttaatttatctatgcctgttgaaacattgcttccgccctttttgttgccatttttatcgttactgtgtgattgaaggaatttaagcttaatcaacgaagaaatagactgattcattatctggcaagtgtggattgaagagctggtctggcgggaagttagcgaaaatgaagttacaatgagttgaaacagagtaaataatagggagtggatgcgagtaaccttgcgatgtcaaaagaattcaaagtactatatctactgcctttctttccacttggtgccttttaccctgaaagtctaatgagcaggtagtataagagaagcagcttctgaagaagagttctttgtacaataaaccggccttgtggtgcgagagaggcttgtaatatagattatactgaagcctgttgaacttagcgtctattttcttttcgttccctatatcacttttcctaatattttcaacatctcctttacgccaaaaacaagaaaaaggacgagatggccttgggtttttaatgcttacgcctgtttcgcctctcataagacagataaatgtacgttaaccatttgacagttaactttttaggcgtgaacaaggaacgtattaaagtgtttttcgaataattgatcactttctagctttcattcttttttaagagctacatccaattactgtgcattgggctctataaaaaaagaaaaacgaaccttaccttgtggtcggaattgtgtactgaaatcagtggttgaagataattgtactaaagaatcaaaaatagacagtcttcaaatgattactcaagacactcctgctttaaatccaacggaagaacactacctgaagagggaactgcttcgatgtcaattggattatgaaattggaaagcttaacgatcagtttgctttgagaaagttcggttatcctttctcaccaaacgatccgacagctccacagcctatctccaataacgattcatcaccagtgctcggtggcaaaggccattttagcgttaattatcccatgctgagttatgttttgcaagaatttatatccacatttcctttactttcaacaaatttgctagttgatgaaaaattctggcagagtaaggttcaagtgttctttgaacatttcatgagtcttgggtttagtgaaagttatgacagggaggaagcttcaaaaaggaagaaagtttccaaaaagctatcaaaggttatcttgttgctctttaactccggtgttggctcttttcaagagcaagcgtattataatgaggataaattcgttttacagtcaggccaagcgagaaaacgctctaatattgagaaatttgcaatgccaactagagaaaatttagagaatttgctcactaacgaatccgtttttattaacggttgggacgtcaatattatatccgtgttcaataagaattcacggaaatgtactgaaagtgtggataatgacaagtctagtaaatctactccaacttcgagtcccaaaagccatgctataaaatcatttgcttccacttctaaatggatgaagaatgccttcaacaacactattaacagtaccataaatagtatgcccgaatcctcagcatctttattttcgaaattatcccttggcgtgccttcaactaagagcaagcaatctagaaaacatcattatttcttgattaagattaagaagcaagatgacgacgaccaagataacagcaatgaagagaatagtaatcttgatcaccatgctggttatttctatgtgacaagaacatacagcgacttcaaaaaactatctcatgatttaaaatcagaatttccggggaagaaatgtccgcgcttacctcatagaaataaaaaagtgacgtctatgataactaaaaccgaagtgttacacaatgggcaaactaaatcagcagccagggaaaaaatcgtcaacacttttgacactgatttacaatctgcatcagagtctgataattcttcatttttacagacaacgaatgaattatctgctacagaaacagtactcacagaaaaagaaactgaaacgttgagaaaaaatattctaaatgagatcaaggaagaagataatattgatgaggacgagtatgaggaagaaggtgaaggtgaagaaagtgattttgatgaatataaagatgcatccgattcaaaaatcaatactttggtgggtgaaaaaatgagaacttcattaagacaatatttaaggactttgtgtaaagatgcagaggtttctcaaagctcatctattcgtcgcttcttcctaagtgggcctaatttagatattaaggacataaatccgaaaatagcagatgacattagaaacagggctctgatagatgtaagtaatttggagaaccaaatacgtttccaacagatggcgttagaaaagtctttaaagctgcaagactcaatgaaagatttcaaaacatccctgttaaaagatgaaaaatacttgatgagtctactagtagaaatcaaggacaatacgaaagttgaagacctgtcaccacttttacaagactttgtggaatggtgtaagatttatatttcctcaatgatttatcaaatgtttctgggtaacgataacagttatgaactctatacacaaataagacggttacataagcttatgccgtacacagtaatgggacagatcatgaaatttactaatccaatagcgatcatgaggggtatgattgaattatttatggcacaacccttcggtggtcattcgctccttcaaacaatgttttctacgatattaacagatgatttgaaaactcaaaaggtagctataaaggaattagaaaggaaaattgctgagatggacccgggcgcttcagttgtgactaaatgcttgaaggattttgtctttaataatgatactaaggatgagcatgatactaaactctttactatggacgcagtaaatgcagaatccgaatccatgaacatgcctgtaccattgatagtattaatgaaaagtgcagctgcaaatctaattccagacgaggttgtcgcgggacttattgaatcctattcatcatggaaactgcaaaaagaagacacggatgccttgaatgtaaccagcgaagatcagtcaggtatttatttcacacacgtcaaagatttatggcaattgtatattaaagaacatgataaacagctaatgaggcagctatggcaagatcctgagttaacccaaatgctaaaggcaattgtcactatgatttacgaacctatggtcaagatcttcaaagttgcaaggatggatgttgctttgaaaaattttgagaagttcatgggtgatttgatcaggcttgttgatgatgttatcaatggtcagttgggcgtttccacacagttcgatgtcgtggaagaaatccataacttagtaaccaaacatcaagatgccttttttgagtttattcatgatgtatatttgaacgattcagagggcatttttgaaggttttattacttggattactacgatagtgaaatttttgcaaaagagtaaattcggaggaccgagtgaaaggatcgacttcaataagttaatttgtagagatgatatcgatattgatgtcaaacttttgaaagttcaagttaataatgttcttaataaaaagattggtgcgagaaaaatctataagaagttgttagatttgaaggttaaacaaggtactaaacaaaataacaaacacgctgctggcatacttcaaaagaattggagtgacataaactccttggttatgccatccagctctggatcttttggacttggagatggtgatttggtggatttggatctcgatacaggtgattacgattttttacataaagagaatgaagttgaattagaaaagcaatacaaagatttattgaatcttgttgttgatgaaagtgaaattgataaattgagatctcaagttttcgcacaggaattaaaaaattatttagaagctcaaattgctaaaaagtaggccctttctagtatctcctttattcgtttttattcgttacgattttccggcttaataatataggattgctaggtctatatataagaaaagcttgtagaaataaaaaaatagaaaaaacttcaagataaatattgttctcttttattttaagatcctacaaacagcacaattccccttttagttatttttagccaagatcaggatagcagagaactgagtcccttattctttaattgagggtcaaaaaattccgattgcgaacttcatctccaccttggcaaaggaatgacgaaaaaatgatcttgcatatatatatttacttgtaaaataattattttggaatttttcttaacaaaccacctgacaaacaaacaccgtacgcaagcatcccgcaaacattagaaagattgaacaaaagactcaatccgtgcgacttgccaaattctttacgtaatatagcatcctttgcttccaattcactacccgtgtatttcttcgcaatattctttctttgttctttaactttatgggtccagggcaacaaccaaaacaaattggttagcccactgacagatgcaaccaccaaagaagataatggtcctgttgtcaaggcaattggagcggtaagggccaggatgacaggtgatgccgcttgcatttggaaaaaatacgggaagatcttattttgcaaagcagaaaattggtctttttcaagaactttgaatgcgattggagaagctacataggaataaaacgtcgttcctccaaatctgaaagattaagttggtacataaaagttgttagtcagttattctcaattaatcataattgttcaaattttttcttgtgtcttaatctgtacatacacaaaggaataaaaaagcaaatgagccgtagttttgactaaacacatttttcgttgttaagtttactggactgtaaagcgtagtttgatctgcctatatcatcaaacaactccatttaactcccttaaataatactattcttttctgtaagtttatcgcactatacgttacggtgctttccgtctttttcggatgagggatgctcataagaattacaacaaatcataagccctgagataaaaaagatcaatcaatacgattatcataaaccatgactaagtagatacacagacacgaatatatggagaaatggttgtgaaagctattgcacgaaattccataggtcgtaatggagttggagcattcgtgtttccatgcagaaagattactttgcaattctgtaactggggagggtcttcggaaggcatgaggaaatttttgacttcaaagagattagataaatggggccaggagttcccatggatacagtttgaagtgatgaggaagtctggacatcctttgttgagggcagaatacacaaatgggcgtgaaaaagttatttgtgtgagaaacttgaacattgacaatgtagaaaacaagctaaagctattgaaggattctgatggagacattttacgcagaagaacaaagaatgataacgtggaaagcttgaacagtagtgtgaggggtatatggtcgcctctgcatgctgcgaaaaggcatagaatttagctttagtatataagaaaattctagaaatagagagagataattatacttgtatatataatttggggcagataagactcctgatatttaagatttaaagtcaattttgccattgttatatgatcatgtcctgaaatatgacctcttgtatttggttacccgctttacaccctgcaaatcacactagtctaataaatatggaataagactgaaacatataaaagatgtaacttctaggatatctgaaagagcaaccgtacggtattcaacgtttagatttgatggacggccttagctttgttgataaagggaaaataccagatggttacaaaaatgaaatagatcaattagtaaagaaggaatttgcgaatataaaaagagagcctgttcatcccgaaatacgaggtatacttgcgaagagaaagggggccgataatagtgtttctacgcttacaaatgcattgtacaccgaatacttgaaacaacgtaataacaaaaaaaggcgaacaccggattttaatgacgacgatgatactttatttttggaagagtatagaaggaaatacccgaggattgatacttccagatacataccgaacgagtcttccgaagttagcttgttaggaattgtagattcttatttaaaacatcaggaaatagttttggatacacttctaccgcaaacggtatcgaatcaatggagaattaataatgattatattcgtcaaacgtgtactatagtggaagaaatgaacatccagcagaggaaacaaattaacgatttggaaatatacagaaagaggttataatgtcgcaatggacctttattattataaatgtggcggcaaatcgtggaaggatattggatcgctcgccatagaagtccttagcgcgcatgtacaataacatagagtttcatcttggtttaaaattcataattttattaattggttacaaaaaaaacatagatatgagtatataaatgtattatatttcttcacaaactaattaaattatttgtccaaaacatcagcatcgtacttttgcttgaaccaagagacggtgtcttccttagttgtcttgtgggagttaccaacggtacccttacatctctttcttctagtgactctagcacctggtctgttcatgacgacatagaaatccataccgaaaataccgatggatgggtcatacttgatacccaagtcaatgtgttcgtcaataccgaaaccgaagttaccggtagcagagaagtttctgtctctcaattggtattccttgaccttcaaacctctttccaaaatttcttcagcctttggacctctgacggtaacgtgaacagcaattttttcgtttcttctgataccgaaagttctgacagtgtatctggccttggattgaactggagtttgaccagataattgctctaaaaccttggaggctctggtcaatctgtcaccagattcaccaacagaaatgtttaagaccaacttttcgatcttcaaatcacgcatagggttttgagctttggcagacatctttggctatgtttgtatgttcttggttcaccttcccttccactgaaaaaaaaataatattagttgaaatacaataaaatatgaactaagaaagaagcctgcggttactatcaagatgtatcaaacaatgaaactttcgcatagctgagtggtaagtgggctacctttgctagtgaaacaataattccctgcaaagtgaaaaagttcgattggaaactggtcacgtggatgtgagtctattacccgtagagtctgcgcgctgtttgcgtcgctctctgtatttctatggatttcaccgttcttttttcatttatacaaaaaagacagaacttaatgaaataatcgcatcgtcagtacacccatacctttaggatggttggatgttgcgctgtcgcaggaaagagcctctccgggtattatgtgatatgagggaaaacagcaaaagggtggcaaaacgaagaatagcactccttcaataatgcaaggtgaattgtaaagaaaggcttcaatatatcaattttcaaaagagaataacaaatttactattaaattgaatagatagaaagaaaccagaaagaaaagaaggaaaaaaaaacaaacatgcaagctattgccgatagtttcagtgtaccaaacagattggttaaggaacttcaatatgacaacgaacaaaacttagagagcgatttcgtaacgggcgcctcccagtttcaacgtttggcaccatcgcttacggttccaccaattgcgtctccacagcagtttttaagagcacacacagatgattcacgaaacccagactgtaaaatcaagatcgcacatggtactacaaccttagcatttagatttcaaggcggtattattgtggcagtagattctcgtgccactgccggcaattgggttgcttctcaaactgtgaagaaagttattgagatcaacccatttttattgggtacaatggctggtggtgcggcagattgtcaattttgggaaacttggctaggttctcagtgtaggctgcacgagctgagggaaaaggaacgtatatctgtcgcagccgcatccaagattttaagcaatttagtataccaatataaaggggccggtttatcaatgggtactatgatctgtggttacactaggaaggagggcccaaccatttattacgtcgactcagacggtacaagattaaaaggtgacatattctgcgttggttcaggtcaaacatttgcatatggtgttctagactctaactataaatgggatttatccgttgaagatgctttatatctaggtaagagatctattttagctgctgcccatagagatgcttactctggtggttctgtaaatttatatcatgttaccgaggatggttggatatatcacggtaatcatgacgtaggtgaactattttggaaggtcaaggaagaggaaggatctttcaacaacgttattggctaaatagaagcatcaaacatatgtatatgcacatctatattaatgatacattattctcttcaaggatccaatatggcttcccatagaattatgaaggaagtccagttctcatgtttccaatcatcacatctatatatttttatataattatatctttaagtattgttcggtaatatgaggacagacgccatcaatgcaaacaaaaagtgaaacccgaaatcaaacgaagtgaataagtagttgtagaggcgacccgatggaaaattttgtaaaaatcgaagactgaatctcaacaacgcaaaacagaataggacgcatagattcatacctattactatggcttgatccgatctatctttatgaaaagatttatgcttctacttcgaatatgctaatactattatcgaaattttttaaagtttttcctcaagggatacatttacttcagtgataccctcgttgatatcctcgctgaccttccgccttttagaatcatgaccttcttcgtcggtttttgaaatctcgcgattatcattgctactattctcgtctttagatggaatatcatctttagattcgttgtttttaatactttcactatcgatcttttcgtttttgttgttcttttcatctacttcgcttccactatcactttcgctttcgctttcactactagtgctgctattatcgccgcttccactagcactaccgtcatcgctaccactatcgctctcgcttccgctctcactactggaactgctactactactagtgccgctttcactttctaagtcgttgtcctgtgcaggcttaggtttgggttgtgcatcaacattttgagaagcagccgccggaactgacgtagctgccacagaggatgtagccctagcattttgtctcggttgaaaaaatcgagacaaggacgaaggatcaaacgatcccggttgtttatcatgcaagtaattattgggatgggatgatgccgacgcagataactgagatggaggcctatctggtacatgcggcgtctggactattggttggcgtatcggtttggaatgctgtgccttagctgctaaagccgccgccgctgtagtttcagggttcactaattgctttacctcaccttttgtgacttttgcagttgccgcgtttacagcagctgctaaaattagattcaaatgctgaggattcttgtccatcaaggctgtaagtggattaccagtaatccccttgttttttgccgcttgtgtaacctgatttattgtcatagctagagcctgcgtcaaaattgcagcgatgacctgcttcgataaaccctttctatctcgtgttaaaatgacaagctgttcctgcagatatttcattgtcctttgattatcacttgctgtatttttcctgttcgaggcggctctgtttgctgcaagagtttgtgagatgttttgttttctcgcattaacgttagatctctgcgaaacaatatcttttttgcccctctgcggcacttgctgaagtttgtgctgttgctgttcaagttttaattgtgcagcttgtgcctttgccacagctatctcactttgtttctttttctgtcgttccctctctgcaatatattcttcatcaagaccccataaccatcctttgccttctttagaaaccttcctgaaagatttatttagcgataagttgtgtcttaccgagctttgccacccatcaggacagtatttataataggggaagagttctcttattcctgcataaatttcagataaagacattcccttggcagtcgagtactttcgtatgcaagtagttagcatagcagagtaagatacagtaggtttcgttctatattctactggaatctcctccaaagtatatactttctttggtattttcggtggcttcttttctttcttaacagctggtttggtctgcgctttcttgggctttgctccagttgtaatctttttcttagatttgggctcgttttttttgagatttcttgtatttatttcagattctgctatgtcagcgttttctgggcttttgctatcgtcgttacgttcttgttctggtaaaataaattgaaatggaatttgtccaatttgaatttttgtcttattacgaagtggcacagtatttcctttttcaacgaaaatgtcatccacaaaagcaccattcttccctattatggacaattcgaaccttcctgtcccaaaattgtaaaaaatctgggcgtgtctcctcgatattgattttgaaggaccaagattaacgtcaactttgtgggagaagtcattctcagacctccttccgattattgcatgtaatgtttgtacataaaatgtgaaactttgaaagtccagccttgcataggcgaagatagtcggttgttcattcggtagcggtaaacttgcatcgattggctcagatagttttcgttgggtagtttcagcatctgtactattattttccgttacagtgttttgtggcggttgtcccactaattcatgctgctgaaacattattggcgttattgaattgtttctcatatgcagcatgttgtttttttcatctactaatgttggtagggtctcggtatctttgtttactgataatttatgcacatctgtgtatatagcatcagcagtgggttcatccttttgtatacttgtatcttctgagttccttatgccttcagttttcactgctgctgtgttatcttgagttttctccctttcgtcctcatcagggtttactggctctatattgatatcttcttttgatgaaacctccctgctgtgatcatgagttaaatcgatgttatttacaggatccatggtgtgggataacaactcatttgagttgaacagagcttcatcattttttgcatcaaattccagtagcttcgaaaaatcagcgttatcaaggttatcaggtaattcaagtttcaaatttccattatcgtctgtaacaggattctctacctcgttttcaatatcagtagtcgtgttttgaggatgtttttcctctgttactatatcagaactttttggtagttttgtttcaatcggtacctcgcttgtcggtgaatttgttatgctttctttggtttcttggtctttcaatgcggaagaatctatagtaaactgtgtttcagtggtaggcgatgaagtcccgacatgattgctgctttctattattgccatttccccatccatcttattcttatatttgtatagatatgagtgggtttttgttttgagcggctagacgttaaatcaggtaaaaaccagtaccaggtatattatggtaataaaaaaaggagaaaataaaatgctttcaaatacaaaattaatattcgtgatgaccttctacaagagaaaaaaatgtgccaatagaaaagtcctatttatccagcccagaagataatagcaaatattaatagactttaaactaactcaaaggatgacaaagttggccttagagaaagagctactcctttcttagcttggtgacggaatatatttcaaaggttcctttgtttattttttattaacgcttttaatttttcttgtcttagtcttcgtaatttccagttaatcgcaacgttcagaatgatagtatggcgctatcatgttgtgctctttcataagaaaaataagaaatgtattaacagtcaagagtatgcagaaaaggtacaacagccaagattatgtttgcgtttatatgaaactacttagtattcagctcgtaaagcttatgttatatttactgtgttctatcaatcttcatatttctagctttaattctttcctgagagtttatcacccaatcgaaagtaccattgaagtcatccttgatatcacctgtagtcaaatcaaaattgtcatcatctaaaccgagaagcaacacgatttgtgtcaatttcaagaacttctctctgagattatagttcaagccacacatattgccgatgaaaaggctcagttctctatctaatttcgtaacaccaagttcattgaattctagagtccatattctttgctccaatgttgttacgatgtagtcgactatgacagatagcaactctgcatatgcttcgttgtgaagaatatttttgtaagggataatcaattggttccatttgctattgaaactgttaatttgcgacaaatcttcgaaatcttctatgcttgtgatgtaattcttttggttcgaacctgcagaataatcgcgagacacatttttttgattggacgttgaggaatttgatgaggctgaattaacaaaaacagttcccaataagttccgaaccctattttgtaggatattttggaacaagtatttgacagcccatttgcttagcttatctgtttgttccaggactaatttttctgagtttataattaaattctgtaactgcgctgcatcattgtcaaaagggaaattgtctctcaaaatcctttgcgaatcgtcttctaatatttctatggataacagcctgtgaacgtatactttactcaagtacaacgtgttcagatatatcaaataatggtgcaacgcaagaatggaatcctcgtcctctgcaactacggcttgtaaatttgattgaatatttgtcaaagcgctagctgctgcccctctaaaagtgaacctgcttagcggagaaaacttatttgcaggtggagaaaccgatcttgatgttgcagattgctcctcaccttttggaatgtatcttttcaaagatacattggaggctagtttcgattgtagtaacttaaatttgttttgcataaattttaccagaaatcggttctgaaaaaattttaccaactcgttcaaaaaacttgctaagagcttaaactggccagtattaaccactgatatcagatttttccgaactaataaaattaagtcatctaaaacagatgttacagggtatgaaatgttatcgtggtcattgaggggaacagcagttataagatcgttcagtgacggtaattcttctagtgaaatactatttctaaatgatctctgcagatggttcaacacaaacacctgaaactcatcaaagaccttatcttgctttaactttaaggcaaatttaccatctgctattggtggaggtggttgcaatacatgcggatgcaaatcgctaaattcattccatttaactgaataaaatctagaatacatggaccaattttgaagtatttgagaaaattccattatcaataatgccaagtcatgaatggatataattgagctcttttccgtttctccgtctgtttcgatatccgactgattactgtctatattcacatcttcattcttttgtgaatgttcccattcatttatatcatgtatagtcctttctattttcctcgtctccataaaaatatctagaatcaaactagcttgaagatcagcttctttttctactttttccatgacatgcaccatgtgcttttttccataacacgtggcgatgacttttgaatgatcatttataatggtcgatacaattttaaaaagatgtaacagtacttgtgaaaaaaatccttgaaacttggtgctgttttccatagaattcgacataattttcctgctttcgtccgcaataatatcacagacatatttggaatacaggtctaaaccaagtacgtcctgcccaatcatagggaacattttgaacattaaggttagctctttaatatcctgtgttcttgttgcttccatgaattgctcctgaaataaacttgtcagttccttacaccaattctttattagtatagctggttcttcgggaatttcactcgagggcacaactttcttggcaaactcggatacaataagttttttatccggaaggcttctaatttcattgattgctgtcgcagcaactaagtaatcctttgtttctaaagcagaatgcgccagtgaaatattattctttagcgtcctgacgtcttttacaaattgtaacgttttgttgaccaaagcgcgttcctgatctacagtttcaatatcgtcatgtatagcttttgctcttgcgttcgaagaagaaatggtggccacagtctcatgaaactgagtcaaagtagtcgtaaggttagttctttgcaattctaatttccgggactctttgttgagcgatgattgcgactgttgcacaaatgcatttaattgtttagattgttttgcgtaatcattggctatcacttcagacagcttgtctatttgagatagtgtcgataatttgtctaataacaaggtgtaccttgctagatttttagacaattggccctcgatgatcgagctctcccatgatgcattcgatttttgcccttccatcaaaacttcacccttttagagcctgacaatacagtatcgttagtttgcgctacttcgctgtcccaacgaatttggtttgttttctatgttctatctctatcccacacttttttcacaattcctttacaggcgaaaattcaaaaaagtgacgtaaatggagttctaaaagctaaagcaacaagttaataaggttagaagatcgtaaatgtgtttcaaaagttgcttacctccttcactatatctcagctgcttgtatagcctatgacgaaaatttatgttccctagcaaggatataatgtgtcaatcaacatgatcgcaaaccagctagattgtgatgtatgggtctatcttattgtttattttgactagcattgaataaacaaaaagcgctgctaatagattcttgcctttatataacggggatctaacctcatcaacagcaaaaatcgtcttaaaacacatctcaaagactagttctcaaacgtcacgctatgaacagtacacctcctacgtcacccgtcaccagggtttctgatggttcctttccatccataagtaacaatagtaagggttttgcttatcgccaaccgcaaaaacataaaagtaacttcgcatattcacatctggtatctcctgtagaggagccgacagctaaattcagtgaggcattccagacagattattctagtaaggcgcccgttgctacctcggaggcgcacctaaagaacgatttagacgtattgttcactaccccccggttttactctccggagaatttggctttaatgttccgtctttctaatacagtttcttccctagaatttctggatgagtttttgatgggcatattacttgctccagagatggattttttgtcaaatccaagttattctcttccgtctaacaaattagtgggacagggaagttattcatatgtgtaccctatatcatcaagtgcttcatcaagatgtaacaacgattcaggggttgttttaaagtttgccaaatcacagcataaaagcaaggtgattttacaggaagctttgacgctagcatatctccagtacatgagtccttcaaccaatgaaagtcatattattccattctatgggttgacatacataactaaatcccattttagaagactgaggtccaacgaatgtgttcctggccttattcttccgaaatgcgaaatgagtttatatcacttcaatacagcagtgtcacataagctttcgttgataacaaaaagaaaaatatggtggagacttatgaagcaaatgatagacgcattaaaatctttgaaaacaaatggtataattcatggtgatataaaaacagcaaatattttaataacagaaatgcatgttcttaatggaggccattgtaaggattttgacttctaccttgctgactttacgtcggcatttcacattaatcaaacaccaacagatctgaataccacggtagaatactgtgcaccagaactaattgatagctcctccgatcatgttcctacatttgaatcggatttgtatgccgtggggctttgtcttttatcatttatatcgcagcatgagccttacaacgaacttcaggcgttagtgtcgcatggatcctctccaggtattggcagttcatctatacagcagtcccaatggctgataaatgctcttttgaaaaaagatcctataaatctaaacatgttaagaaacgatttattccaggattggaagtcagaactagcattattgtccagaattctggttgatagacttcctctagaaaatctcataactatactcgatagtaactatatatgataatatacatgtctatgaaatcgaaaacccccagccatgcatagatcaaacttcaccgtttataattgcgtttaaacgcctttccttttcttcatccattttcctggtatttatctcatcgtctctcttaattcttaatttactaccttcatctgggattatgaactgtggatgttccatatcacattcatccttccctaaaggacaaaatccggtcatgtatctttgacagaaaaccttcttaatatgccgtctaggacaagaactccccagaggacagaatcccatttcgtaattttcacattttggtatcttgctagcgggatctatgtgtagatattgacaatctggactttgtgtacagtacccgtttttgctgaagaagacacattcaggcatttttcgaagattgtattcatgtaagtattcacattggtcattctttttgcacaaccctcgaagccaatgtctacaaacaattttattctgaaatattggtaacacatgcttttttggacataacggtcccctcggacatgatttagggccttctctagaattgtaaaattcacaaataggtctgtcaggatcgagtgaaaacgaatactcttgcctgaggaaaggttcaaatttaaaaggatattttgctgtatcggggtgaattaggctcattacataaacttattgattttattcgtcctagaatacttgtttaagatacagtgcagaaatctttagcttataattcagaaatgtgatattttgaagcgattggaacaacaaagtacagtgcattctatataattattaaaagttatagtggactattgtaataacacttgttttccccatatcataaccgacggcgcgtaaatgcatgctcaatcaagtttccgaataagttaagtttgccacccattgaggattaatatacacaaggcagcattgaaaaacctaattgttaacactacacaaatctctattgttgtagtaaactgcgctttttaccactgttacaatagttactaatacacgcaaaaattctggataaacacggcaaaatggtagacgtggaagagaaaagtcaagaagttgaatatgttgatccaacggtgaatagggtgcccaattatgaggtatctgaaaaggcgtttcttttgacacaatcaaaggttagtattgaacagcgtaaggaagcggcagagttcgttttagccaaaattaaagaggaagaaatggccccttattataaatatctttgcgaggaataccttgttaataatggccaatctgacttggaacacgatgaaaagtcagattctttaaacgaatggatcaaatttgaccaggagctatacaatgaattgtgcaaaaaaaatgaaagtaagattaaagagttaaatgaaaagatccaaaaattggaagaagatgatgaaggtgaactagaacaagctcaagcctggattaatctgggtgaatattatgcacaaatcggtgacaaagataatgctgaaaagacgctagggaaatcattatcgaaggctatttccacaggcgccaaaattgatgttatgctaacaattgcaaggctggggttcttttataacgaccaactttatgttaaggagaagttggaagcagtcaattctatgattgaaaaaggtggtgactgggagagaagaaatagatataaaacatactatggtatccactgcttggccgtaagaaactttaaggaagcggcaaagttattggtcgattctctagcaactttcacctctattgaattaacttcctatgaaagcattgccacatatgcatcggtcacaggtttattcactctggaaagaacagacctaaaatccaaagtcatcgattcacctgaattgttatctttaatctcaacaactgccgcactacaatctatctcgtcgttaacaatttccctttacgcgtccgattatgccagttactttccatatcttttggaaacatatgcaaatgttttgattccatgtaaatatttgaatagacatgcagatttctttgttagagaaatgagaagaaaagtctacgcacaattgttggaatcatataagactttgtcgctgaaatctatggcaagcgcatttggtgtttcggttgcgttcttggataacgacctgggtaagtttattccaaataagcaactaaattgtgtcattgatagagttaatgggatcgtagagaccaacaggccagacaacaaaaatgctcaataccatctgctagttaagcaaggtgacggtttgctaacaaaattacaaaaatacggtgcagcagtgagattgacagggtcagatcgtgtttgaggaatttacattatttagcaacgcacataatcacatcaacatgtatacatagtttggagacttgagtaaatagtagtgagaggatatatggatcggttcaagtcaaaggattgtaatcatcctctttctcctttaaaacggagagcttctatagttttcaagcttccattaaaaatttcagtatttagttcggaaagttacataattgcaatgtctcataaaggaccatgcttcttttgaaagtgaggaatctaaggctgaaaatgccaattcttaaaaagtagtataaccagaaaaaggaatccccataaaaggaaattcatgatacggtcattgtttcttcatttgtttaatacgttgtattcgagtgttctagccaataaacgattcaactaaaacacttctggttcgcttttagggatatcgttgaaatgaaatcactccatgatagtttaagtgttacagacattaagagaagtcggctgcaaatttccatgcagacactttgtcccttcttggaggataccctacagtgtaaaagcctccttagcttagtggtagagcgttgcacttgtaatgcaaaggtcgttagttcaattctgacaggtggcaaaattttttccctaaagttaacacttatttagcttctttttatataaaaaatccatgagaattgattctgcattttagtttaaattttttctttaagactatgatgctttcatgcacaaggttatattgttctccttctctatagttattgcaaggaaatcatatataacgaaacacaatttgatccttttgaacctacattatcccgcactcttgacgtatcatcaaataaagctaaactgcggaagcctaaaaatactaagcacgctatttgtcatccattagcaggccaaaagcaaactaatctatgttttcaataaggccaatataataatggataattttgaaagtactgctgaaggaaatttaagtataggaaacaaacgagtatacgaactacgaaaaagaaacttccaaagaaatttggtgaataatttgagctttctcgggtatgttttaatatcattggaatatatcaagtatgatcgtaccgtctggacacttataacaagagcaatagtgcaatctctcataagttctccttttccaagtgatgccaagttacgtaggctagcgaccctcggtgcagataataacacgacgggggttgcaacacttccaggcggaagatctatcaggtttcccggaatgtttggaacagaaatgctttataattcttctagtgaagctgagcaacaagaccatgatgataccgctattgtgtccatgaaaaagcaaatccggaagtttttatttcatggttgcttatcgttgaatatgcttttcattatcttaacaatcctattcccaattgatttttttgaacccctgagtggtagcgagccagtagacgatggccctaagaatactccctcacccttttccaattcagatggtctacttttgggtgagagaagaggtgggctttttctacagatgatcggagaacggctaccaaagagcaacttttccggcaatcttggattagtaatgttcgaatttagcatacttattgtacagtttactttattttcactaacatgtgttgtattggcagatttagattttgaagagccagaaagactagaacctgtaaatagtgatggctacgatggctctgtaatagttgcacgaataccattaaataaaaccatgaatgccattttaaatgacggcaatattaatgacaacaatgagaatgctagcaattctgtctaatagtatatatatgtagtccataaggggtaatgcatattactgttatcggcactattttatagagagttacatttacatatatcattctattacatttccttatctatgacgattcatgggtttgtatttttttggtaggatttgccaattctactaatactagaagaaaagattatacaaagataaagaccctgaggttaagtatttaatatttttctcaaactgtgttttttttattagtatgcaaagtaggatcattgggtaattggacagtttttcaaatactcagccttattctttaaaatcctgacggatttgaaaaaaatttcttctggtgtcatggcaccagcgctttctacgttgaaaataaagtggttcctcactcttcctaatttaactttatcagcaaactcttcgtatcttaaaacctccctggaaaccgtatccttcctagcatctttgacatacgcttcatctgaaccttcatcaataccaataacacctgggggaaaacatttttgaaatcttctggcactttcacctttgattggctgtaagatattgatttgaggtaataatctataagaagcggtggaaactggtgaaaatttagcatgatcaccaccgatacctaaaatgcaatgtgccttcaacgaaatttcttgaccaggccttagcttagctaataaaatatcaggatcagctggaacaaccggacaatcagcaaaagtggtagattgtctgccctgtggttcaaacttcaaatcacgggcgtagacatgggcattgttatatagttcctttggatcagtagatccctttggagcatctggatttcttgtgcacttcacgttcaaactcaaaacgatagtattttcatccgtaaacttttcatcgtccggcaaattactatcaacccatgtgagcatatcagggtcaacttttaatggaaccaagcctattctatgagccaaaacctcatcttggataacggatgtattgttaaaaaaatagacgtattcagcagccacggatggaacctcggaaatcattatacgacgaaaggcattcgcaatcgatgtgtcaatgtttatcaagtcgaaatttgcctctcttgcgtctaatgacgaaatattgacttcgaagtcctttttgaatttttccacattccactcgttttctgcatccttcgagaaaccaggaaaatccgtggaggttgtattcgttacacggttatattcaatacccacaatatttgacatatcttctttcacctacttactttcatgcacttgatacctgctcttctacataatatgagtgaaattttttctttcaactcatcgcaataattttttcacaaaatttttgtgaatccaagtcactataaacggaattaataaatatttgcaacataaagcacaatgtattgtagcagaagacaaacgacaagtatgggataatgcaacatctctttctaattaatataaaatcaagaataagcatgtcttctgactaatttttatatacaaacaccaagatcataaatttttgtctttgaatggataattaacccatacacctcatacaagattttgagagtaaacacaaatcaatggacctgtagtcggctagatcacagatcatgatgaactgtattgtcgcaacaaacttgtaactccaatagtgattagcaacccagaatatcgtattcaacaataattcggtagtcatgttttcacgaagtgatcgagaggtagatgatttggctggtaatatgagtcatttagggttctatgatttgaatattcctaaacctacttctccacaggcgcaatataggcctgctagaaagagcgaaaatggaagattaactcccggacttccaagatcatataagccgtgtgattcagatgatcaagataccttcaaaaatcgcatttcattgaatcactcaccgaagaagctacccaaggattttcacgagcgtgcttcccaaagtaaaacccagagagttgttaatgtatgccaactttactttctcgactattactgtgacatgtttgattatgttattagcagaagacaacgtacgaagcaggtgctaagatatcttgaacagcaaagaagtgtcaaaaacgtttctaataaggttttaaatgaagaatgggctttgtatttgcaaagagaacacgaagtactgagaaaaaggaggttgaaacctaagcacaaggattttcagatactgacacaagttggacagggtggttatgggcaagtttatcttgcaaaaaaaaaagacagtgatgaaatttgtgctttgaaaatattaaacaagaaacttttattcaaactaaacgagacgaatcacgtccttactgagagggacatactaaccacaactagatctgactggcttgtgaagttgctttatgcatttcaggatccagagagcctatatttagcaatggaatttgtacctggtggtgattttcgcacattgttaataaatacaaggatattgaagagcggtcacgcaaggttctatatcagcgaaatgttttgtgccgtgaacgcgttgcatgaacttggttacactcaccgggatttaaagccggagaatttcttgattgatgctacagggcatatcaagctgaccgattttggtctagcagcagggaccgtatcaaatgaaagaatcgaaagcatgaaaatacgcttagaagaagtaaagaatttggaatttcctgctttcacagaaaggtctatcgaggatagaaggaaaatatatcataacatgaggaagacagaaattaattacgctaactctatggtcggttcgcctgattatatggccctagaagttctggaaggtaaaaaatacgattttacagtggattattggtcattaggctgtatgctttttgaaagtttggttggatatacaccttttagtggttcttctactaatgaaacttacgagaatttaagatattggaaaaaaactttaagaaggccccgtactgaggatagaagagcagcattctcagatagaacctgggatttaattacaagactaatagctgaccccatcaacagagtacgatcttttgagcaagttcgcaaaatgtcttatttcgcagagatcaattttgaaaccctaagaacaagttctccaccatttattcctcaattagatgatgaaacggatgcaggttatttcgatgacttcacaaatgaagaagatatggctaaatatgcagatgtcttcaaaagacagaacaaattatctgcaatggtcgatgactctgccgttgattccaagcttgttggatttacttttaggcatagagatggaaaacaaggttcaagcgggatactttacaatggttcagaacattcagaccctttttcaactttttattaagattacgtccctacaatttaattttgtatagcataacagatacattgacaacagcaacaagatgtgctaacattttccattttgaatgattaccaaaattatgaaaccaaggcaacatgtaatttttaagtttagtaatctttttcgggatgagatgttttgaagagttttatgctattaaagtagtaatatgatttatatattcaaataaaatgtaaattatgaaagaaaaatacgataagctgatagggtaaactagaaaccttcgttttcttcatcatccacatccagtttctttctaccgcccccatttcttaaggcagccatctcattagtggcaacttgctttctaaccttctttgtcatcctggctatctcttcttcagcgtcaactgcatcttcttctgcatattgcattaccaatctgcggcccagtaaatggacaccgtgcaactgatccatagcattttctgcttcctttggaagtaaaaattccacgaacgcaaaacctcttgcagacttgtcgaacttctttggaactctaacagattttaattgaccaaaagaattgaataattcgaaaacgtctttcctagtagcttcaaatggaagattcttaacaatgattttaccgcttttcttattggatttagtctttgtattaccgctctgagatgcttgtctatgggataacttcaattgaatcttatggccgtcgattaccgtcccatccattgcagctatcacggcattagcttgttccttggtcctgaattctacaaaaccaaaccccattgacaaggtcttgccttgatgttttggatcaggttttgtcttcacttgggcaacaacaaaaccagtgaaaaccttgaacctatcagtaagattttggttcgtcgtggagaagtttagattctttatgaaaattgagacagttggaccatcaataacgtcttcatcatgagcattagatgacccttcagttacatccttgtttgcttccattaagtcatttgatgaaggttttacctctaccgggttttcttcttcttttgcagaagtgttatttatcaaatcatcggcctcagctggtttagtaaagcaatccttaggccccctttctagatatattatgccgtccttaaatcttttatacgatagtttagtgaaagctgcccttgctgacgttgtgtccctgaattgcactatagctattgtaccagctggtggcatgagcaatctttccaatttaccatatggcaaaaacatttcgccaagctcttctctagttgtcccaaaaggaaaatttttaaccagtatcactttatcgtctctttgatttgtagattttaactgtgaaaacttggtcagatcaacacctttggattcaaagtattttctaacatcaccaataacatgggcttcagccaaagcttgtttgacagccgaacttgagttttcagcatcgatcaattgagatttttctagacccaatttggctgccacactacccaaaacagcatcttggttcatatacaaggagttccaagaaaatgtttgtctggatgcagctgccttccttttcaattccttttgctttttcaatggcatattctttaaatcaaactcatctaatctatggctttttttttcttcaccaggaagaatatgcaatagtcttccttgaaaaatctgtttatccaattcaacataggcgttcactgcattcttagaatccttaaatagaacgtatgcaaatcctttggattgaccagtcctggtatccaaagccacatgaacctcctctaactctccaaatggactaaatagtttcctgaaatcttcttctttggaggtatacaagatattacgtaagaataaacggccagtttggttaattttttcaatagccagttcttcgtccgtcttttgcggcacagcacgttctggttgttcttccttcttggtatcgagactttcattttgttcagtagcgtatgatgatgatttttcccttgtttccgcttcactttctttgattcttacacggcgttgtttgaaccaatctaggtcagaaaccttttcatcttgggcgaggtttctcctcttttcattctctttttcatcactattagcgtcatcattaactaaacctatatcagtatccttcaaattgctaatacttatcatcttttcttcctctccggcatcttcttgatcttcatccctgtttctgttgagagccgaatattcatcgtcactttcattctcaatgaccaaatttggtgcttcgtctttattattctcttcctttaaggctaatgcatgagccaatagagaattcccttgcacgctggagtcctcttcttcccgttttagtttttcgtcctctatgctcttgtcaatgccaactttttcccatgatgtgacttgtgagcttggcttcatagtctccatgaactcttgtaattgcttgttcttgcgaatctcgtcatcaatgttgctgtgcttattttcatccactttctttttctttcgattttcttcttgtagcaatttttcttccttttccctaaaccttttcagagcttctcttctcttctccttcatgggctgcgggactcttgggtctgcaaagcttttagccatggacacttctatcttagaagtgttgataaaactgccattgaaatactctacagcatcaaaagcgtcttcctcgttacggtatccgataaatccaaatcttctactttctccgttcctatctctaagaattttaacatctgttatgaggtctggaccactaccattaactgcttgatgggaatgtttttgacgtaatctttttgtaaaatgctccctgagattatcatctgttagatagacgggcaaacccttgacaatgatacgggacatgttagttatgttatcttgtgcttgaggctcaaattaaatctcagttcaggttgcagtctttgcatatgaagtaccgatgagatgagatgagatgagctctaaatttccataaaattttttcattttataaaattcacgtcgctccgcacgtaaatccctattacggaaattatttctcaatagggaaagcccctcctattgttttttccgtctcgaggatttttcacttttagtatataagtaaaacataaaaaacatgagaggtggtatggtttatttgccgtcactgtggagccttcaagtaatgtaaataagagggaaagtgtgatagtacaagatgagttcgaattcaacaccagaaaaggttactgcagaacacgttctgtggtatattcccaataagatcggttatgttcgtgttatcaccgccgccctttcttttttcgttatgaagaatcatcctacggcctttacatggttgtatagtacatcatgtctactggatgcgctagacggaaccatggcaagaaagtacaatcaggtttccagtctgggtgccgttctggacatggttaccgacagatccagtaccgctggcttgatgtgtttcctttgtgtgcagtatccccaatggtgcgttttcttccaattaatgctgggcttggatattactagtcactacatgcatatgtatgccagtttaagtgctggtaagacttctcataaaagtgtgggcgagggtgagtccagattgttacacctgtactacacgagaagagacgtactgttcactatctgtgcgtttaacgaactattttatgctggattgtacttgcagttgttctcaaattctgcaacctttggtaaatggactacaatcataagtttccctggttacgtgttcaagcagaccgcaaacgttgtccagctaaaaagggcagccttgattttagcagacaacgatgccaagaatgccaacgagaagaacaagacttactgataggatgagtttcttactttttttctccttttaattgcgctaatcttttatttatgtgtagtttttatttatgtgaaatggaacattcgttgatttaactttaaaagcagcctactctatcgtcttgattatacttggcacaacaaatgctcaaataaacgaaaaatttcatattgttggtactttttctcaacgcggtttttttcctgtttttttcgagcagttcccgagggcatatttaacataagccaaggagagagaaaaaacgtttgttggacagatcaaaaagaaaaagaagaagacctctcctctatctcaagcttctgcccccccccccggaaggaattcaagcacgaaggtgaacattgcctacaagaaaaaatggatgttttattgtcgcttcctcaaccggaattatttaagaccacggtgattccgttcttggcaaatcgcaatataatcaagtcggaagcgattctctccaacttgcactcaattttttatgttgctatattctaccatatttggtttctttttggcaaatggatcttattcccacatttggttaaatggaaattggactatgaccaaaaacataacgtcaagaaagatgagaagacaacttcggaacgtcaagctcaacattacaaaaagaagtacacttctttgatcaatcaaagttcagtccacttaatatccctactgcaaagcatagtggtcctgtactactcattgaagttcttgcttgatccaaaagcctcggccgagccctaccaaacctcacactctcgagtgtttacagaaaatcgagacactcaagtcatctgtatttttgctattggttatttcgtctgggatatctatatttccaccatgtattctactttccccttcgttgtgcacggaataatctccaccgtcgtgttttgcatcggattgaaaccgtacatccaatattacgccccagtgttcttgatgttcgaactttccaatccctccttgaactttagatggttcggtatcaaatttctaccccagaaaagcaaattctgctctctactgctgctgttgaacaatttgacgctcatggtcgtcttctttgccgctagaatcgcctgggggtggtttcaaattggaaaactatgttacgacttttaccaggtgcgcaatgaacctggtttcttagtctttgacaccattgttatccttgcaggcaatttcgtcctggacatcttgaatgttatttggttttctaccatggtgtctgtggctgcaaaggtcttgaagaagggggagtctgtagacaaagtcactaagaatgaacaataatccatggaggcacactttaacatgtgcatatatgtgtatatagactataaacttgtgtaagctatgcgagcattacaaacctagaaaattacaggcaataaatcaatattgatacatggcgaatttttgtggggggggggcaggatctttgcctacattttcttctttaattttacctagactgagcgattctgccaccttcaggactactgaacactttcaatgctacttttgccagaattatactatactaccacactttcatgtgatgaaacgtgaaactctaatcacgagatttagggggaggtgtttcatatgcggataacgccgttctcgcgcaagctgattttccattgcttaataaaaaggcgaaaagcctcctacatagaggatgatgttggtttgaccgtgattgatgtccaagtagctgtggcttattgggtattctttcggaagcttttgtgatttttttgttaaggtttgagagtggttaattgagccaaatacggcgcggtacaggtaaagagagaagaatcataaagaaagctgttttctttatcctagtctactttttatggctttgtgtgctaaaagaagaaaaacaagagataattaagtggattaatagatgtctgactatttcacgtttcctaagcaggagaatggcggtatctcgaagcagcctgcgacaccaggttcaactcggagctcttctagaaatttggagttaccgaagaactatcgttcatttggtggtagtagcgatgaactggcatctatgtattccgccgactcccagtacttgatggatatgattcctgattcattgacgctgaaaaatgagccagcatctggaaatacgcaaatgaacgggccagatggcaaagagaataaggacataaaacttgacgagtatatattacccaagacagacccaaggtcaccctactatattaacatgcctatacctaaaaaattgccgaagagtgaaggtaaggcgagggctaaacaaaaggttaacagggctgatccttctgatttagatgtggagaacatttacgaaacttccggggagtttgttagagagtatccgacagatattttgattgataggtttcacaaatggaagaaaatcttgaaaagtttgatcgcttacttcagagaagctgcctactctcaggaacaaattgcaaggatcaactaccagatgaaaaatgccgtaaaatttgcttttcttactgatttggaagatgaaacaaacaaactggttgatccaagtatatctaagttgcctactaagaaacctcagcctgtcccattggccgctcaaaaattggacagcaagtacgacacagatgtggaacagccgcagtcaatccaatcagtaccttcggaagaggtagcttcagcttcttctggcttcatgaaatttgggtcaggatccattcaagatattcaagtgattttgaagaagtaccatttatctttgggtagtcaacaatataagatctctaaggaaatcttggcatatattatacccaaattgaccgacttgcgtaaggatttgaccacaaagatgaaagaaattaaagaattaaatggagatttcaagactaacataggcgagcatatcaaaataacaagcaggcttctgaataaatatattgcttcagtgaagttattagatgaagcatccacttcgggcgataagcaaggtgaaaaattaaaaccaaaacacgatccataccttttgaaattacaactagatttgcagctgaaaagacaattactcgaagaaaactatcttcgagaagcttttctgaatttacaatcagcagcactacaactggagaaaatagtatattctaaaattcaatccgcattacagcgctactcagcgttaattgattcagaagcacgattaatgatcaaaaatttgtgccatgaattgcagcaaggtattctatctagaccaccggctgtagagtgggataattttgtctctcatcatcctacctgtctgatgaatttaaaatcgacagacccgccaccgcaacccagaagattatctgatattgtttatcctaacatgaaatcgccgctggccaaatgcattagagtaggatatctactgaagaaaacagagtcttctaaaagttttactaaaggttattttgtgttgactacaaattatcttcacgaattcaaaagcagcgatttctttctagacagcaagtctccccgttcaaaaaataaacctgttgttgaacaatcagacattagccgtgtgaataaggatgggactaacgctggcagtcacccatcgagcaaagggacacaggatccgaaactgacgaagagaagaaagggtttgagttcttcgaatctatatcctatctctagtttgtctttaaatgattgctcattaaaggatagtactgactcaacttttgttttacaagggtatgctagttatcattcaccagaggacacatgtacaaaagaatcaagcacgacctcagatttggcatgtccaacaaagacgcttgcttcaaataagggcaaacatcaacgtacgccttcagctctctcgatggtgtccgttccgaaatttctaaagagttcttccgtgcccaaggaacaaaaaaaggctaaagaagaagctaacatcaataagaagtcaatttgcgagaagcgcgttgaatggacgtttaaaatattttccgcaagtcttgaaccaactccagaggaatcaaaaaatttcaagaaatgggttcaggacataaaagcgcttacaagtttcaattctactcaggagaggtcgaacttcattgaagaaaagattctgaaaagtagaaaccataataatggaaagagctctcaaaggtccaaaaacagtacatatatcactccagtagacagttttgttaacctttctgaaaaagtaacgccatcttcctctgttaccacgttaaacactaggaagagggcaaatcgtcctcgttatatagacatcccaaaaagcgcaaatatgaatgcaggcgctatgaattccgtatacaggtcaaaagtcaatacaccagccattgatgaaaatggtaatctggccatagtgggagaaacgaaaaacagtgctccacaaaatggtatgagttacacaattagaaccccttgcaaatcgccttattcaccttatactggggaaggtatgctttacaaccggtcagcagataacttaatggcatcctcttcgcgaaaagcatcggctcccggagaggtacctcaaatagctgttagtaatcatggggatgaagccattattccggcaagcgcgtattcagatagtagtcataaatcgtctcgtgcctccagtgttgcatccattcacaaccaacgggttgatttttatccttcgccattaatgaacttaccaggtgtttcacccagttgtctagcattggatggtaatgcaaacggatattttggaataccattgaattgcaattcggaagcaagacgagggtcagatctttcaccttttgagatggagtctccattgttcgaggaaaacagaactcaaaactgcagtggctctcgcaaaagttcagcttgtcatattccccatcaatgtggtccaaggaaagaaggtaatgactcacgattgatctacggcaatgagaagggcgcctcacaatcacgtctaacgttgaaggaaccgcttacatctaaaggtgttgaagctccttatagcagtttgaaaaagacatatagtgcggaaaacgtcccactaacatctactgtatcgaatgataagtctcttcactcgcgcaaggagggaagtactaatactgtacctgctacatccgcgtcaagtaagtgacactatgaaaacctgtccaataagactgcacagatgaagagcatgtcatttggttccttgataagtgtaataagcaacaagaaagtcctgggtcatgttcctgctgaaaatacaaacccattaactaccggaaacgaagaagattaagacaaaatggaaaagttaagttaaacgcaatcagttcatatattcttagatagttatcatgtttttataagtaaacaaagtagtcttctaccaaataaaaatagattcctgattgggtatttttcagaagtatcatctgaacttgatgttattttaaaatgaaagccagcgtccataattatctttttcttacttgttttttacagtggcggtaggattggcaatgcctgttcatctccagttttccggtccgcttacgacatcggcctttctataagacaggttggcaatgcgccacggtacatgatgacgataggagccttcgaataatattttgttgtgaattctcctgggaacctctcaaaatcaaatatgggtttacctaaatcggcatataagaagttactcatagattgtccaacgagagtcattaataaaaactgtgcccaacgagtcaaagatgtttctccgctcattacaaacttcgagaaatggtcggataagcgcaagaagctctatttcaaagatgaagaggaaatggtggggcagttccatttggaaaatttcaatttaaaaaataacttatatggtaggcttttagcttctccaatgagagcagaaaaaatctcaaaattaaaatcgtgtagagaattactaattccattgaaagtggtaccatcaactggcaaagatcagcatgctgataaagataaactaaaactggtacctacactagattattccaaatcatacaaaagctcgtacgtattgaattcagcctccattgtacaagacaacttggcggctgcgacgtcatggttcccaatctcggtattgcaaacatcaactccaaagagcctagaagttgattcctctacatttataacggaatacaatgctaacttgcacgcatttataaaagcaagactttcagtgataccgaatgttggaccttcttcgataaatcgtgttttactcatttgtgacaagagaaaaacacccccgattgaaatacaagtagttagtcatggtaaagggctaccaattacacagtctgtctttaaccttggttatctccacgagccaactctagaagctatcgtgagtaaagatgcagttactaatggaatttacctggatgccgacaatgacaaggatctcatcaaacacctttatagtacattattgtttcattcagttaactgattgcggaagaaaaaaggaaggaaagcgggatatatcgctggaattgtctctctgaatttgccattattcttattcaatgaatacaaaactggctgtcagcgaatggcatcattttgcaatccgaaaatgaaaaatttgggcgcctcgggcaggagaattcagaacccttaatcccgcacatctacgtaaaatatctctgaggtgttctatagtccatcacttaccatccatctgcaaggctgtatgattgataaagaggaacattaagggtaaatagatttgttgatttgtttgcactagtggctttgtattaaaaacttcaagggcatacacatgcattatattcaagagcacaaccaataatttaccattatagaaggtacttctttgaaaactaaatcatacactttttcccacgaaaaggcttacatttaaaagctaagcattcaatttagttttgctgatcaatttctcgagtaggcttgtcatccataatatctagtagctggagtatcctgtttattgcaagaaaaaaaatctacaatgtctatgttaccgtggtctcaaataagggatgtgtctaaactattattaggctttatgctttttattatatcaattcagaaaatcgctagtattctcatgtcatggatattgatgctgcgccattccacaatacgaaaaatttcatttggatacttttttggtacgtcaataagacgagcgtttatcttaactgattttgctcaaatatatattggcaagataaccttgcgaataggttggaaacccggaattgtgtttcataatgttgatttgaagttatttgggaaggacagccatatcactgcacattcaactaaagactccagaacatatttcaatccgcgggatcaaacttttacctttgtaattaacaggcgagtcctatcaattttgaaacttgtgttctcattttccactttctttcatactttagctcttacagtgcctaatggaaaacaatataaattaaatatcggatccataacgatatcacacccacacgatgataccataaagttagaggcatttttgcatgattttacccatcctgaaacgaaagatactttgaaccatactggtttttttatggtctgtaaaattggaaaggaagatgatacaggcagcaactgcacaaaagttatactaaaaaattggaaatcaagtctcaaaataagtgatgtttgttggcatcttccagagaagaaagggaagaatttgcattcggagcctgttgagcctttttctgctggtgatgatgcggaaatgctcacttcatatcgtaagatgctaaagccttttcactacccactgaaaactttgaacattctggaccttaaggtagaaaatgtaaagttgatttacaaaaaaaagtttacaattcgcatatcaagtgctcaactttacttggaatcaatctccattctaaataatgtctccgctttggaacttttacccttaaataagcccacatggggcgattttgaactatcactttctgcaaatgctgttgtagtagatatcgatggtaatacagcagttagaattccatttggaaatgtcatactgacgtcagatattttactatttttacttgacaatgtacctttacggagaacgaaggtatcttccattttgaacattataaatccttcagtattcctcactatacatcaagtactggaagttcttcatttagtggacaaattcgatagccctgagacctcatcatgtactaacacaaacgacagatcattaaatattttagatttagatattgatcgattgcccagttttaactttgaactactaatgtcgaattttatttcaaggctgcatatatcagatgaggagaatgtgacgtttaaggtcttcagcacacatgctctctttagccgtaacaacttgtctatgactcctaaaaagggacaagtaatgcaaatacgtccggattggccatttgcgaagacagccctagtatctgatcaattatctaactatattaaaattgtgggtacatcactctcttacctgagaattccaacagagcaggacgctaacccagtgtctataccagtctgtggctttgaaagattagacacatttctggatgaattttcaaattctaaattgatcgttcagtctacactaagacattcgtacgttagtcttgagaacattgaagttttgcatactttaagtcgcgcctttgacaaaatttacttgctaatatctagcagaacaaaaaggaatgcggctcataaagcgaatggtggaaaattgggggacctaaatgaagccaagaaaacatttaactggtcattgaaacttagaatgaaggatatttcatgttcgttactggtcgctgggtttcttccgaaaaatttggatcctgtggaagctgagaattttaacttatctgacgtaactagaggcgccaaagttgtttttacagaatcaatattgttagcggacagccaggagaaaaacttcactattattgatgcatccgtatatcgtttcatggatggcactacgtataagccctctcctgaggttattattcaatttaccaatttgttattgagttttaacgactcagatgaaattcatttttcacttcccaagattaaatttaagatggatgtaaatattatctggttgtggttttatattcggagtatatggataaaatttcgtcctaattcaaaattgagccgaaattcagtgagcagtgtaaaatctgtcaatgttctcgatagattaagagtagatataggaaagatgattatagagctaacgcttcctcataatacagaggtactcctaatattcgagaggattggactttcaagttccactaaaaatcttacaattgcatctttgtcagcgtacgtggtatcggtttatgtgaagcatattaaggtttatgtttccttgctaaatattaatgactttgagctagacactgaagagttgatctgcaagaaatccgctgttataaacacctcattgattcattttcatgccgaatatcattttagattttacatgataacggataacatagtcacgttgtataaatcgtttaagcaaattaaattggcattttccaatttgaatgaatttaagcgattataccctcagcaacagtttccgaaaaaagttccaaatttacatatttgttgccaggattttctaattgatattgaagaagatccttttgagcaggagttaggattaattttgaaagttggtgttttggaacaacgtgagaggttaaagaagcttgaagagttcaaggaaaagctatcaacatatgaggacatgaatgtacgtttaaggtcgctctatgatacctcccgtggacaaagttttttcccagagttttatgcgaatgatcaagaatatgagcaaaaggcctatctcaggttgttagaaaacttttcaacgtcatggattgccagatacaggaaagcaaaactttctttttatggtatgccttatcgggttatcagccgtgaagagcttggtacgaaataccacttgtttactagacagaaaaccagtactgttgctaacctcgtcgtaaaagatttggattttaaactaggcagtccttccttccctttagacaattatatggattttgtttaccagtatggaaaaaaagttccaaaatctacggagtacactttgctaattattcttggcctcaaaatcaaaagcgcgttatgggagttgcgtctgagagattatccaatacctgctatatcatttcccgacacatttacaacaggtgatgttgtatttgctgaaaagatgccagcaccttgcgcgcttcatactgtttatgttccttttgtcagctctgcccaaagaagcccctataatgacgccaatacaatatatggtttgcacatcattcgtacaattaattcagtcaaaacatatttcaatattaggtcaatggttacatcttcttcatctgccagaataacatgggggaaatctctgcaacccggttatgagtctttgatgctttggtttgattttttaaccaaacctctcatcgatccgtccaaaaagctaggattttgggacaaattcagatatttagtgcatgggaagtggatatacgagttttcagaggaaagtgagatccacttaaatattaaaggttcacatgatccttataagattacagatgatggtgcgggtctggcgttctgctggtctggtggcaccacaatttacgttcataactccacggatcctaaagagtttttaaaaattgaatcccaaaggtttcagttggcagtgccagactttgccaaagttagtaaatttgataaagtctttatgaagctcgatggaagagtaatttggacattaggtttactttttgaacaaggcgatatatctaaggctggtgacgaagagaggttccttccaaataggccacattatgaaatacagctgatgaatccagatggagtcgcagatttggatcaccatgatacatacaaaggatttagaacatcttttatccacatgtcatttggtgtctattcttctgagcacggatccataaatagtctctatctcgcaccttacgctttaacacatttctttaagtggtggaatttatttcatacatatacatctggtcctattaggcaaggacggttatttacggatgtacttcaaaacaagacaaagtttggtcgctcattatttacaatagcttatcagctacatttaaaacggctaatggttacgcatatttatcggcatattactactcaatatgatcttgaaaaagaccgcaaaataacttttactggattgaaagggaggtttgattcactgaaaattgatttgcatcaaaaaagagttaaactgacccatacgaaccaaaaattaaataagtcaaaacctgtatggaagtttaagatgtctaggggtgagattgattgtgcagaagcagatattaggatattatcaactctgtttgatcaggaagcagttaaggaaattcttacttctggactcgatggcatacttgaagacgagccatcacgtcctattacgcctcaagatgtggaatacttgcgtgaatcagattggtatgattatgaggattatatagacttgaatcaagtgccgcttggttcctcacttccattaaaattagaagcaataccattgctatactctcctagaatatcctactttagaaaaataaatgatgatggttacgtactagcttacccatttggtaccgaagaatctcacaattgtctgattggcaagaatcatccagaattgacgcaggagaaattagcaactgaaagaaaacgagaaatagaagaacaactaaaattattacatattacgttaagcgaattgcaatcgaacaaaggcggaggttcggtaagtggaaattcggagcgctatgcacgcgaattaaaagcagaggtagctgaattaaaccacagattgcacacagtcaacaccatcttgagcgatttaaaaatctcggagactattcctggaggaaatactgatggtgatagctccagctcactctccgatactgatgtaaatttggaaaatgcaccgccaattcaaaatagaatatcgctattgaggaccaataccgtggagtcttttgtatcaatgagaaaagcctctactatgcaggttgagtccacctatgataaccgtttcatggtccataatatcgagttaaaaatcgataataaaatcaggcatcaccttttggaatacgcttccagtgctttcgaaaggaaatctatgaggtttgctgtgacttataaatccgtaactattttaaaagaattactgggaaatgtgttgactggggtcagaacatctgtagaagattatggttcaatacttgaggacgatttagccagtaattcagaatttattgagcactttgagaaactcatcagagaagttccgagtgatgactttgattatgttgataattatctttttagactaatctcccctcaggttcagatcaaatcggacgttgaaaggaacgcagcagttattttagctgctagggatatagaaatgggaataattgatatagttcaagtgtatggaaaatcaggaaaaagaattcccgttgacgtcgatactattgttgaaactcgctattccgctgtttcaaaggacattcagttgtttacattgttcaaaaaggatttagagggtcctgaaggtagatttttccataaaaatggatatggttccgacaaagagtcagatatatggcccccatggattcctcttgaaatgtgctttgacgggtctttattagataagcatgtttttctaaaacggagatcaatgtttttgacctacgtcgctcccaatcccctattttttagtgcaaatgatacgtctgcattctcttatgattcgagatttcgtattgcatttccaggattggttctgacctcggactgtcaacaatactgcgctgtatatgcaatcgcagaagatttactttcctttggatcatcattggatgaaaaagttgagaaactttccaggatattatttactgatgaggtcagaaataacctggaaaatcttgatgtctctgttgtcacagcattacaagaaagaataaaggaactctattatacgcgagcatacctcaaacttcacgagccaagattgtttatgaaatcaggacaagagctaaccttcgatattcaaactagtacgttgaagttgacgttacttatgacggcaatcaagaaaacttacgaccggatggggagtggtaatagagtaatacagaaaagattgaggtggcaagttggaacagatgaattgatatgggaattgtacgatgagagtaaaactcctttcgtgactatcggattggggccctctacatttattcgttcagaaacttccgatggcactaatagtaataaagtatccatttcttccttacaatgtttcaaccagcaagaaaatcccgtttacactgaattgctggcccccttttatgaaaattcatcctataataagaacgcgccaatggtagaaattttttggatcctggggccatcagttggaggtatttcagatctgcaagatttgattgtttctctacagccattgattttcaagatggatcacaaaacatcggaaaaactaatgaattatctatttccaaagatagaacaaacttccatagaacccaattctccagaacttgtaccacgttcttccactagttccttcttttcatcgtctccagttttacggcacagtctttctaacggttctttatctgtgtacgatgcgaaagacgttgactcttgggacttgcgtagtatccagagcaaagaaggtatcaaaaagcataagggtgatcatagaaaattgtcagcatcactttttgtgcaacctgattataacatcaatgaaatggtcaaaagatcagggacatttttcaatgtaaaatctattataatccgaaaaactctaatgtccgtgtgttataagggttcacacagccttttgaccgatgttaataacctgattgttagagtccctgttttaaagtaccataacaaactgtggtcgagggaagaattttttactgctttgaaaagagacgtcgtaagaatagttttacaacatttgggaaatattattggtaacaaatttttgcctcataaaaaagagaataagaaaaaaacttctatggaaatacatcgattactaagtccagattctcaaaatcgtgataattcacatatccttgaagtcgaagggcataattcattttatagctccacgcactcttcagatatcagatcaataaactcagatgaaacgtataatgaaaatgatggaaatggagtaaagccattttaccctgttacgagtgagttttcaaaaaataaatgaggaaacacacacatgtgtctagcgtaaatattcttcagttatatagtaattgtattatatactaaaatgaaaatcagtaagattttttttttacaggccttcttggcgttagtttttccggtttttcacttactaagatgagatgatggggcgcacggccaaagtattccccattcatcaatttagcatgctagaataaaaagattaagagcaatatctacgaccgacaaagtgatctatcaaactgctgacaaaaaatgtcgttggaagccatcgtctttgatagatcggagccagaaaatgtttcggtaaaggtacttgatcaattacttttaccatatactactaaatacgttccaattcacacaattgatgatgggtactcagtcatcaaaagtatgcaggtgagaggtgccccggcaattgcaattgtgggttcgttatctgttttgactgaggtacaattaataaaacacaacccaacttctgatgttgctacgctgtattctttagttaactgggaatctacaaaaacagtgctaaataagaggctagatttccttttgagtagtagacccacagccgttaatttatcaaattctcttgtagagataaagaacatactgaaatcctcaagtgacctaaaggcttttgacggtagtttatataattacgtctgtgaattgatagatgaggatttggcgaataacatgaaaatgggtgataatggagctaagtatttgattgacgtgttacaaaaggacggtttcaaggacgaatttgccgttctgacgatttgtaatactggatccttagcaacctctggatatggcacggctttaggtgttatccgttctttgtggaaggattcacttgctaaaaccgacaaggcagactcgggattggacaatgaaaaatgcccgaggatgggccatgtcttcccactggaaactagaccttataatcaagggtcaaggctaacagcatacgagctagtttatgataagattccatcaactttaattactgatagttccatcgcgtatagaattagaactagtccaattccaatcaaagcagcatttgttggagctgatagaattgttcgtaatggggatacagcaaataaaattggtactttacaacttgctgtaatttgtaagcagttcggaattaagttttttgtagtagctcccaaaacaactatcgataatgtaaccgaaactggcgatgacattattgtggaagaacgtaaccctgaggaattcaaggttgttactggtacagtaattaatcctgaaaatggttccttgatattgaatgagtcaggagagccaatcactggaaaggtcggtattgcccctcttgaaatcaatgtctggaatccagccttcgacattactccacatgagcttattgacggaattatcacagaagaaggtgtatttaccaaaaattccagtggtgaatttcaactggaaagccttttctagatatcattctaattagactctcgaaataattacttttgtactgtaaaggataaaatttcatattgagatgtaagaattatttttttttttcattcaataaaaggaacacattaatgtatattgtcagaaccttgtaagtccaaaacactataaccaactgatacaatatgtattgtctttgtttctgcatatttgtaaaacgtgcaaaaaagtaaagaactcctcatagggggctcgaacccctgacatttcggtatccttgcttaagcaaatgcgcttaaaagccgaacgctctaccaactgagctaacaaggatgagttcttcggagcgtgttgtatctcaaaatgagatatgtcagtatgacaatacgtcatcctgaacgttcataaaacacatatgaaacaaccttataacaaaacgaacaacatgagacaaaacccgtccttccctagctgaactacccaaaagtataaatgcctgaacaattagtttagatccgagattccgcgtttccaccacttagtatgattcatattttatatagtatataagataagtaacattccgtgaattaatctgataaactgttttaacaactggttacttccctaagactgtttatattaggattgtcaagacactccggtattactcgagcccgtaatacaacagagcgtccttaataaatatttctataaatatttgatgtttaccttccgaaaaaggtacattgccaaccttatttgataaatgtgtaaactaagataagtgttgagatcggattttgataaaggcatttgtttggggtgtatgagttgggaaaagaaacaacaatcatctcttgaccagttttcctactactagtgtgttatcatatagcgtaagagtatgacatagagattgagaaacagaaactgaatcataacgaacatcacagaatttacatttctacacaattttcagaaaaagtggagtggtgatatatgcttattgttctacaagttctcttcatgcgtttttgtttatctatcttattgaattattatcttcatgcatttatacttattaaattcgatgaacatttcatattatttttatatgcttcataattcatgttactacgatctatacagagtattatcgtaatgtcttacctttagcttgtcacttaacacatgcactgcatttcgaaaagatgcttaagcaagtttatcataatttgggagtgttcggtgaatttatacagaaagcccctccaacgtcttattgataatgtatatttagttcatttaccaaaatactatcaattcatcaacctccaagtggttttgactaaacagcccacaattgacatatgtgactgctaagcagacctttcttgaagtaaatttcagggaaactaagctacggcctttccaaaatatgggcaggaactgcttaatcctttccttttattagataagcactttagtatttttgtttttcatggccttatcctacgttattgtcgtgaaagaaatggcagaaatttctgttgtacataaattactaactgccttaccttgaaaacggttttattacaaaaataggggtcaagtgttttgttatccctgttgttgttgttttataagtcctaatctcgcttgaatatcgcccatattcacaccctgttcttgaccgtctactaaggtgccttagggggactcaaacttaagatcgccttctacgcgttttatgctatgatcattagtgttgatgcatcggaagtttaaaaattaagtgcgagtgcattagcacagtggaattattagaatgaccactactccttctaatcaaacacgcggaaatagccgccaaaagacagattttattccaaatgcgggtaactatttgtataatatgtttacatattgagcccgtttaggaaagtgcaagttcaaggcactaatcaaaaaaggagatttgtaaatatagcgaccgaatcaggaaaaggtcaacaacgaagttcgcgatatggatgaacttcggtgcctgtccctcgaggaaatagcaaactcgttacagctagcatctcatagcatgggcatagagtttcagaaattttgctcttaatggaaaatataacctctttggggaaaagagaaatagatcctttctcaaaaatttagaaaggaaaaaaaatcaaaatataataaaatagattttttttaggttaattttttgccaatttagctagacttttgaaaagatccaaaaatttactaaaattgaatctttctggtattaattttgtcctatacctcaagaagtaaagtattctcgaattgatacttctgaaaagcgaaagaaatatagctaaaggatactggttatttattctttctttttttctttctttttgattgagccagtgtataataaaaacctactgcgagctattcaataaattgacatagaatatctgttgaagcggttctttgattgagcatctgttttccttttgtatttttgtccttttagattcttttaacgacattggagaaattttaatcattgtataaaaacttcattcgctcgtttgtcagaagtttttttataacttgctatttccttccaagaagccttttattgattaccccctctctctcttcattgatcttatagatgtccaacccaatagaaaacacagaaaactcacagaatactagttcatcaaggtttttgaggaatgtacaaaggttggccttaaacaatgtaacaaatacgacatttcaaaagagtaatgcgaataatccagccctaacaaatttcaaatctacactaaactcagtaaagaaggagggaagtcggattcctcaatttactagagaaagcgtatcaagatcaacagccgcacaagaggagaaaagaaccctgaaagaaaatggtatccaactccccaaaaacaatcttttagatgataaagaaaaccaagacccaagtagtcagcaatttggtgcgctaacttctataaaggaggggagagctgagctgcctgcaaatataagtttacaagaatcctcctcagcgaaggagataatccagcatgatcccctaaaaggcgttggatcaagcactgaggtagtccataactcggtagaaaacgaaaaacttcatccagctagaagtcaacttcaagttagaaataccgaaagtgaaactgatagtggaaaaaaaagaccaatttctacaattgttgaacaagaactgcccaaaaagtttaaagtgtgcgatgaaaatggcaaagaagaatatgaatgggaagacctagatgcagaagatgtaaatgatccattcatggtcagcgagtacgtcaatgatatattcgaatatctccaccaactagaggtcattactcttccaaagaaggaagatctctatcagcatagaaatattcatcaaaatcgagatatcctagttaattggttggttaaaatccataataaattcggcttattaccggagactttgtatcttgccattaacataatggacaggtttttaggtaaagagctagttcaactggataagttacaattggttggcacatcatgccttttcattgcctctaaatatgaagaggtctattctcctagtataaaacatttcgcatcagagacagacggtgcatgtacggaagatgaaatcaaagaaggggagaaattcattttaaagacattgaaatttaacctaaattatcccaatccgatgaattttctgagaagaatttcgaaagcagatgactacgatatacagtctcgaactcttgccaaattcttattagagatatcattggtagatttcagatttattgggatactaccctcattgtgtgcagcagctgcgatgtttatgtcgagaaaaatgttaggtaaaggtaaatgggatggaaatctaatacactatagcggcgggtatactaaagaagaacttgcgcccgtgtgtcacatgataatggattatctagtgagtccaattgttcatgatgaatttcatagaaaatatcaatctagaagatttatgaaagcttctataatttccgtccaatgggctttaaaggttagaaaaaacggctatgatataatgaccttgcatgaatgagaagaggggcagatgcttaaaatatctaaaacgataatcgataaatgtccatataaaatgtatggctgctttttaatcatttcttttcacatttccatttattcttacaaatttcacacccaattttagcgcctttcattctgttatttttaaactgacgataaaaaatcattcgaagcctaagatttccaaaataaaactccatttttattctcactaataacaccacaccattaattttaattttttaattttaatttcagatttgtaccataagttttattctatttcagttcaaccgtttccggatgcatgtagcgagggtagacaaagaaaagcatcagtatcggatgttgatattatgggaaatatcataaccttagtctcttaaaaaatgctgctttcttctcatttttcatttcttttaaaattatttcagtatagttattataattaacattggaataacattaataataataattttttaatagtaataatgataataataataataaaaataaaagaataaatttaaaaacaaaaaaaattctaatattaatgatgataatagtagtaatactggtggtattatatatgttgaagtgaacacgcatatcactataaactatatatacatatatatagatagatagatagatgcaaaaaattttttccttttagttcagcaaaaagaaaagaaaatgtaaagagtatgcgaattcatgagcattactagtactaatctacttaagattaaatagattttgaaagttgctatgcatttcggatgtacaccacttgaaagtttggaaataaacagagccataccttggtttcttgtacttcaaaatcaatgaatctaaatgagttttggaactagcgatgtctttgactagatcaatgcagagagactgaaacgcttcatcgtgtattggatcgataccaccactgtaatgctgtagtgttccattccatagctcgttcttgtttctgttggtcattcttctcgctatatacattgccattgcgcttacggtagatggaggtaaatgaatgaattggtggcagcagtaggcatactctaaaataaacttaccaatatttctattaaccggatcgtaatcatctgccttggagatcctccttaggaaattgagtgggttgggccaaccaatgttgaattctaaggaagtgagcatgaacatttccgcattttttatgtcgtttttagaagccgcgccgtcagtgatataagcgtattcagctagtttgggcaaatttacctcttcaaattttgccgcgatgaaaagtgaggtaactgccaataattgtaacttgttcatcgtaactttatttttagctaaaaatctatccattaagtttatggataggaataacgtttccggatagcattgaaatttttcgtgcacctctaccagccaatccactaatattgttctcatggaaggcctcaaataatacttggacgttttgtcgagtaaatagttgtgcgatggtaacgtttctaattctcttctatataaaaatgcaaaaatttcagcagaatattctgctaccattgcagtatcatctttttcaacataatctaggtcctgccagcctactatttcactcactccttcagcgtctattctgcgttttttgttcactatcgaagcagcatcatcatcttctccttcttcttcttcttcttcttcttgctctgctgccgttcgatcgttatatatctgtcttttttgaacggcgctaacaataggtctaatgttttcttctcttcgtactttggccgccttgctccctgctactattctcttgttctggcttaaaggattattgttcactggtacatctgttaaagcccttcttggtttagaatcctgaacctgctgcttactagagctgtcattttttgaaagggcccttttattttgaagaatctttaggtttgaattgcacaactgcctctcattttcattataaatcatagaatttcttttaatactctgctcatggtcgtggttctctcccattgttcagtaaaggtgttcagcggctttaaatacagggaaaagcgcgttactgctaattattaagcttattttgctttgtgtgagacaactaattggccgtgaaaagctttaggtgattgagtctcttgaagtacaaagacaaaaagacttcaatagatagacagaaaaaaaacttttcttgagaagcttaagaattagttccaagtagcttctaataaaccgatgaacgcaaatgaagttcccttcgcggtagatggcagtagctatcggcagtcactaggaaaagtgagtttagcacagatatgctgtgggcgctatcccaatgtgggcaaagcgcgtgaacatcacgacgcgccttcccgttaaattttgtaccatcaagggcgcgtcttcactcgagatgcgcgttcttttgctggttcttttcactgagggcacagaatatgatacccacagtatgacaagttttaatcgagatagtttgacgttcgttttttactttgaatatactcgtagtctttttactttttgagtataaaaaaaaaatgactagcaaaataaaattagtagtctaaaaaagaaagctcgcactcaggatcgaactaaggaccaacagatttgcaatctgctgcgctaccactgcgccatacgagcttttgaattatggtaattttgattatcctagaatgttatatctcaatatctcaatatattttggacatctatgaaacacccataaagcagccgctaccaaacagacaagattcagtatgtaaggtaaatacctttttgcacagttaaactacccaaacttattaaagcttgataaattactgaaattccacctttcagttagattcaggcctcatatagattagatatagggtacgtaacattctgtcaaccaagttgttggaatgaaagtctaaaatgtcatctattcggtagcactcatgttactagtatactgtcacatgcggtgtaacgtggggacataaaacagacatcaaatataatggaagctgaaatgcaaagatcgataatgtaataggaatgaaacatataaaacgaaaggagaagtaatggtaatattagtatgtagaaataccgattcaattttggggattcttatattctcgagagaatttctagtataatctgtatacataatattataggctttaccaacaatggaatttcgacaattatcatattattcaccaattaatcacaagttggtaatgagtttgataacaagttactttcttaacaacgttagtatcgtcaaaacactcggttttactcgagcttgtagcacaataataccgtgtagagttctgtattgttcttcttagtgcttgtatatgctcatcccgaccttccattttttttttcttggaatcagtacatagcaggtatgagttgttagagctgttacaagttacggtaaacatttcaacacaccgttatttaacgaatttatttgagaaagtggtgtattttaagatatatgtttggtttcgattgttggcaaagactataatattatgcatataggatataccaaaaattctctctgaggatataggaatctacaaaatgaatctacatttcattttattacgtcatatatgaatactagtcaatagatgatagttaatttttattctagcatatatttaagtttgtttgcgaaaccctatgctctgttgttcggatttgaaattttaaaactacattaatgtgttagtttttctttctttctttctttgtcttgacgtgatttggacttctgtcttgcattcgcgtccattcatctgacccaatattccttttggttttgttatccttataaaaagaaaggaagcttcttagagggaaaaaaatgatgaagagtaatgccaaaatataaataaataaataaatatgaaaatcattttctatttttaatagaataagaagagcatcttaagattacaatttcaagaaatagtttacacagtatatccaataactccaataaactactttcctatacaaatttctatggtgggattaatagtaaaacttctgtacttctctaattcaccaagaaattaaggtaaacatctggtaagcactatccagctttttgctattacacatatggcttttctgcaatcatttcttcccattttgtctcaagccgttagtcttgaaaccacaggcggagtagagttacttgatgcggtattttacatgccttttttcactgcaaaaaaaatgaaatacatatttacacgatttgcaggacagtttacgatagtgagtatgcagaatagttaacacctttgttttatccttttgtgtcttaattatatgatataaaggcgcctggcgttatcggatagtaatagatgctagttatcaacatttcacaattgaaggaaataaagttgaagtactcaacaaaaacttacttcagaattaaatttttggggggaacataggcatcctatgacaggtgaccacaagcccctcaacgcaatctaatattttacaaagtggtaaaattctttcgttcttcgttttaatatacagtcatttattgattctattacattaatattcctacgcttcggctcacataattaacaggacttcgagtccgttaaacttgggatcaactaatttctacggattagtgcttatgcctgatgtactgccatatatggtgttatgatatcacataaatgacgagaaacggccatcgaatttagtggaagctgaaatgtaaggattaataatgtaataggatagtaagtgccgacgtgtgaaacgaaagaacgaattgtaattttaccatgtaaagctgcccactcttttttggggattcctttacctacgagagggcctgttagaatatatgcaataaagccattcttatcagagatagactccaaacaaccacctcaaaacccactttttcctcaagtctgcctaaactcaaaaattatatgatagatgttctcaggagaattgggtattcagaagaacattcgtaagacaggccaaagtaatatgaactgcctctgcttaatggaataacgtgatttttgtaccaaattgcctatttcagattcgcgtgcgcttcctttattcgcatagcacgcagagtacaatgtggcattaaaccctattgtcctgcacggaagatcttgcaggaatcaaatactgcctttcactttgcaacctcttaatcacatagtagcacctatagacacgtattctattctctattataatgttgttcaagattggatattggaaacctttagagcagtgcaatttggcaagagataattccagtatttaaacagtggataaatatacaatttccaaagcagtatgcctttcctatggttatcatcctcctaggtctttgcacattaggttttccaagaacagcattctgtccctccataatgacaaattctacagtgagtattaacacgcctccaccatatcttactctagcttgtaatgaaaaattaccaacagttatgtcaattgctggatcagactcaagtggtggagccggtgttgaagctgatattaagactatcaccgcacacagatgttatgccatgacatgcgtcactactttgactgctcaaactccagtgaaggtgtacggcgctcataatataccaaagaaaatggtatctcaaatattagacgccaatttacaggacatgaaatgtaatgttattaagactggcatgcttacggtggatgcaatcgaagtcttgcacgaaaaacttttgcaacttggtgaaaatagacccaagttagtaattgatccagttctttgcgccgcttctgactcttctccaactggaaaggatgtggttagcttaatcatagaaaaaatttctccttttgccgacattttaactcctaacatttcagactgtttcatgttactgggcgagaacagagaagttagcaaactacaagacgttcttgaaatcgcgaaagacctttctagaatcaccaattgctccaatattttagtgaagggaggccacattccatgtgacgatggaaaagaaaagcatattactgacgttctttacttaggtgctgaacaaaaattcatcacttttaagggccaattcgttaatactacacgcactcatggcgctggatgcacactggcttctgctatagcatctaacttggctcgcggttattctctttcccaatctgtttatggtggtattgagtatgtacagaatgccatcgcaattggctgtgacgttaccaagaaagctgtgaaggttggaccaattaatcacgtttacgccgtagagattccattagaaaaaatgctcaccgacgaatgctttacagcatctgatgctgtacctaagaagccaatcgaaggttctcttgacaaaatccctgggggtagcttctttaattatctgataaatcatcctaaagtcaagccgcattgggatgcctacgtgaatcacgaatttgttaaaagagtggcagacggcacattggaacgcaaaaagttccagttttttattgaacaagattatttatacttaattgattatgtgagagtttgctgcgtcacaggtagtaaatctccaactctagaagatctagaaaaggaccttgttattgctgattgcgcccgtaatgaactaaatgaacatgaaagaagattaagagaagaatttggagttaaggacccagattacttacaaaaaattaagagaggtcccgcattaagggcctactgtcgttacctaattgacatttccagaagaggaaactggcaagaaatagttgtagccctcaacccttgtctaatgggttatgtttatgctgtagacaaagttaaggataagataacagcagcagagggttctatttatagtgaatggtgtgatacttgcgcgtcttcattttgctaccaagctgtgcttgaaggtgaaaggctcatgaatcacatcttggaaacatatcctccagatcaacttgattctttggtgacgatctttgcaagaggttgtgaattagaaactaatttctggaccgccgccatggaatacgaatgatagttacaatatttttaacagaatatataaaatacatatacagaaatgataaactataaacgcaaaagattagcgatacgaaaaaaggatttctcgctattatatcaatttataaagagatcctttggaaatataaattatgttcatttcattttttcaacttctagaaggatgactaactattgtttccatttgctagcatggtaaattaatacatttttgaatttgctgctagggtacaataccatgcaatgtttataatataaatcaaagtgacagagattcctaaaagctaaaacaaatccattgataatataatagtaggttggtcaattcaccgcagattcaatgtaagtattgatactccataaatgttaacttcaggttgatattcgttacaaaaatcttagtttgcttttcattactatctgaacggaatgctcaacatttttcttattctacaattgtacaatgtcacgtaaacagtttgatttgtgtatttacagtggaaacattttacttgttggcaatagtacatgcgcagataatcaaaaaccattgtttccgacattatttctgacaattgcttgaatttgctgaacacttttcgaggtacattctgataaagagtgcattattagttatttagagtatattaagacatcttctcgaagatatataaattcgtaaaggaaacaaaaatttcgggataacaaaaaagtttcttctttttacgtattaaatggtctattcatcgatcctatttcactatcaatcctattatattatcaacttttgcatttctgcttccaccaaagtcgacggctgtttctcatcgtttatgtaatatcataacgcatgtatgacattatatcagtggcatgagcgctagtccatgaaataggagtttaactccaacatacggaacattcgcattatcgcacacgtaagactcgatatattaaggaaggaatttccgagttggattaataaaggaaaaataaaatatagtgttggaaatatagttgcctcagaataatatcaatataatattaaaacgtatatagttagatacccggtattattcgagtacgcattaattcagcagtatgactttctgtgcctgcttatatattgtaaccgtatgttgttctaccttaaaaatttgctaaattgaaggaattgactatcgtcactgaagagtattcgtattatggtattatgatacattgtctaaaaaaaggataccatttttcttcaatagaacaagaagagaatctaaggacaccatttcgagaaatagtttacacagtatatccaataactccaataaactactttcctatacaaatttccgatggttggattaatagtaaaacttctatacttctttcatccatcaagaaattaaggtaaacatctggtaagcactatccaacttttttctgttacacatatggtttttctgcaatcatttcttcccactttgcatgagtaagtgtcccattttgtctcaagccgttaatcttgaaaccgcaggcggagttacttgatgcggtattttacatgccttttttcactgcaagaaaaaaatgaaacacttatttacacgattttcaggatagtttacgctggtgagtatgcagaacagttaacacctttgttttatccttttgtgtcttgattatataatataaatgtgcctggcgttaaaaaatagcaactgaataagtttttttactgatgtccttgagagaagtaactaattatgaagtctcgttttacatcccgttgtcttacagcaacaggactcataaagtttgtaaactgccaaacggaattttagcattaataatatcggatccaacagatacttcaagctcatgctcactgactgtttgcacaggttcccataacgatccaaaggatattgccggtttggcgcacctttgtgagcacatgattctttctgccggttccaaaaaataccctgatcctggtttattccacacactaatcgcaaaaaacaacggctctcaaaatgcctttaccacaggggagcaaacgactttttattttgaattgcccaatactcaaaataacggcgaatttacatttgaatctatcttagatgtgtttgcctcattcttcaaagaaccgctcttcaaccctttactgataagcaaggagatatatgcaatacaaagtgagcatgagggaaacatatcatcaaccacaaaaatattctaccacgcagcaagaatattggccaatcccgaccatcctttcagtcgcttttccactgggaacatacactcgttatctagcattccacaactgaaaaaaataaaactaaagagctcattaaacacttacttcgaaaataatttttttggggagaatataaccttgtgcataaggggaccgcagtctgttaatattcttacgaaactagctctatcaaaatttggcgatataaaacccaaaagcgctgtaaaggaaaggagtatatcgattaggacgaggtcatttcgaagatcgaagtctttaaaaaaacgccaagattcttccaaaaacgactacagtgacttgaaaacctttaaaatactgaacacaacgtgggaaaaaaaatacaaaaatacgatgtgttttcaacaatttcctgaatgcaattcgatatttatcaattcaaataaggtacctataatgagacttctctttcctgttagcgataaaaacactcggtttacaaaggatgacattaaaatatacagtcatctttggtgtgaacttttcggcgatgagtctccaggatctttgagctattacttagcttcaaaaggctggctcacaggctgttttgcctttacctcagaattcgctattggtgacataggattaattttggaattagaactgacaaacagtggctgggaaaatattaagagaattacgacaatagtacttaatagactcttgccttccttttacgtaatgaacatcgattacttaatcacttttttgaaagaacagaatttgatcgacctcgttagctttctgtaccaaagttcagaggatcttccaatggaagagtgctcaaaattaagcggtattcttcaggacgatttagaatgtttaaccccccctaatatattcaaaggatttaaatctcttatagaaatagatgatcccaacatcgaaaaatatgaaaacacaaaggccaatatacaatggtggacagggcaagctattaagttccaaaattttttaaaatctttcatgaatcatgacaacatgcgccttttactcttagggaatataaaatctggtaatatatttgataaaatgaaaaataaaagtgatatatgcaccgattttttctatgaatttgagtattatacggcaaacgttcatctagcaagtgataataaatttcattcaaacagctcgtatgaatttaattttcccacaggtaatctttttttaccagattgcgtcagcgatcctttaaaactacaacagctcttcttagaatgctcgttaaaatcgaaatttgctacgcttagacctcaaatttatagtgagcccactaggacaaagcctcaattagtcagtgagaaccagaattatgagatgtggatcttaaaagaagacccaaattttgcctcagacaataaatccgtcgtatcatttgaagttttggggttaggcatcaaacctagtccggaggcaacaatccacctggaagtactagcacaggcattatttatcatcacctcttcattcctttatcccgctctgagaattggttacacatatgagattgcctcatctagtaagggcaacgtaacactgcgatttactatttctggattccctgagggtgttttcacaatagtaaagacgttcgtggatacgctaaaacttattgcaacagatccaacgtttctttctaaagataccttgagaaaggcaaggattttagttagaaataaatacaagaacgcgtcatcggacaactgcgtgaagctagctagcgttggattgctgattgttttagagaaatatatatggactttagaggatagaattaatgcattagagcttaccgagttggaatccttcgaaaaattttgttttttattctggaggaatcctaaacatttggtcttgttcatgcagggaagccttgaatatgctgacgcaatcaaccgttacttaaataacaattttacgcagcacctaaaaatcagcaatgaagggagcaaaccgaccatacgtctctaccctcctcccagtacaaaagatctagatcaaggcacaaatgcctttatatcatataatggtcaccaggatgatcccaacaatagtattgtgtattttattcagactgcacaaagagatgacatcaaaaatctgacactaacctttcttaccgaatatctattttcactaacgctagtgcctgatctaagaaataaaaagcaaattgggtacattgttttgggaggactcagggttttaacagacactgttgggattcatataaccgtaatgtctggcagctcggggcacaatctggaaactaggatcaatgagtacttatcttacttgcagctgcaggtgctaaatagattcaccgagtttgattttcgaaggatacttctagagccgttcttaaatcttttaaaacagaacagtacgaaacagtttgaagggtcggctggtcctgtagacctattaaatgagatagtggcaaatgtgcaaaatggtgataattacactctcaacaataaacaaatgagacaacataggaaggtaagaaataaaattgcggaaggaaggcttaattttcaagaagatcatgaaatgattgatatctcatttttgcaaaaattaactctaaagaaatatttagcattcttcgagtccaaaatctctatatattccgctcaaagaagtaagctatcaataatgatcacaagtccaatggcagagaaggaaattgcaagcaggaaaatgttccttcagctagaggcctttctgaaaataaacggattcgccataaaaaatgaagacttgaagaaaattgtcgaacattcaaagggaaatcctattttacttgtaaagaacctttttacttattttcgtaggagaaatgaagttttcaagctcggaaccgttgtattgcaggaaatattgaaaatcatcggaatgaatcttaagcagagatacggctctatattagggttttcttcccaagatggtgaaggacaagaaatagaaaaattttggaacaacgacacaagtccgattgttcctcttcaggagcttcctgaaccaaactttttccgcaaggccgcattttgaaccgtattttgctcgttccagcctttccacgtttttgttatctaagcaacttggcacatttccctactatactacaaaccgatacgtaaatacttccctaaatagcatatgaattattcagtaatttttaaggatcgaaactgcacctcaactattcgttactgtggttatgttctcatgtattgatgcaaatcatgggatatttgctcaagacgacggtaaaatgagcaaaaatggcacgatcctgaaaagagcacttttcaagattcgggctacaaaatgcaacataaaaaatgttgtattgtcatctcgagagggtcttgtatgttttattcctcttatgattagttcacattagtaaaacagatacgcagtgtgctcttaataaacaactactccatagctttatttgcataacaaaacttttaagcacaaacttaaacaggtggagtaatagttcggcggcgactcaaattacatttgttggaagaatcgaatagaaaataaaaaaaagtgtattatatttgacattcaaaatggaaggtatgaatatgggtagcagcatgaatatggacgccatgtctagtgcatccaagacagtagcatcgagtatggcgtcgatgagcatggatgcgatgtctagtgccagcaaaacgatattatcgagcatgtcatcgatgagcatggaagcgatgtccagtgcgagcaaaacgttggcgtcgactatgtcgtcaatggcaagtatgtcgatgggaagcagttcaatgtcaggtatgtctatgtcgatgagcagtacaccaacaagctccgccagtgcacagacaacttctgattctagcatgtcaggcatgtcaggtatgtcatcgtctgataacagtagctcttcagggatggatatggacatgagtatgggaatgaactattatctgactcccacatataaaaactatccagttttgtttcaccatttgcatgcaaacaatagtggtaaggctttcggtattttcttattatttgttgtggctgctttcgtctacaaactactgcttttcgttagttggtgccttgaagttcactggtttaaaaaatgggacaagcaaaataaatattccactttaccttcagcaaactccaaagacgaaggaaaacattatgacacagagaataattttgaaattcaaggtttacctaagctgccaaatttattaagcgatatatttgttccatctttaatggatctctttcatgacattataagggcgttcttagtatttacctctacgatgattatttatatgttgatgcttgctaccatgtcttttgttttaacatacgtttttgctgtaattactgggttagctttatcggaagtcttcttcaatagatgcaaaatagccatgctaaagaggtgggacatccaaagagaaattcagaaagcgaagagctgtcctggcttcggtaactgccaatgtggtagacatcccgaacccagccctgatccaattgctgttgccgataccacttccggaagtgatcaaagtactcgcctggaaaagaacaacgaatctaaagttgcgatttccgaaaataatcaaaagaaaacacctacacaagaagagggatgtaattgtgccacagactcaggaaagaatcaagcaaacatagagcgcgacatccttgagaattccaagttgcaggaacagtccgggaatatggatcaaaacttacttccggccgaaaaattcactcataactaataactagacaaggttcgtccacctatatcttcttcttccaatatctctatacatcaaaataagaatatcgttcatttctcagaagctcaaaaaaaatctcaaaatggatacttctaatgccctcatgaagaggaaagaaaataatagacacagcgaccttcctataaataacagacttgtatatagttgaatgtctaagtaattttaattcaaaaatccttaactatattaccaccttgcaataataagagtgaagtgttaaaaatgatacttgcttgccttcatcgagttaccgttgtctcccacgtttcttttttctcgttggacagaattgcttccgcgcgaacattttccacttttatttgaaagaggacattattcagatcgtgtcagtctcatctaattggcaaagtggcaattttcgaaataacaagataactgcataaagtaacacttgtcgaattgaaagtattttgccagtgatatttaggttcgagtaaagaaaatttcataaagaaatcaacaagacacaatgctgaaatacaggtctttgccaatcaagagagcaatccatcatccggcaccaggaattactccaatttctccccgtattatggtaagcaggttgagagtaataccatcttttaatttgaagttcaatcgttggaactcttcggtgccagaaagctcgaaaaaggagttaaaaacgacagacggaaaccaagaaagtgcgagtaaggtctctccagtaaaagagaaggaaaaagtaccctttaaggttaagatgcaaaaagcccttcgtcattattgggatggttccaaacttttggggttggagataaaaatttcttccaaattgctcatgaagagtgctgcaggctacccattgacgagaagagaaaatttacaactgaaaagaactactcaagatatcgttcggttggttccatttgctgctttcctcattataccctttgctgaacttcttcttccatttgcattaaagttattccccaatttacttccttctacttatgaatcaagtaaaaaacgcgagaataaactagaaaatttaagaaacacaaggaagttaatgtctgaaatcataaagaataacaagtcccattttaaacctaataatatttccgaggaacaaaaagctttgtttaacaggttctacacacatgtccgtgctacaggagtgccggagtctcgtcaacagctaatcgaagtagctagattattcactgatgatactgtattggataatgtgacaagaccttacttgattgcattagcgaagtatatgaatttgcaaccattcggcactgatgtgatgctacgttaccgtatcagatacaaaatgcttgaattgaaaaaagatgatctatctatatattacgaggatgcagaacaactctccctctctgaattgaaaacagcatgcgcctccagaggtattagaagtgtagacgtagagcctagcgtgttatattcgaatctaagattgtggctgaacatgaggctcaaggataagatcccatccacgctgttaatcatggctactgcctataactacggtaatgtgcaatcaaaggagtcattgtacgacgcattatgtgacgttttaatcggtatccctgatgaactataccatgaggttaaagtaaacgtcgttaaggaagatgaggcatccgctaagcaaaaattgaaacaattgagggagcaagaagaaattatgaaggaagaagagcagcaagaagagaacgccattgtgagcgtcaaggatgagttgagcttggacgaccaagacaagaacatagatgcggctgctccagacgtaaaaccgcatgacaccaagcctatcggagaagccgctgccatcaaagagaagtaacccagttttcacctggcccattaaaccgcacgatacactctccgctactctcgccaacattctttttatacatacttgcacgaaactgcttttttagcaatgaaaagaaaatgtagtgaactctactatagattttgtacataagataaataaaatacactactatatgaaatttttgtttgtaaagctggtgtttgcacacatagatagtatcaacgtaggggatcaacacatgcacgactactagaagccttacccgtaacttcttgcatatctgctttgccaatatttttttttaaagttatttcttaaactactcctcgtgctgtccacatttttacccgttagttgttagacaaaaaaaaagcgcaactatctcccttttgcgcatctcccaagtcctttaccaaatatattagaagaatgacacccggccgagacggatgaagcggccgtctcggccgccttaggaagggatctgcgtttttgttcgttaatgaggtaatcaagggcgtacttggtagaacggtactaagttaatcattgctgctctccctcaaaattactcaaagaatagagtgtctattgaaccgtagaataggcatttattatataaggggttgtcaatttaccaaattttttacttcatctcaggactctctcttaaaattattttccttgccattttctatgttatgtagaatagaaaaacaggtacatattaactaaaatatacaccaaaaaaagtaaaaataaaatgtctgtcgccgatttgaaaaacaacatccacaagttagatactggctatggtttaatgagtttgacttggagagccgagcctatccctcagtcgcaggctttcgaggccatgcacagagtggttgagttatccagagaacgtgggcacaaggcctttttcaacgttggtgaattctatggtcccgattttattaatttgtcgtatgttcacgacttctttgcgaaatacccagatttgagaaaggatgtggttatcagttgtaaaggtggtgcagacaatgctaccttaacccccagaggcagtcacgatgatgttgtacaaagcgtaaagaattcagttagtgctattggtggctacatcgacatcttcgaagtcgcaagaatcgacacttccctatgcacgaaaggagaggtctacccctacgaatcgttcgaagcgcttgctgagatgatctccgaaggcgttattggcggtatttcattaagtgaagttaatgaagagcaaattagagctattcacaaggattggggaaagtttttgacctgcgttgaagtggaactttctttgttcagtaatgacattttacacaacggaattgctaaaacatgtgctgaattggggttgtccatcatctgctactccccactgggcagaggattgttgacaggtcaattgaagtcaaacgctgatatccctgagggtgactttagaaagtcgttaaagagatttagcgacgagtctttgaaaaaaaacctgaccttggtcaggtttctacaggaagaaatagtcgacaagcgcccacaaaacaactccattactcttgcacaactggctttgggatgggttaagcactggaacaaagttccggaatacagtggcgccaaatttatcccaattccaagtggctcttctatttccaaggttaatgaaaactttgatgaacagaaaaccaaacttaccgatcaagagttcaatgccattaacaaatatttgactactttccatactgttggtgacagatacgaaatggcgtaaggttaaaaaagtgaatctccattgtttatataaattttaaatttgatatgtaaagattctaaacgcaatgtgcttatttcagtaatagtaaggattctcaagtggaagccagcttgcgttgtccgttgtgctttaggaaaaaagaagagtacaagaatattagcctctttaaagattttgtcaattctcctctgaaagcaaacaacagaccttgcacaatgacaccctttgtcaattgaggaagaactcccttccaaagagattttaacccttcatttttgtacaagtatagtagcgcttcttggaaagtagtgaatttagagccagcgctttgaagcattgctttagcgacaatcaagggttgcgtaactagagtcgaaatcatcttggaaaggacacccaaaatgaaattttgcactgctgacaaactgccagcatcgttggaatggtcatggaaaaaaacttctttaagtctttgaaaagaggcatatgtgatggaaggatttatcgtcaatgctaaacctgttcttaaacctttccaaaaagcagttatgtccccattattttcacggtaaatgtccttaataacgttggtaaatttggcagactctgcagaatggactgtttgttgtcttgtagctaccacagccatgggactagtaaaaagttgcgatatactggcagctgctaccccaagtaccaattcttcaatcgtagaaggtgtgataggaccatcgcggtttttcagtgattgcagtcctaacagcttatgtttcatgtaggactttctgataaatgtgtaccaaaagaaataaacaaaattctggacaaatgtggccaccgtagtgactgtcataccttgatacagacccaaaatacccttttctttgaatatgtttatcatgcaatctacaacattcttatatctcctattgggcaaaactttaccttcgttactatcctcacttgaagaaggagatacttgtgactgaatgatcgtcttcgataaatccagcggataaactgcaatattggccattgccgaagccacagcgccagttaatgcagactctagagttaacattgatgatatgctcgtaacaatcttggcctagcttccagggtgtctgtacttttacgcagcatcatattttctctattttttgcacatcttcttgctcttcttatatttaccaattatctgaaatagtcactcggaccgagatgcaaaaatcggatttaaaactcgatccgaggagaacaccaaatgacacaacttctatcaatgcaattgccctctaagtatcatagatgccgctattttaaatgacagtgcaatcgatttccatattaaatggataaaggtgtttattatgaagatacccattactgacgtatatgtaatgattcctcagtccagtaccatagtcccgtcaccttacacggtggaaaaattaaactgtacccgcgattgtaaagaataacgtggaggcagtcagaaagaacaataaacgaatagtgaggatgtcgtagaagaagcattcatcgaaaaacagcagcaaggcaatgtcgcagtacatcggtaaaactatttctttaatctctgtgactgacaacagatatgtggggctgttagaagatattgactctgaaaagggtaccgtgactttgaaagaagttcgctgttttggtacagaaggtcgcaagaactggggtcctgaagaaatttatccgaatcctacggtatacaattctgtaaagttcaacggcagtgaagtcaaggatttaagcattttagatgctaacatcaatgacatacagccggttgttcctcaaatgatgccacccgcttcacaattccctcctcaacaagctcaatctccaccccaggctcaagctcaagcacacgtgcaaacaaacccccaagttccaaagcccgaatccaatgtgccagcagctgtcgctggatatggtgtttacaccccaacttcgacagaaaccgctactgctagtatgaatgataagagcactcctcaagacaccaatgtaaactcgcaaagtagggaaagaggtaaaaatggtgaaaatgagccaaaatatcaaagaaacaagaatagatcaagtaatcgccctcctcaatccaaccgcaatttcaaagtcgatattccgaatgaagattttgactttcaatcaaataatgcaaaattcacgaaaggtgattccactgatgtggaaaaagaaaaagaattagaatcagctgttcacaagcaggatgaatctgatgagcagttttataataaaaaatcgtcttttttcgacaccatctccacttctactgaaactaataccaatatgagatggcaagaagaaaaaatgttgaacgttgacacctttggacaagcttctgccagaccaagatttcactctagaggcctcggtcgtgggcgtggaaattataggggaaacagaggaaacagaggaagaggcggccaacgtggaaactaccaaaacagaaataactaccaaaatgatagtggcgcctatcagaaccaaaacgactcgtacagcagaccagccaaccagttttcgcaacctccttccaacgttgaattttaaaatgatgtttctatgtaaattaagtatatcattcagtatgtacatacaaaaatcaaattaatagtattatagtccgcgcctctggatagtattattttagtgcgtatcgcaaaatatgaatagcacagaggttcattattatgttctgagtatgaggacgaggtaatacataccttaaaatcttacatcatgtggatagcatttatggcttcttccatccggccgtacgcttctgttcctgtccctagccatagcttttctcatatcaaaagcatctttattgtcatctacttttttcagggtatctggatacccatcttcagctgagttataatatcccaccactctcctgtagacactgtatcccaatttttcgtaaagtttgatggccaattggttattgcacttgacgaaaagatcgataaagttgacttcatggggcatgacatcggtcatggtctccaaagtattacataacttcgaagctagcgatattcggcggaatcttggagctactgtcactgcagttatatgagtgtgccactccgtggtcttgccttctgtttttgccatcatgtaaccagagatattatgcttaaatgtaggatcaacagtcatttctgaacttttgaaaaaaaggtctggccatattatcatgtattcaaaataaaactctaaagggaagttttctgttaagatatcaaggttgacattgttagttttgaataaatcgacaggttcaaaaggctgaattgttgtcatttctcgaatcctcctgtctctttccttgaatattctcaatgttccactatctttcacataagcaatattgtgaactatatatacttcattagatattgcttcaacattaatattaataaaaaggacatgcataaagtaacatccgaacatctccaaacacccatacatatttatattatcgacgagggaatttttttcttcccaggcccaccaacgtgcgcccaccgctatgttttttgcgcctaggtaggtgggctagcttctatgtatcaaagctccttctgcgcagccgaggttttgctaagcactaccgcattggaatgactgtgtttgtaggagctccttgtctccacgctttcgcaattttcaagatcgagatactattagtgatggtaaggttatgaagcttacatgtttaatattgtagattccagaagcaggtaagaacaacaaactacaagaaaagatgggtaaaggtaagccaagaggtttgaactccgctagaaagttgcgtgtccacagaagaaacaagtatgtacaattatagaagattgcactatggttgaaagattttcataataagtagaagaaaggatcggccattgctaccatgaaatgagttggaagcttgaaaaagtaagggagaataattttgcaagaaactagggtagggctacttaatttattatagccatttgaattcatcagcttttaggaggagaaaggccattttgcgaattttgaataagaaagtccacaagtgatgaaactgaaaatctacaatgaatttctgccatctcagataatgaattcactacgagaacctcatttactaacaaatttattaatctttttgatgaaactatgttttgtcaaaagttaatcgtttaaaacagccgttgggccgaaaacaactataagaagagattattgggtactgccttcaagtcttctccattcggtggttcttctcacgccaagggtattgtcttggaaaagttgggtatcgaatccaagcaacctaactctgctatcagaaagtgtgttagagttcaattaatcaagaacggtaagaaggttactgctttcgttccaaacgatggttgtttgaactttgtcgatgaaaatgacgaagtcttgctagccggtttcggtagaaagggtaaggctaagggtgatattccaggtgttagattcaaggtcgttaaggtctctggtgtctccttgttggctttgtggaaggaaaagaaggaaaagccaagatcttaagcagagttatattacgatttcataattcgaaaaattctactgtgtatgtatatgtttaagagattaaataattcttcaaaatcatcaaacatcaagcttatttaataatcctcttaataaaaccacctagtgttatttcgaatttcttaaacaaaaaacacatacatatgatacatatctcaaagcattacggaattacctgttttgttattatttatgcttcttgtttaatcttgaagtcaacctcttgtacatctcactattgtttaaagtggaaccaacaccaactgctcttgcgtttgtaggtactgcgctaaggttactcacaggagcatacttgtaatcagtagtggtttgtgctggtgcggcagccctgtttctccttgcagcagcttgttcgtacaaggtttgtaccgaagaaccacgagaggtaggatcttcaccagacttagatttctttttcctatttttggcagaatccataacggatttctttctcaatttttcagaatcaaactctaattgcattattctcttatctctgtagttatctgaagcaccaataataggtcttgtccactccgcaattaatttttcagccaacctagctagttgagcttcgacacgcttggactttgtataaaagataactactctccccaaaccactctccttcaggtgttcagttttcactggtagatcgtttaaagctgcaaagagtgacttttgaatctcaaaagatggcagagacccatcaggtaagggttccaaccatattctgacactttgaagtaagttattatccaaaatggtgtctgccaagtttgcctttgacagtacgcttaccaccttcggcaacaatttgaccttctgcatggcaatcagcgaagtatctccagtttctattctcttatttaaagtatcgatgtccaactgtgctgcaatattcatttcgtctttaagccttagaattttttcatccaagtactgttctaaatcgtcttcatccctcctcgttcttctaacctttggttttttcaatatacggtccagtttttcttccaattcctgtctactacttggagtagcacttgaatctctatctttactagccctattttccaccgttggttgaagactctgatcattatgctcctccttttctaggtcgtcatctgagaaatctgtgctaatgtgcttacgtttcctttctgcagcttctacgttactattttcgtctattgcggcttcctcgttcttttctccgttatctgggtctttagtatcattggaggtaccttttgaagtttcttggggttccatactttgattttgttttgtattttcattctcagcgtttatagttgacttttgggaggaagctgtcccatcttctggtgtcgcttccaccactttgggttgttcttgatcggctgtactcattgctaattgatatgtttttgccttttattactaaaagttcctctatatatacttcagaggacaataaactcccttgatatggcctgcatatactttacaagtgctatcaaacaaagatgctgggcaatgaagctgacagttaactcttccaaaacttcccttcaaagaaattgtgagagaaaaaaaccttcttgttacccttctttggaagaataccgcacatcataaaatcaagaaatgaattcgaaagtttactctttctttctagaggcgttacaccaatattagcgaattgcagtttcccacaaaaggcgtccattggcatcaaataactagatagtataaaatgtttggtctacctcaacaggaagtctccgaagaggagaaaagagctcatcaagaacaaactgagaaaaccttgaaacaggccgcttatgtggctgcgtttctttgggtttccccaatgatctggcatttggtgaaaaagcaatggaaataattccccactgaagaaaaaagattgcatctatgaatgacactaaaatatgtttctctttttgtatttgcttttgattaaataatggtcaatttgcgccccccaccttatatagtttagagaaagacgtgtaaatattttttaaaaaattgatactgctctaatgagcctaaatctcctttcttcgcttgtatatatgcgtattctgtatgtttgtccaggcagatttttcggctttttttaccagcttttattattaaaatgtgataaccttaattgaaggttgcgatacaaaataatcctttattacgcataaccaaggaaaagagaaaatcagtgcacatatgggtttacctgaagttaactttcttcgaaaaaactgcatacttgtggagttaaaattattctatcaaacagtatacccaccgaaggaactatattggaataaccgaataactgcagaattgagtacattctccaatattaagtatgcaaggccgactttcgcagtaaataatggcacatttcagagaacaagaccgaaattagacttggtactggcttcatctgatattcgtaagctggctacggttttatttaatttaaaagctctcataatgaatacgaagggtgaggaacccactctaaccacgatgactagtgtccaaacgaacgaagagaaaaatgataacctggaacagaaatattcaagtctgctagatagatggaatgggaaagtagaagtgcatgattctcctttccttcaactccaacgggacagcaaccttttgtttgctgagaggccggtacgttacgttagcactacagaaggtgaaggcgtggacatatctagtgaagagtttttcaggttagaggaagaacagtgccgaaggaattatgatgttttggtcgatgaacattctacaccatcagtcgggatgaaagacggccaatacggaccaaatataattcactttgaaccgtcgctgtaccacacatattcttctctaccaatgagtatgaaattttggttaaatggtctagaagacgacgaaacgacgatgatgaacattgatgagaagtcagccgaaaatctggatatattattacatggtttcaaaggattttcgaacaagcgcgttaaaggatgaattaatcatcctcttcatgtactacttatgtccaatttgagtgtaaaatcacaggtacaaggcttatccatattcgtatatatcttcataatgtttcataattgcttcagaaaattattcaaaacgtcttgtgatattcattaggtgaaatcgtagtttgcctgatacttgaaagaatctcacctggagaatgggtgttttcactaagattcgttaatttccactaatgattaattgttaactgtttaacgcgacgcgtaataaagtttcctgaatacgccaacatatgggaacatatagattaaattaataagaaagcttgggaaaaataattgagaagggcaagaagtgacgtaaatatactagacgtactattatggtttcagttatagacaagcttgtttttgactttggtgggaaaactctggtctctctcgcaccagataataatactttgtgtgtagccaataaaaatggcttaaccaagattctgaagacaaataacccagaagaagagccagagactttagattcttccaaattggtctcgtctataaaatgctattcaaactcgcactttctgatgactacaatgcaaggtgatgctcttaggtataacatcgattctagtcaagaagaattattggctagatttgctttacccctacgtgactgctgtgttattcattcaggtaaaatggccgtatttggaggagacgacttagaactaatccttttggaattggacgatgaaacacacaaaaaacatgccattaaaatcgatgaacaagtttctcaaatttcttacaattcacagatgaatattttagcagtttcaatgataaatggtaaggtacaaattttttctctgacatctactattccaaacaaagttcatgagttaaatgattacatagtggccaattcatatgatgatacacacagagataagatactctcgaatatgatggatgatatagataaagacaatgataatgacctgagtgaaacggctgatccagatgagaacaatgtagctgatccagaattctgtgctgctaatagaatttgcacgagagtggcttggcatccgaagggtctgcattttgcgctaccatgtgcagatgatacagtaaaaatattctctataaagggatattccctacaaaagacgttgtccacaaatctctcatcaacaaaggctcatttcattgatttgcaatttgacccgttacgtggaacttacattgcggcagtagatttaaataataagttaacggtatggaattgggaaacttccgagatccactacaccagggaattcaaaagaaaaattactaatattgcctggaaaatccaagcggactcaaaaactctagaccttgttttaggtacctggtccggtagtatagccattgtccaaaatttggcagagtccgtagtatctaatatacctgaccaatctgttgctgaatcttcaactaaacatgggctttttgtagactccgaatctgacttggaaaacttagagggaaatgatgatataaacaaaagcgataagctattttcagatattactcaagaagcgaatgcggaagatgtgttcactcaaacacacgacggccccagtggattaagtgaaaagagaaaatacaacttcgaagatgaagaagactttattgatgatgacgatggtgctggttatattagtggcaaaaaaccacataatgaacattcttattcgagagtacacaagactcattcgtttccaatcagtttggcaaacacaggaaaatttcgttatatgcctttttctccagcgggaacaccttttggctttactgacaggcgttatttgacaatgaatgaagtgggctacgtatctactgtcaagaatagtgagcaatacagcataactgtctctttttttgatgttggacgttttagagaataccatttcgaggacttatttggctacgatttatgcttcctaaatgaaaaaggcactttatttggccaatccaaaactgggcagatacaatataggccacacgatagcatacattcaaactggaccaagattattcctttgcaagctggtgagagaataacaagtgtggcagccaccccggttcgcgttattgttggtacatcattaggctatttcagaagtttcaatcaattcggggttccatttgctgttgaaaagacatccccaattgtagcgcttactgctcagaattatagggttttttcagtacattattcgcagtttcatggcctttcatactctttatctgaattgggtacttctagtaaaaggtactataaaagagagtgtccacttccaatgagtttaccaaacattaattctgatatgaaaaaagacgcaaatcttgactactacaattttaatccgatgggcatcaaaagtttgttcttttcaagctacggagatccatgcatttttgggtccgacaacacgcttctattgttatcaaagtggagatcaccagaagaaagtaaatggctccctattctagatagcaacatggaaatatggaagatgtcaggagggaaggaaacgacagatatacatgtctggcccttggctttggcgtatgacacattgaattgtatcttagttaagggcaagcatatatggcccgagtttccccttccgttgccatccgaaatggagattagaatgccagtatttgttaagagtaaattactagaggaaaacaaagctatattaaataaaaagaacgaaattggagctgacaccgaagcggaagaaggggaagaagacaaagaaatacagattcctgtttctatggcggcggaagaagagtatctgcgcagcaaggttttgtcagagctgttgacagatacactcgaaaatgacggtgaaatgtacggcaacgaaaatgaggtattggcagcattgaacggtgcatatgataaggctttgttacgtttatttgcgtctgcatgctcagaccaaaatgttgaaaaggctctttcgcttgctcatgaattaaaacaagatagagcacttactgcagccgttaagatatcagaaagagctgagctgccctctctcgttaaaaaaattaataatataagggaagctagatatgaacagcaattgaaataaaaaaatgtaaaatatatatacgcaagagacaattatttgatacctgttcatttgttcaaatcatcgttcaaaatgctcccacattaacatatatttctttgaatgcgacgataataaagagttacgttgaacatgatctgagctggaagcgtccttgcgaattttcgcgaaaggaaaaagtgaaaaaatatgaaaaaaaaaaaaagagatgacattttatagatgagctttgattaaacagtgtaacacctggtcctgtaccgtaaatattcaaataagcatcaattcaaagttctttatttcttctttagcatttcaaaattatagaaaatctagaaaagatgtcagatgttacccaacagaaaaagaggaaaagatccaaaggagaagttaatccatcaaaacccacagtagacgaagaaatcacagatccatcctcaaacgaagatgaacaactagaagtttcggatgaagaagacgcattggaatctgaagaagaattcgagggtgaaaatccagccgataaaagaaggaggcttgcaaagcaatatctggagaatctgaaaagcgaagctaatgacattttaactgataataggaacgctgaagaaaaagatttaaacaatctcaaggaaagaacaatcgacgagtacaacaattttgatgctggagatttggataaggatatcattgcgtccaggttaaaagaagacgttgctgaacagcaaggccgagtcttcagatattttggcgataaacttctaatatctgaagcaaaacagagctttaccagggtaggggaaaataaccttacttgcattagttgtttccaacccgttttaaacaaatacaccttcgaggaatcatctaatggcgataagaacaaaggtaggttatttgcctatacagttagcaaagacttacaactcaccaaatatgacattactgactttagcaaaagaccaaagaagctaaaatacgctaaaggaggagcaaaatatatacctacgagcaagcacgaatatgagaataccacagaaggccattatgacgaaatcttaactgtagcagcctcaccagatggtaaatatgttgtcacaggtggaagagataggaagttaattgtatggagcacagaatctctatcacccgttaaagttattccaacaaaggatcgccgaggggaagttttatcgttggcttttagaaaaaattctgatcagttatatgcatcctgcgcagattttaagataagaacatattcaataaatcaattttcccagttggagattctttatgggcatcatgatatagtggaagatatatctgcgttggcgatggaaaggtgtgttaccgttggtgcccgtgatagaacagctatgctttggaagattcctgacgagaccagactaacatttagaggtggcgatgaacctcaaaagctactaaggagatggatgaaagaaaacgctaaggagggagaagatggagaagtcaaatatcctgatgaatcagaggcacctttatttttctgcgagggtagtattgacgttgtgagtatggtggatgattttcactttataacaggctccgataatggtaatatatgtctatggtctctggcgaagaagaaacctatcttcacggaaagaattgcccatggtattttacctgagccctctttcaatgacatttcgggggaaaccgatgaagaattaagaaaaagacagttgcaaggcaagaaattgctacaaccattttggatcacatctctttacgctattccatattcgaatgtattcatatctggatcatggagtggatcgctaaaagtttggaaaattagtgataatctcagatcatttgagttgctaggtgaattatctggcgctaaaggtgtagttaccaagattcaggttgtagaaagtggtaaacatgggaaggagaagttccgtattttggctagtattgccaaagaacacagactcggtagatggattgcaaatgtttcaggtgccagaaatggtatatattcagctgtcattgaccaaacaggcttttagattgctgatattgccgtaattttccatgcccttttcactctctcagaacgcaaagcggctccggctcccaagtatatagaaataagcatatagaatgaaatgtatcttttgtaaaatatctaaaaaaaaaatagtacatgtattttagtctttttggtacattaaaaaagttttcattgtcacgtatctgcaatggcattcttcacaaagcatgttagatgcggggggaggggaatgattatggacaagaagaccaatattattatttattcttcaatggaatcggaaatagaatgaagaattatgactccctgatatgcgaatagtttgaacctaaaacgcgccaggactgtttaaaaataacaaaatcgaacattgttagaatgaaactctaacatgttatctatttagtagtatgaacggaaggataaataatcgaaatattattatgtagaaataccgattccattttgattcttatattctcgagagaacttctagtatatctgtatacataatatgatagcctttaccaacaatggaatcccaacaattatcgaattatgagaaatgggtgaatgttgagataattgttgggattccattgttgataaaggctataatattaggtatacagaatatactagaagttctcctcaaggatttaggaatccataaaagggaatctgcaattctacacaattctataaatattattatcatcattttatatgtttatattcattgatcctattacattatcaatccttgcgtttcagcttccactaatttagatgactatttctcatcatttgcgtcatcttctaacaccgtatatgataatatactagtaatgtaaatactagttagtagatgatagttgatttctattccaacataccacccataatgtaatagatctaatgaatccatttgttagttaatagtttaaatgtttttatcggaagaggttttgtcatcacatcagcaatgttcttcttggtctcgatgtagtatacgtatagattattacctgatacttcatctctaagtctcattgcctttgtgccaaaaaatctgtttctaaatttctcttcatttgtagacttaattatactgatcgttgatctactatcagtaagtaagcctttaataattggtttcttgttaagttcttgcacaaggtgactgaggttattcaatagcggaatagcttcactgactgcgtgtatttctgcttctgtagttgaagtgcatgttaacgaagcctttgtcgactttcctccaatcacttttccgttgagtaggaaaatgttaccaatttgtgacttgtaatatggttggttaccatatgaagcatcgcttattgcgactagtttattatctggctcggtaggtttgtttttgtgccatatcagttgtttatctctagtgtcccacatgaattgtattaactcatatgtcatgtctaaaacttgcctagaggggaatagtatatgttgagcaagtgtgttgatgtagtatagtaagtcaaatctaaatttatatccaacatatgaagctagaccaatcaacttttgcatttcatgtaccttctctttgtattcatcttcatctatttctagttcatcctggtctatataaagacctggttgacctggagcgctaagttttcttccttttggattcaaaggtacgtttaatttgggtattttctcagttaatgagttttccatacctaatttcatgtatttacctctttgatatttgatttctaagccaagtatgtcgtactgaatttcgttatcactttcacccagatttattatctttgtatcgtattgtttcttgagtgttgttatgattttcttatttgcatttaagtctttgctgaacaatatcatatcatcaacgaataagcaaattgttacttgactattcttaaatacgcatgaccatccacgaacttcttccataccacactgttttatcaggtatgatttgatagtttcgtaccagttcgctccactttgtttcaatccataatgtgatttcttcaaacgtatcaacttatcattcattcctaaatgtggtggaggtcttatgtataattcttctttgatgtctgcatacaaatatgccgaagatatgtctaattgtgtaatatagtagttattgtctaatgcaagtgacagggatgtcatcaacgcataatgatgtacagtgttggattgcatacctgtatcgtacgtatcaggatgctgaatgtcacctcttgcaacaaatctagctttatgagttccgtcacgtttcttgttgaagataaacattgagtttattactcttttagggtctatttcttttctgtcataatatttgtcagtgtcccaagtattcattttcaatagttggttgacttctttgtggtatgcctcgatatatttttctttttctttaatatctttattataggtgattgcctcatcgtatcgtaaggttgtccgtattggtttgattgattttactgcttttacagctgcaatcaggtgaattcgtttcttcgatctcggaggttctaaactacgcatattcttagtattccatgtgtctcgtgataccttaatttcagtttcattatcttctaatgatcttttcttactgttgatagtagtataggcattagagtcaccaataccacccaaactggaattagtttgatgagaatttatcggtgggagttctttaaatgggtcagggaattcggtaggagattctggaggtagatcagggagtgggagatcagcgatgatagattcctcggtattctgttcagaaacagtagttggcgttttgataggaacaatattgtgcgatgaattattttccggtggagaagcatcgattgaaggtgaacggtgtataatccttttctcagtctcttggtcacttatctgcggaacagttttgttgttggtaccacccgtactggatattggtacgtttgtatgattagtctcattttcactgtacgagtctgagtgtctgaaatctttagatttactggcgtgcgacgactcatgtgtgttagattgggacatgggagcaagtaaaggaacatttaatttatgcataccacccgaaccggtactctcgatattggaaatttggggggtgctagatctcttctttgatggaagaatattagattcagatatgttggggtcaacttctctgggtgcgcgaatattggttttagaaacacgtttcgaatcttcagtatgagttgacggaggtgtggaatcggttggactcacagcttttgaaaggacatttctcggttgctcaggatgtagttcaatgtcggattggaagtcatggtcagattctatgttaagatcattggattcttggatctcatttgacgcaatgaacgaatgatatgaagcagttaaacggtttaagtcttcatcgaaagtgagtgcgtcgtaattgaattgatctaatctggattccttgccctgaagaataacatagttagttgtatctactgtcttctttaaggatggaagatagatgatatatccataagagtttcgagacggatgtagagcgtagcctgggatgccacgaggatgtattttggagttagggttgtgatcattgacgataacaggttgaccgaaaggtaacaaagtactgatatcaagtcctgccaagccagcatgttgtcttgcagattttttgcttttaggtgaagctagtgaatttctcacaatagtagaaaattcgattgcagagaaccataaatggttcggtaaaccactacattgcagttgagtacggcagtcatctaataaggtacggtttagccgttcagcgactccatgtgctcgggaatccgctgtggttgtatagcatggagttataccatttttttcaaggaatttatggagagttctgttagtatactcagaaccacggtccatttgtataaccaagacactggcctgaaactggtttttaataaaagctagtatcgtagtaaaaacatcgaggatagagtcctcgcgacggtcgtgtaatggataaacccaacggaattttgttgtctcatcagtaaatgagatgaaataggatggtgcactttttggtaggttgtgaactggaccaaatatgtcagtatgtaggtattgaaagggttcgtatgaattttggtattttagtcgtgaacctttgatatgtctgtgtttggtgcttttgccgattaaacaatcaggacattgatagtcaatagcactagaccagtcgacatctgattcgttaaaatacgtgatggtgttatttttaagtgagtatcgaattgtctgtgcattggcatgcgcaagcattcgatgaatgaaaggataaggatatttgcgtgtactttcacttgtatggacattattgatggtgggtacggagatatttgatggaagcaagtactttttagatacccagtaaaagtctccatattttacgataggtgcaagtacagtgccgtcagaccgttctaagacgtttttggtaaagcatgctgtgatatctactgcagccaattcattcaaactgagtaagtcataggctatgttaggagtgtgcaatacctttattgatgttttggtgttgtcctggaagtgaaattgtaggtcaccaatagcgttaattggtatatttcttttttgagcatcaactacgtttatgtcaggattagatgatgctgagtgtatgtgatgagcagatcttataagggttcgtgatgctcctgaatcgagaaggaggtgtccagggagttcatcatcagaatgattagtatgatttactgtagattcagtaagtttctggcctaagatgaaggtcgtgcttattgttcaattgaatcggttcagtagttgatttactgatggaatcgttgtccgtgctgggagagttattagatgtggatacattgtgagccctggctgttttcgatttcgaattatttgttttttgaggattccgagctataactttgggtttggttgtattcgtatagctgcgagaatcattcttctcatcactcggatttctcctgtaattaggtttactgtttctcgatccctgttgttcttcataaatagcatggatatctaagaacagttcagcgactgtcatatttagatgtcgatgacgtgtgtagcgtaaaaatttatattcgccagatagacctctcataattaattggcatgcgaccttgttattgatatgaatgccattattgttcagtctgtcgataatgtttgtgacttttgtttcaaatgcatctgcaggtgtactgccattatattgcaaatttgccagggtcacaatgtcgtttgcctcttgggtatcagattgcattttttcaatacttttggaaagaattttcatgatatccgtataatcaacggataggatgtctttgacccaggtaggtaggaattgagagggagcaaatatttgaaaagtgttatacaagaaggtgagttcatcatcagtgatctgacgtacgggttttccgtttactgtcggaataataccaccgagattcgagttttgtaaaaatttgatgtatgttttaacccaatttggaaagtcattaggtgaggttaacattggtggtggtctgacatattttttagtggatgtcatatcagagtccgctgaggatgaatcagtaaatgtattacctgactcaggtgatggagtgctcagaggcgttccaactgatgatggatactgcggaaactgtgattgtggcccaggtggaaagtacataggcgacatttgataaggtgtatacggaatcatagatgggtgtccgtaaaatgaccaaccagatggattggcttggttttgggtcatcatgcactgctgtgggtacggcccattctgtggtgaatgtgactgagcagtttgaggagaggcatgatgggggttctctggaacagctgatgaagcaggtgttgttgtctgttgagagttagccttagtggaagccttctcacattcttctgttttggaagctgaaacgtctaacggatcttgatttgtgtggacttccttagaagtaaccgaagcacaggcgctaccatgagaaatgggtgaatgttgagataattgttgggattccattgttgataaaggctataatattaggtatacagaatatactagaagttctcctcaaggatttaggaatccataaaagggaatctgcaattctacacaattctataaatattattatcatcattttatatgtttatattcattgatcctattacattatcaatccttgcgtttcagcttccactaatttagatgactatttctcatcatttgcgtcatcttctaacaccgtatatgataatatactagtaatgtaaatactagttagtagatgatagttgatttctattccaacaaattattcatcaaatacatctcgatatccatattttggttgcaaagaaataaataccggagatatgattcagatgtggaagcggttttaaagtcccaattcatcattatttgcgactccatggccaagttggttaaggcgtgcgactgttaatcgcaagatcgtgagttcaaccctcactggggtcgtattttttactaaattagtttttttttagggaacagacgttaagttttttaatattattatggcatatagaatggtgagtaaaaataccaaatgatgaaatgaatttgttttgtgagtctatgataaaatgcagaatataaaattaaaaagttcagaaataaataaataaaaaaaaatctagtatcgcggcacttccgttcaatgtgccgacgagcagttactggggagttgattcatgcttcttttgcgtgatgcaatttaggattattacttttttcgttttggccgcttactgtagctgatgacaatgaggagttttggctgtcctcagtaggatttgtctcagacgcagaattagcgccattgcatgtagtatgaagtgcatctgtatctacaccccactggtaataatctctcctaacctccacgtaatcgtaagcgaattcgcctatttgatcttcatccaaccccaatgcttcggcttcctcagtgactcttagatggacacccggaattttacctaatacgaagcaaatgatggccgtgaccacagcacaatagccggcagaggcaccgatataggcaatttgaatatacatttgtttccagttatgcgtcaaccaaccacccttatgctttgttgtgccgtccattccaataacccaatcagctgcaaatagagcgttaaaaatcaatcccaccacaccggcgataccgtgttcagctaatagatctaaggaatcatccacttttaaataatactttatttttgttgcaaaattacaaacaacacccgctattataccttggatcaaagagccatatagagtaatacaacccgagctaggcgtggcagcaactaaaccacagataatgccggagcataacccaacagtggaccattttttttcagatcgataatctaataaacaccacgtcattccacccgtggtggcgctgagacaagtgttcatgaacgcatatacggacctcatatttggtgacagtgagcttgcagcattgaaaagcaaccaaccaaaccaaagtatagaagtacccaaagtcaccatggaaacattatgtggtctaaagttgatcaggaggttttcttttcttcttcctagaaaataagaataaacgaaaccagccacagcacttaggatttcaatattcccaccgccagcccagtctaataccccccattggtaggcccaaccacctggggcccaaatccaataagtgatgggacagtaaaccaaagtcgcaaaaacaaaaagaaaaaccatatgtggaaaaagcttacctctttccgcagtggcaccagctataatactcaatgcgacacacatgaacatcatttggaaaatggcataaatcagttcaggatacgtggaatcatccgaaattttgccatagacgtttctaaacccaaatgaatccaagttgccgataaatttgttgttcgtcgcagtcttagagaatgctaaagaatagccccaaaaataccattgcagtatacctactaaggtagccattatcactacccaaatcaaagccagagcagattttcttcttgctaaaccggaataaagaaagcccagccccggtaccatgaagaaaaccagggcggcacctaaaatcataaaagcgactgtggaactatcatatgtctctgtccatagatgtccgtcaccccgagccatgtgaactctaaatctatatgttttcaattgtatcttctaaaaaaaaaatgccttcgctttttacaaaacaatttcaaaagtgattggacccttaactagcctgcattgattgtaatagacaatcaaagaaccaaaagagagaagaagcgaccgaaagaagacggctatcagactcaaagcacacaaccttattctacaagataggaaagggagaagatatctatcaaattgttgcgataagatgcgataagacaaggagagggaaagtccgtgctgcatatcagcatatcaaatctgctaaaacatattaacttaacatatatatataatatataaagtatgccatcgggtaccttaactaaaaagggtcatagcgtggaaagcgaggaaaaacctcgagatggaaaaccagtttatggaaaacttcaaaataactcgcccgccttatcgcgggcaaaccagctacgagagataaggatttggcgccgagataaggtggagatgtttctccgccgcgcggcactttttgccggaactggaactggtttgaggtaggtcaagaaagtgtcagtaaataggagtgacagaaacgggcacatctactcttctttttcttgtttgtttcgattaaatgcaatacatactcctaaagacatatatatataaatatgtatgcatgcatgcatgccttcataagtatttctacttcctctttttacgttgatcgctgatatattccttcacaaaattcctcttagattcaacatctaacttccgtgagactagtttatatttgtcgccaccgtttaatgcaacgcgtaattcctctaaattatccgagagtacttgtggctcgttgatcttgcatttaacattaatgcccttgttcagaaatctagataaatactccatattggagatgggcaatgtggtgatggcagttttattagttttgatttggatggtctgcaattcaaattttttagttttggccattgcggggttcattgtggttattgaagggtctatgaattctttaagttttttcccggttatactaaacggtaagacgcttttaccattacatgaggtaccctcagcaaacataaaattcacggtattgcccaattgagatagctctgctacctcgtggccatagagttttatatctaacccaccggcgaggatgaagttgatgaattctcttatggaaactttgtatacaatgtcattggatgggaccaacaacgtaacaggcccttgagctaataacaccactgaaaaagcatctaaaggtgaggtacaattgcaaatataaagcttgcccttctgtggataatgcttggatttccttacgtcacgtttcttgattccttgcacggtaatttcctctttccaactgaatgtaaacttcaatatcaaacccagtaagttgttctggccagttagaaggtacagcataatcaatggtagcattataatggttttcacccctaggatacccaacaaacacgctgtcatcaccttactaggtttcctgattgtgtttggtagaaatggagctattcccgtaccattgtctctccaattggtgtacttttccattacttttcttgtattttgtcacctcgtaggagctacttctttcacgccaggatctgacagtatttctattacgttactccagtcacgttgagaaaaggcttcatctttttcttttttcttgagataacttttttcttctaccttcactcagaccgagatatcggacctcaaacatagcgtttttttttgtaaaacacttaaggatggaggaacatgtatgctgagtaattccagcagaaaccatttactgagagcctcatcttttgttaaaaaatttgtttaataaaatatttcattttcaaaaaaaaaaaaagtaaagttttccctatcaaatgtcttttagggatgtcctagaaagaggagatgaatttttagaagcctatcccagaagaagccccctttggagatttctttcatacagtacatcattactgaccttcggtgtatcaaaactgcttcttttcacatgctataatgtcaaattgaatggttttgaaaaattagaaactgccttggaacgttccaaaagggaaaatagaggccttatgacggtcatgaaccatatgagtatggtcgatgatccgttagtttgggcaacactaccatataagttatttacgtctttggacaacataagatggtctttgggtgcacataatatttgctttcaaaataaatttctggccaactttttctcacttggccaagtcctttcaacagaaagatttggggtgggcccatttcaaggttctatagatgcttcaataagattgttaagccctgacgacactttagacttggaatggacccctcactctgaggtctcttcttcgctaaaaaaagcctactccccgcccataataaggtcgaagccatcttgggtccatgtttatccagaaggatttgtactacaattatatccgccttttgaaaattcgatgaggtattttaaatggggtattaccagaatgatcctagaagcaacaaagccgcccattgtagtaccaatatttgctacagggtttgaaaaaatagcatccgaagcagtcacagattcaatgtttagacaaattctaccaagaaactttggctctgaaataaatgttaccataggggatcctttaaatgatgatttaatcgacaggtatagaaaagaatggacacatttggttgaaaaatactatgatcccaaaaatcctaacgacctctctgacgaattgaaatatggtaaagaggcgcaagatttaagaagcagattagccgctgaactgagagcccatgttgctgaaattagaaatgaagttcgcaaattaccacgcgaagaccctaggttcaaatccccctcatggtggaagcggttcaacaccacggaaggtaaatcggacccagatgttaaagtcattggcgaaaattgggcaataaggaggatgcaaaagtttctgcctccagagggtaaaccaaagggtaaggatgattgaaatttaagcaattaaattcgtgtaaatactagcatgtatgaggtcatttttacataacaaatattcattacttactttgctttttatctgtgcgcattaaaatgagtttcatatataatatagttacatgtgatgaatgtatggacagtctctgtcatttgtcaaaggagtgaaaaagaccagaaaaggccttgacctcattttctactaaccaatctggtagaattcactttagacgcaaatcttaacgaattgagagtctcattaatatgagaggagcttggtgaaatgtttacaaacattaatgttttcgaatccccagtgagtgaatattgcagtaggtatgtcagttttgagttcctgaacggtatatgtcttttggtactatcaggctgacctaaagcatgaataacgtcacctaagcaacttaaagatttatttatattttgtgtttctcttaatctatcccctacaacttgagagacatttattctttcggaaccggccaaatcaacaagatttagtgtgccatacgagtgtgctccagtttttgcatttgatccagacaaatgaattatgaaaatactgtgtgaacgggaggaatgctcatttgatgctgtgctagcggtggatcttaatttatttgcttttttcaggattatttccaccatttcttccgactcaagcttgcaactcgtaacattcgttatcgtggtagtcttagtttcctgatcatgacgtatttcgtgctttaagccaatgcttgtgtcttctttattattattatcacttctcaataagtctacgatgttctcgttgtagatctcaatgaattcgcagttaactttataatcccatccttttgtctttaatttattgatccagttaaatatatgagatattgtggacggaatgataccatcacctggatttaacatcgtgaaagttttcccagatcctgtttgtccgtatgcgaagatacaaacattatatccatctaatgaactttgcactaactgaccaacttctttaaaaacatccacatttgtatcctgttgatcaaatattttatcaaatttgaattcatgcacttgcgctgtgttttgtattttcgtcacttccatagattgaacaccactattgtcatcaaattcattaacattaataaggctagtatcagaattttccaaattttttagagctggacgaatcctacaataaactcgtatatttcctcttaactcttgtaactcattatgcaatgtgcgtctaaccgtttcctctttaatcagaatttcattcaactccttcatacccagttcagtgtcttttatatattcctcaagttctttgatcttttccaaagtttctaaattagttttctgttttaatgccacctcatctctcagccttgtagtttcctcttccttttctttaacttttactttgatagcttcatacgcgttacgcttttctgttaagagcttctttttttctgccaactcaggttttaatgtattttcgatttccttttttatgctttcgatttcttgcatatgtttattattcagctctatatcctttttccactgcgattggtactctgtaagccattcttctttttcaagcatatgcttttgttcaacatcgttcaacatttcctgtaaagtggaagggttcatggtgattttatttcttacctcttctattttatctaaaagcgacgctctttcattttcaaactgtttaatcttcataaatttcaatttctcaatttttgttttgtattcattttccatttgtttcagctcttttttattagatgccgctagctgctttaaatgtatttcatgtccttcattcatgaactgcttctttgacaaaaattcttctttaatcgagataagttcattgtttttcaaattcagttgctgttcaatttttatcttttcttcacgaagggtttcaaatttgagattaacggcattgattttctctttcgtttctgttagttcatctttgagtaaatctagtgttgcctttttctcaaataagattgcttgtgttctattgagttcattaacattttctttataaaaggaagttacaccggagttgcttttctggtttccataaatcaaatttgctgtacctttataattctttaaaagctcgcgattaggtgacatggatatgcgactctgactagctaatgagtgtctatgaatatccgtacgttgcggcttcagaagagtgtgcttaggcggtggagttgttgtatttcttcttttgtggccattcatagctaaaatatcattcttcggcgatggtgtcgagagatgctgcgtagatctgccttttgtgggagtacgtggaagtgattccatagtttaatagttgccagaatttctctaagtcctttatttcaaaatctaccttttttaaacaaagactccggatagttgttctggtatattcaaatagaataataagaaacacaaagagcggaaaaattgatagctttaatgcttatataatattcgataatttttttagctgtaatactcatcatcatattttgattcgaggcgcatcaaattgtaaacagtgtttgttttgattttgtttgagattcattttggtgtatctccattaccctcttattggaaaattttgaaagaaaaaaatctaggattcgatgcccataagatataaggaaaggtaataaacagatgctatgaataaagcgatagagaagccgaaggaaaatcagtacataattgatcatgggctccaagcacagagtagacactaaggataagaaaagaaccagaaagaatgcagaatttgggcgtgaaaaaaggaatagtggcaaccaagagttaagtaatgagccggaaaaagatacaataatggaaggtgatgaagccgaagaagacgagcagaatagctctagcgatgaatcatctaaaattatagataacgaacaaagtgatgctgaagaagatgatgatgaagaagaagaggacgacgacttcccaagaaagaaaaaatcgaaaaacagcaaacatgatgatggttctactggattttctgctgcagtaaatgctattttatcatcacatctgaaagcatacgacaggaaggaccccatcatggctagaaacaaaaaggtgctgaagcaaagtgagtcagaaaagctagaatacaaggccaaaaaagcattgttggcagaaaaaaaaaagttattaggtaaagccagaaagacggatattattccaattgcttccggagaagacaggtcagaaaatattagaaaagtccttgagaaggagacagcgctcagaaagatagctcaaaaaggtgccgtgaaattatttaacgccattttagcaactcaagtcaagacagaaaaggaagtatccgaaaatttaagcgaaattaagaataaagaagaaaagaaagaattgatcactgaagtttccaaagaaaaatttttggatttagttaaagctgccgcaggaagcgacaatgaataatcaacatgttcatgtcaaaagaagaaaaaaaataaagaaataaaaactgtatattatttagtctatgtcaagcgagaaaggggccctatatcttccctcctccttgcaattgaattttgtttgcattctatattatcatatagtttcatatcaattgcaaaaacttttgcagccaatgttacaaaattgttttcaatcaaagaaatacaggtgtggtgtccttcaccatcgatatattaatattaatatatcatgaataaatataaaaattcaaggtaatgtacttgtgcacttcttttagaatatagcaatttcccttagctctttttcaaattgtaattctctacaatacataaaaagaaattgatctttggttcaactttatatatcgcaataagcaattctcaacattatgaaagtttatctaaattaaacaatcttcaacaatagaatggtctcttggcccagttggttaaggcaccgtgctaataacgcggggatcagcggttcgatcccgctagagaccatttatttttgacccaggtttttttcctaggcaaaattgataacagggacttactattttctatttttttttttttttacatctcaaacaagggaaatcgatgactctgttgatataaatgtatatatacacacttttaaaacttcgttgttcatcttcgctttcaccatgctaccccaggcaagtagacgttaccttgggatgacgcttcgctatcgccgtcttcattatcaaaaacgtttgtgaaagcctcaaattctaacgtaggaagtgtcttcaactttcttgaagattctgcattgagcaaagaatcatagttccagtctaagaaatcttccatgttataacttagcttcttaaatggttgagcaaatatcttcgccaacgtggctacattaggatgataatgttccatcaatgacgccagctcccacagagaggaatccagtgcatgagttaactcagggtccgattcatgaacatcgaagggatctacatagttttctttcagagttttcaagttcgccacttggtcaggtgtctggaatgggttggaaatgaaggctgggttgtgcagcataatcatacaattcggatgtttcctgattaaattatagatgaagggaatcacggtgacaatagcagagggtggtgattctagggtgagtctggctagctttttgatgaaagatgctactaaatgggcggataaatgtgttgatgacaaaaatacgtccattaacctgaaaaatcttgctctgtatttaacatgcattaagtctggatttataatttgataaagtttcatataaaaatttggatattccaagttgaatcttttcatcaattcaaaaaggccattcagagccaagatcggaacaacaccggcgtttttattagagctttgcaaattgtaggaatcagtaaggaaatccattagtttagttggagtgtggaaatgaggtattattctcttatgcaaaattaacagaatagacttatactgctgtaaagacaattggccgtttaaaagggataaccaatttttctcgaaattggacttgaatttggactcgttctctatggcttgtgggggatttggtacaaagatctctaaatctgcatcaacactagagcaatgtttgtcatgatttactaaagctaaccatttaccaacgtttttcaaaagcaagtcctggtaggctggatcctctaatagttggttaaattctgattgaaagtagtattgaatatctgcaaatttcgtataatatttttccgtgaattctactatgattaaattttcagacgcacccgagcttttgacatcctctatttcacccatgttcgaggaccatagggcgatgattaactttctgaatgttttattggggaaaaatggtgcgcccttttcagatgcaaaatgagttgattccagctctgcaagttgaagatagacatcaagcgaatctaacccaagtgatgtttcgaaaggtatgtccgaaatgatagctaacagcttcgtcttgaacgcttcatacacctttctacaccaattaacaaactgttccttctctaatgtgctctttttggacgaaggaagggtcaagtcgccgcgggaaaacagctttctaaatatctggaatagcgacataaccagaaatctcaaatttttttctgtctcatcttcttccaattgagtaacattttctggaatcactagttcattgattaacttgataatggagttgtactgctttctgtcacccgcagcagtcagcctcttggcaatatctttaatttctgatataagcaataccatattctttgacgtttctttttaatagatctctcttcatggcaatagaggatgataattacatctcatctcatctcatcaaaaccgtaatacacttttttttttctcagttggaaaattttagtgaaaaatttcaagaatagccctaaaccttcaaatacgaggattacccgtagagaagtgctgaaaaacttttttctttttcttttttttcgattttcatttaacaggtataaaaagcgaaacactcggtacatatattttaccaagacgcgttagattttctttggaggtttcatttaaagaaaccaatgaccttccaagtttttaaaagaatacgatgatattatttgcgtttcaaatcgaacaattcttctcggagcgatctgaggttttaatggagatagcggttcctgcgcaacccattgatcttgttacattcttaagaatgacaaggacgcttttataaaattctgattcttttttctttcattcttttgttgtttttgacttgggagtagtcatctcatctgtacacaagtagctttttatatgttcttaaattgtagactagtcaaaacttgtgtcctttaaaccgtgccgaaacagttttaaagcggacatccagggaaacttgccgttaacaataagtgaccttgcatggaagactgtcgattggtctctgtggaaaccagtgcatatctaaattaaatctattgtcatcacgaatgccgcccgtgttcgtgcaacgtgagcgcaaatacgcctggggtctgtctttctgcgctggaaagcaccttcgggcatcaactaccgtttcttatcgctggcactatctatccaccaatcacacggcagcagtactgctgccgtggacggcaaattaggtacagggcctatgactgttatcatttggcaggctcagacagagagagagagcacaaggaaaagagccttaactcatgtaacatttgactcattctgtaaactgaaaatttgctgcccactcgagatgacaaatagttcgttcttgaatttatgcgcatttatagatacgcatatataaccctatagtgaacgccactaggagacagattctgtttggaccctgatcgcatactcttcttacctttacataataaaataagaaaaagtataacttgctttacgctaaggatataaatcggacgtaacttaagatgtgtggtattttcgccgctttcaggcacgaagacgtgcatagatataagccaaaggctctacaactatcaaaaagaatcagacaccgtggtccagattggtccggtaatgctatcaagaactccactatatttgttcatgaaagactagccattgtcggtgtggaatccggtgctcaaccaattacttcttcagacggagagtacatgctatgtgttaacggtgaaatctacaaccacattcaattaagagaagaatgcgcagactacgagtttggaacactgagtgactgtgagcctatcatcccaatgtacttaaagcacgatatcgacgctcctaagtacttggatggtatgtttgcttggactctttacgacgctaaacaagatcgtattgtggcagccagagacccaatcggtattacgacattatatatgggacgctcttccgcttctccaaagaccgtttattttgcatccgaactaaaatgtttgactgacgactgtgacactatcactgcattcccaccgggccacgtatacgattctaagactgacaagatcacccgttacttcacaccagattggctggacgaaaaacgcattccttccaccccaatagattacatggcaattagacactccttagaaaaagccgttagaaagagattaatggccgaagtcccatacggtgttctattgtcgggtggtttggactcctctttaatcgcttccattgctgcccgtgaaactgcaaaggccactaacgatgtcgaaccatcaacttacgatagtaaggcaagacatctagcaggtatcgacgatgacggtaagctacacactgctggttggacaagtctccattcctttgccatcggtttaccaaatgctccagatttgcaagccgcaagaaaggttgccaaattcatcggctctattcatcatgaacacacctttacattacaagaaggtttggatgctttggacgacgtgatctaccatttggaaacttacgacgttaccactatcagagcttccactccaatgttcttactatccagaaagattaaggcccaaggggtcaagatggttctttccggtgaaggttccgatgaaatcttcggtggttatctatatttcgcacaagctccttctgcggcagaatttcacactgaatccgtgcaacgtgtcaagaacttgcatttggcagattgtttgagagctaacaagtctacgatggcttggggtctagaagctcgtgttccattcttagacagagaatttttgcaattgtgtatgaacatcgatccaaatgaaaagatgattaaaccaaaggaaggacgtattgaaaagtacattctaaggaaggcattcgacaccacaggagaaccagatgctaagccatatttaccagaagaaattttatggagacaaaaagaacaattttccgacggtgttggttactcctggatcgacggattaaaagataccgccgaagcagtcatttcagatgaaatgtttgccagtccaaaggccgaatggggtagtgacattccaaccacaaaagaggctttctggtacagactaaaattcgatgctttgttccctcaaaagaccgtggctgacaccgttatgagatggattccaaaggccgactggggttgtgctgaagatccttctggtagatatgcccaaattcatgaaaaacatatcgaataaataacattaaaaaatagaaaaagaattatggattaatcttatagatatttttatagaaaaacaaacactaacaataataataataataaatagaatatagaaatacatatttttcataatagtttgatgaagttttattcataaatcattttttatcgccagtgctaaaaaattaagtgtgtggatgactgtatatatgcgtatcgaacgatcttgatgcaaatcattttgaaacattattcttgactttgatatttcctattatacatcctccttccttgagacccaataatcttaaaaatgatggagacagtgcatgccctccttttcacccttcttttatgtcgtttcttacaattttcgagattcttttgaatctgatctccttttaccttgtgactgaagattcctaatcgaattgctcctctctagcgacgccctttgtttcatttcgtgtgcaattagtagatcgtgccttgttattactgtattcttatttcttgatttaatttccgctcgatagttttgcggatattgactatcacttttcttaaatattagttttatttttctgaaggcagtgctcatatgtaaagtagtaacgttgttagtgcagtgttagcagtcaaacctaaaaataaaagtataaaaaaactatatctattttttttttgtttgtttacgcacgtttatatatttaacacggtgaagtagtcctgccattatgctgctctaacacaagagtcgtatatggatgagctaatgactaagatccgagtagcgaagtcatgtatgcaagctaacgcaacaaggctgtaaagaatacaagccttgtcaccctagtaccagcatcaagcaaattgctcatttacgactgtgccatgaagtagggatgaatgaggtgtttctgatgacacctctgaggagcttttcttgagctcgtttctgtgccactttttgttcccgcggctaagccgcgcagaccgataatactcgcttagatgcacatcaagccaaatctctataaaaaaatcgacgtttcccaaacgacgctgaccctttattcatcgttatcaaaaaaaggcagctttccagtgtactcatacgagaagcaatcgatgcctcacttccgtttgtagatatatacatatttacatgcacactaatgcaattatatgcgagaacaatttgtgagatcataaggtctcgtaaactgtcaattgttgagcagtcacccagaattgagagttggtataaaaacactattaccctcatcgaagccattgcattcaaacttgccatcacactaaaaaaatgcattgatagcatattctgcatgttttactacaaatgaatgaggtattttgtcagtgacatcaatttttaagcgttcctgcttgactttatccttataataatccgacaaatgtgatctggtcttaccagaaacccaatggtcgttgctactgaagagaaaccaaatagaaattccgttctcttcgcaataattgataaatctatcttgaaactcccagttcgtagttatttcttccatctcctgggcagctaatcctagagattgacgaacaaactgcctatgagtcaaaaaaattcttgtagatagtactgcctgataaccagtacttccacagcccataaatttatcaataataaatcttgaaaacccttctgataagatccaataaaagaaaatataactgaacaatgataccacatgagccaatggtggaatataacgaagtgccgctgtcattttgatacccatctcagaggtgtgaatgtccatcacagttggtgtaacgagaccaactttttgtacggagccaaccagtttgttagaaaggcatactttttgtacgatgtatgccccaaccgaatgtcccataataataattttcctgttcttgcatgagaaattgttaattacctctacctgatgatctacttgatcttgtaaagaaaatatcggtgtattagaatgagcgttcaatgtcattccggcatgggatatgccaagaatttcccaatctgggtgcttcaagtgtagatgatgtagcatttcttgataatagtataaaagcccaggattaccagggatccatactagaagaggcgcatcctcgccacttttagtgactgtaggtttgatattcaatatcgagcatggcaacttcgatttagtatactcttttacagtcatttgtcactagaattgagcaggcgggcaatggcgtagcaagcggactgtctattttccctccagtagttttgggctttgctgccgttttaatgctgttttcctttcctcttaatgagcgctttccagttgcgatacttttcgggtaaggaattgtaaggacagcgacgcaattcaagcggttaaatagaagaaacttacatcatatataatgtttaaaaataacaatcaaattactttatacatgaatgagtaatgttttagttgcctgatttgctaaatttccaaaccatttagaactttaaggtttgcctccacttcttggacacattgtctaaagtaaaccaactggaaattctggaacagttttatcaagcccagaatttcagaactgtcagtgatttcttccattgtttccactgctgctgtagtattggagacaaattcatcctccagtttttccagtaatttattatcctcagattcttcaatcggtggctcatcatttactttgttactctttaaatcttcttttctatcagcaacgtcatcaacagtaggctcattcgcttctttctttgattcctcttcggcaccctctgattttggcttttcatcctcggtagaaggcgtttcgtcaaaagaggtggtagtgtttgcgctaatgtcctttgcgctaacatccttgctatgtgcttctcctgtggcttcagcttttttcgcctctaactctgcttcttttgctttgacttcataacgcattgtatcaaatttgagtcttgattcttccacttttttgcgcaggtcatggaccttcttgaagtcttggtttattaatgtttctaattttttgttgaattccttgaccatcatagaatccatctctgccttcccttcatcgatatttttatagcatgtcgaccacgaatcgaaaactttgatcaaattagacaaatcttcatcatcttcttcatcttcttcatcttcctcgtcttcttcattatggtcggcaccctgagcttccgttgtctgtgcagttttgatagactcctttttcttctttagttctgccttttcgttgtgttctaaattttgaaattcacattcgcagtcaacagcggcttttgagatggcttgagcaaaagaccttggcaaaaaagcatcgtcatggttagatcccttttttttagtggaactttcggattttttagagccaaaccagccatctttattgagagaccaccaatccgaaatactctccgttaaatttggtggatagtcgtagccctctacttcgaacgttttggacaccagtagaatccttttacataccttctctaaggaatcactttttttctccaagaattggtactgtggtggtaatttacttatatctgatacagtacccaatgattcctgaacaaatctagttcgcgatttgattgatagtcttgtttgagggtcatttaagtttacatttgcatttgctaatgcattgttcaaagtgtcttgggtcttgtgagcagcggtggcaattgaatcggtgatcttgtttagagaaaaccctgaaaaataaccagacattttctaaccagaattttatggttttacctaactttgctgttcagatgtataagtattgcaacctttttttccctgatcattattatttcaagagaaatgaaaaccaaaactgggatatgcgtgtcgagtgctaaaaaaagccaactagcgatttaagagtgagaagtaatcctcgttaaaagcgatgcagagccaactaactaaactgctaacctcgctttctttacacaagtagtactcaagaagtttcataaaatgcccagttacacactcgtgaaatgcacttcaaggtggtgttacaattttcacgaactgcaacaattgagtatatttattaaagcaggaatatgtttgcccaatcaaacgtaatttcatatatgaacatatatgaagttgcacacatcagcgggaaagatgtctctaccgctcgaggagccacacgtttgatttgcaatccatgaaatagaactgctaatcccatatacaattaactatatcaatttcctgaacaaagagattacaatcaacggcaaagccgcctgcctctccggagatctccttttttcttctttcttttgtcctatgttgcatagttgctcatgtcttttccttaggcggacaattaagagcagccacaatatttccaaaactaaattgctaaaaaagcgtagcaaaaaattctcgtcattcccactttccctaccttaacccttgatgttaacgccgtttcgctcatcggaacaaactatacagataattaagcttttcggcagcggtgagaaaggaagcagccaggaggaatacgcggctttctcgcggagcccgattgccgatacaaaggaactgttgcctcctcccggctatttccataggccttcattcagcatactgttgtgtagttgcatcacatccttgttgaatgaattccaactatttcgataaaccatcccatgaaggagaatgcaatgcggcttttgtttgtaaacgggcttgagaggttctatgcggttaattctgtcactaggggtccgaatctcggattaagtataaaatatgtattaccctgatgattgaccggatgatgtaaggatgcatgtccctactgttttggtatttccacatacggacggggccccgaaacaccacccccattttaacggccgcatctgagcatcggcccatttggcacacgcccgttagtgacgttggtaggggcatttccctgaggtaggcccaaggttgctttaaaaggtccatcgcaaaccccttgtccgcggacctctgcgtcataattaaaatgcccaaaacataaaagtgatcgccccctcacagaaacttatgggcagcttgctgccttaacggaattgactagaattggtttgatttttttttcttcctacttcttcttccatttccctcccctcttcctcatatatgtatacagaaaaatcatacccctataaattccttggccccaatcttctgtcagattttcctttataaaagagtctttgttttgtaattaaaagatacttttttctttcttcttctacgtctccttttttttttttaagaaaatttaacttataccactattttgttcgcaattgatcaagaaaaaatacaattgaaaaggttttacatttttaatttttctgctcatcgcgcttttttaaaaggataaataaacatttctttaaaaaacatcttcaataagaaaaatcggttaaaaaaacttttcttctcaaagcatacctaataacaatataatcccataatgctagccctagctgataacattctacgtataataaatttcctatttttggttatttccatcggtttaatcagttcgttgttaaacacccaacataggcacagctccagagtaaactactgtatgtttgcttgtgcatatggtatattcaccgattcattgtacggtgtctttgccaacttcattgaaccattggcatggccactagttttgttcacactggactttttgaactttgtgttcactttcactgccggtacagtgttggccgttggtatcagagctcactcatgtaacaacagctcatacgttgacagtaacaagattactcaaggttccggtaccagatgtagacaagctcaagccgctgttgcattcctctacttctcttgtgccatctttttggctaagaccctgatgtctgttttcaacatgatctccaatggtgcctttggttctggttctttctccaagagaagaagaactggccaagtcggtgttccaaccatttcccaagtctaattgaagcgcaccaacttaaattttacgccactttcaattaagaatataataaatggacaccgtgaataaattagggaaaaaagaaagcaaataagaaaactccgttttccctcatccctttccgtctttcggaagaaacaaaaaattatacccaaggaaaacccgaaaaaaatgaaaaaaataccagaaaaaaaataacaaatcatatgcacttcttcattaacgattatgaagaagtcttatttctaactaatattattattattattattattattatcattcaccccgctttcttttattataatttgttcttctaatattttaatttttaatcttttcatactattcttatatctaactaaagtatccttctctttgtctagttttacttcactacatacctgttgcgttgatttgagttttttgtatgtaagttctgtttatcctttttcatcctaccgttccgcgcacggcgtgacgtggatccctaatgtgagttcaaatcggttacaaaaattaatagttttgtttcctattattattattattattatgtatgaggaatcgtgctataaaatcattttccatatgtatatgccaaatatttattatttatttcatcttttttttgcttttgtgtgtcaaccgcatttgcagtgccttgtcaaacggcttcaactttctcatcatatatgggggcacgtttttccattcaggaaaatattccatacccatactggacgtagaccaccaattgaatggcaacagctcattgggtacggtgggattgtacttccatgtaccgttcacgccacctgacattataccaccagtgccacgttcaccaaacaatatgttcttgtgctttttctcatcgatcgtcttcgcctctgcgtttgttttctcgttcattgttaataacgtttgcaaggactttctcttcttatctctgaatagcgggttttccttcactgggtacattactggcctgtatccgctatacagaatatcgcgggtgagctccctagcttccaaatactgtgtagtaggtactttgggcagcgatctaaagtcatagaaatgcgcattctttaaaatctttgaactcctttgcttggtaatttgttgatgttgctgccttatggggttcaccagtctgctgtgagtccttctttgcaagcttacaaaagagacgctgacgcccctaatttttgtcctctttaataaaatcatccttattcactatttccgtacgtatatatgtctttgtatatacgtgtatgcgtgtgtgtttcgttactctctataattcaactaaaatgtatacatgcagacacacactcagagggaaaaaataaatgtgctataaataatgaaacacaagaaacatctaaagtccgaaaattgcacctgctcttatcattcattcttatacaaaagtgactagatatgatggcggatcccgcagccccaatcactggcaaagagcctgaataccgataggtacactaagcgtaaagaccctaccgtattctggttgctatcaccaccccacttccatcacgtccataccaggtgcgtaagcttaatcactctttgctcccctggtctgcccttcctattccggatttatcggctcgttccccgcgcccactggggtaaaccggcttgatggcccgacctcggcggctagccaccgcacccagaccacggtcttctccagaatgcccacgacgtagtagcgtggttccgtcaccactattgggctgacacaacacctgtgctcaatgctcagcaatatatcctctatactactactgtccgcgggtgctttcagaagtgtttgccatcggtcgataagctctttgtcctgacgcagcgattcgactgcccccgtaaagtctcgttcgtgatcccgtaggcaatcgcagaaaatctctttccgctgttccaagtcgaacgtcttataataaaacagcagttgggaaacgaatttgtcttggtcgcgcttcgacggtatatactccttgattttgtaggccttgtataacgctttttgttgtttccttatatcttgtgggatggtgtcgggtgcgattgttcccgcattagcaacaatttgtgccagataatggtattttgttggttctagtacttcgctatcgtcttcgctattatcttcgctatcgctttcttcagcggtggcattgccactgcgctcgccgcaccattcttcgaaaagactttcacgaactgtgtcatctctgatcttgtaaaaatcaggatcgttttcgattttcttgctttgcagcgaccacgtggaaaacttgtctagtttatacctatcgaataattcgaagaagatattacgctcgtcaatgtcatctgtatcaatacgattcagatcatcgataatgctgatatcttgatttacaatttgttcttcattctcttcgtcttcctcttcgtcttcctcttcgtcttcctcccccgaagatgaaccatacccgctgactagcccagtgtggctttcctgtaaaggggattttacgtcacccgcctcttcgctgatctcatcttttctctcaacttcgtcttgatttcttttaaatagatgaatctcttcgttgcaagattcgaggattttatcaatgtcctcctcccgcatagtgtaacctctggcaacgccaatcagaagaaccagtttttccttatctaacgactcgattaatgagcgacacctgctgtcgtcctcttgactgatgtcatttttgaactccttagagtcatcattaaagtaaagttttgtaccatcgttgtatattattaagtgccaaccattaaccagttctaatgaaaatgttggcttcctctctgtctgtgattctttcgcattgctttctaggttagagcctttcttcaaattaggtttttcccatcgagactgcttcgtgttcttattatagtaatactttttgcctgcaggtgtcttaaattcctgccattctccacgcatggcgattctgtgttactgaactgtctttctctttataatacatatcagaatctctttcggacactatttcctctttcttcaattatattgttttctctttcattgccgaagaaaaaaagaaacatactgaaagttgataaatatgcaataataaaaccttttcctactcttgacgcttctgtataagataaaaactgccaacaagatcagttccaacttcctgccgtattatgaggtatgttattcattaccaagactatatccgccacggctggatgcaggcatcgctccctgtggcttaagaaaataataggcacaaaactaacaataaaaacatccactactctgtcgcatgttccctgtgctcagatcattcgtaacaaataacgatatacctgttggatatgtaacgccaaaattcccctcattatactggcccatcaacaactcgaagtataatactgcattcttatactatatatctgacatttggaaattttcgctgtactggactttgatctttaatggtgcattttacgttactgctggtgtgtatgctagcttgacccatagaaagaaggctggaagtgtatggatattcgtcatgtacgtcttatacggaggcgttcaaggcttgacgactggtacagttatggggtttttaataggtgcgatctatagatctggtttattttctatgtctacatgggtcccactttgttgcgcagtagtccaaatccttttcgatgtggtgctaagttattccatggttggttccgttatgtgaaagcttctgtcaagaaaaaacaagaaggggtttactgatttgatgataaaagttagcagcaacttttgaatgagaatgtgccatccttcacgtaaagagcctaatactctttcttcaaagcgctagattgttctaaacgtttctttaactattgttttcgttcgtgcagcgtgattaaccgagcctccttcgaggcggggatggatattgtaagctgcatatatagtcgaacctcaaatcggttgagacaataggcaaagtgcccacattggcgcaaacacaagaacattaggaaagaaggcaatctgatatttcaaaaatgtctgcttcattgattaatcgttccttaacaaacattaggacagaactggattttctaaaagggtcaaatgtcatttcaaatgacgtttacgatcaaataaataagagcttgccggcaaaatgggatcctgccaatgcaccccgcaacgccagtccagcttccttggaatatgtcgaagctctttatcaatttgatcctcaacaagatggtgatttgggcttaaaaccaggtgacaaggtccaacttttagaaaaattatctccagagtggtacaagggtagctgtaatggccgtaccggtattttcccagcaaactatgtcaagccagctttctctgggtctaacggtccatccaatcttccaccacctccacagtataaagctcaagaattacaacaaatccccacgcaaaatagtgccgcatcatcttatcaacagcagccatttcctccaccttccacaaattattatcagcagcctcaacaacagccgcaacaagctcctcctccccaacaacaacaacaacaacaacaacatcagagctcacatagccacttgaagagctttggtagcaaattgggtaatgccgccatttttggggcaggcgctagtattgggtcagatattgttaataatatcttttaagtcgtttttctctttatatacttcattcatttgttctccattatggccaaacctttcataaattgaacgaagttctacctttggtgttgttatccctagaatttttttctaatgagtatgaatttaagtaacctttttttttctttttttttaaacagatatatcgtatatggaggataatagtacatcacttatgatatgagcgagaaaatctgtctttttagtaaaaaagtataaaaagtaaaaaggcgtcgattttgcgttgatttctttatatttacgtctgtacaaaaaatacattaagaatatattcaatatcttccctttcttcttccccagcaggctatacgctaatggattaaaaacctgccatatacgtggtatatcctgttgacgacatttatatgagctccggagtcaagattggtatccaccagttcctcaacgtccctaaaccattctttctttcttgaacgcgggatcaaaaaacttcccaatttgtataagttagaaacctcaatcactagtagaccctggtttaagtgttcctcatcggcgtccgcaccttgtttagaataattcaaaactctttccacattattcaaacttatacttatttgctccctataccgtttttcattagaccagacattgcctagtttgacaaatctttttaacgccactatagaagaatatagtatcactaaagccggagataatgctacaactccaaacaccaactgttgcgatttcagcattttatcaatgccattcaatgccatagatccatcgacttttgttttttgcagttgaatcaataaagacctgactaatccacccgtagctatattctttatcggatgatgtagttgtgtttcatatatttccataaattcggtcaaatcaccatgttcgactttagtactcaatagaatagggtctatggggctgttagacgtcgaatcactattatccacaacaaaactaacaatcattctggtaagagaatccatgtcagagtttaatgtctcctgtgatgtcactgaaatggcgcttccctcgtcatgcttaacagtagaccaaacctgtttcaggggtgcccataaccagttcaagatcagccctttcgcaaagtcaacgacattggtcttaatgaaatcttgaataaaataccgggaattccacaacgacataacagaagatggtccatataaaagacacaacaaaattgaaggccagtatctagtcaatatacttggtttagtgaaccttcttaaaggatgatctttatgaaatttcgctgagcatcggatcacatctagtaaattcgaatcagacatggctaatccaaagaagtcctgtaaagattttagacgtctttcgtagttcggtaaatgtacttcggtgaacataccattttcttctggttgttgatcgaattcagtgatcaactgccccagtttaatagtataatactttgatgattgagtgaccatatcaagtctttcgtgcactataccgcgaggtatatcagaaaccaatgaagctatttcaattggtttcttcggtagcccgacaaacctgaagttccgaatcaccataaatttgtttattcttgggcgtattttttctagtaaatcaactgacaaggcctttagggaccatttttgatgcgacagttttttcttatttacatccttcaaaacagtttgagataaaagacgtattgtcgatactgaattttgtaaacagtaaagaaaagactttaggattgaatcacttactgttttgtagtactgttcagcttcatacacggcaggtaaaccttggacgcattcgttggtcacagaatagtagcacaataatataatgtactcaaatatggcttggctaacaagatattgcaaatctccgtcttcaaaggatgagggatcagcaatgtccttgcaaatattgtatagcaaatcaaaaggcaccgaacaataagagtcaatattgtcagttttgattgaaatgcagattttttcaacaattgacctgatcaattgtaattgatcttgtaacctacttagttcttcattttcctcacgtacgtcttgaatcaattgttgctgtgaatcaaatgcaacctctcgtagtgattcctctaatgaatgacttatctcttcaaaagatttcaaaatacgcctattgatgatcatttaagaatattaattaaggaacctgcaattttgcaataggactattttgttgactttgttgttattactaagttttaaagtggaaaagaattccgaccctttgtttagtgagtgggggtcaatcaaattcgtattcctcggtcaaatgaggaggaatgtaaaaaccgaaaataaagtcatcgcataggtacaagaagaatgaacttgagaagttcaaatttctaattcaatttttttttttttctatacatataaattaataaagttactcacggtttgaaggtcaatcaatatatttgtttaggatagcaatagataaaagaacaatagagaaagaatgtaaaatacgtaaaaatatatgtacattactgtcggataatggtttgaatgcatgtttgatatgtttgcttatgtttgcttatgtttgcttatgtttttatcattactactactataatttttcattattatgctcgattcgtaaaatcgttactcttattcaatactatctatggaataatccttcttggataacttatgtctcaaacctttgccccagtaagaaaatgcaaaaggtaaagcaatcatagcagtggagatgaaagccaacaaccaagaaccccagtgcagattcaatttgtggtacatttgaatggtaaacaaggggaaggcagcaccaccggcggatcttaagaaaacctttgtagccagagcactggatgcgtattggacgtagcaatcaataatgtaattattcaatgaataataaatcaacaccataccgaaaccaaaagctaaaccagctgaagctggaccaacccaaataatatgtttataagcggtagcacccaggatccataaagcaattgcagcaaatggagcaccgatcttagcacctagcaaacgatcttcaggagtaggtttacgctgtttgacaatttgtaaatacttgttttcacagtagaaagttgtggctaacgcccaaagagcaccgataacaataggaataaacatcaaacccacaaggttgtctttgtagccatatagttcaccgaaaatgacagggaaggcaaagaagaacgcatatagtagagagtaaatcaaacacacgtagaaacaagtagcaactagaacaggttcagtgacagagaagtacaaaggtctcaacagacaagccctcatcatttcacccatactgacaccttgcgcttcctgctcagtcataatcttgggattaccagtttcctttcttaatctagcagcctttctcttcaagataactggagcgtacgtttctgggatggcagaagatatgatccacataacacctgcaaaggccatattgacccagaaaatcaggtccatacgtccggtagaaacggaaataaaaccgttaactagtggaccaacaacgggaccaacgtaaggagcaaaagcgaagaaagcaatagccttacctcttgtttcacttgggaacatatcggcaatagacccaccaactaaacacaaaccagatgatgaccaaacaccacataaaaatctacaagctaaaagactacctagatttggagctaaggcgcaagggatattgaagatgacataaagacccatagaaacaaagtaagcaactcttctaccgtaaagatcactaacaggagaccaaatcaaaggacccagcgagaacccaataaccattaaagaaaccgataaaatagcggcttccatacctacatggtatttcttttcaacggttcccaacccaccactgatacaagcagacccgtaggcgacacaaataactaagattgacagtaggacagtgtaactccaacggatccatgcaggccagttatgggggttttctggatcgccagtcacaaaggtaacgaattcaatttccggatctagatctggagcttcgtcattcgcaccactagagtcgccttctttacccttttcgttattatcactttctaaagcatcttcattagaagaaggcgaagaagcgccatcgatctgtctagttctcgtacgggaaatcgcagtagaagttctacctatggaatgtagagtggcgacaggaactaaacctgtaggggtttctaaagtatattcttcaggaaaaatcttattcttgctagattgaggagcattaacatcaggaacgggggctttggagctcacacccatgtcctgcaatgacttcacggtttccgtccgggtcaacttcagttgattaggagccatgttggatttagatccactctctgaagggatatattgttgcggctgctgactttctacatcagacaacgaagatgtttcgtctgaattaaacgaatttatggattcctgtctgttcatttctgtttatctttggctagaggagtactaatgcaaaattaaaataatgaagtaagaagggagaaagtaattagttatattagaaaactagaccacgaaatttgtagtataattatgggtatgacaattaaagaattagggtgaacgctaccggtgaggacaaaaaaggctgaacgaagaagaaaaataaaaagaagattagatcaacgcacctagacgaaaaagagcaaatactgcttattgtattcactttggagaacaggttgtaacaggacagctgacaattgctaagttaagtagattacaaagacaaatgttcttaggcgaaaagaatatataaactaaaagaaaaagtggaaaaagggtacgtgtaaaaagagactaggatggttgagcagcgaatgattgcaagatatataaaagaaacgagccagttttacagcgtttaacgcagatccagaatatgaacaaaatgcattaggaaataaatgaaaaaaatggctctatggatcagggatcatcatggctgccggaaactacgccgttctgttttgtttttgtttttcctttttcccgtttgggtgaaatcagtgagctgttccgatccgttgggcgaagacattgccgcagtgacgaagcccggctagtccgattgggctccagtaaacccctcgccaagcacagagaagctagtcagaggcccgctagactgtacttactggtctttagcacacgacgaccgtactttgcacgtggctgcagacacattttgtatggagggaatgcttgattatataaagagctctgtttttatgttacccgtccaacgttctcacccggctccgcgctattttttttttttttttttttttttttcagacccacacaaaatccgcgtagccgagattgcttatgtatgttatcatattgcctgtttgagatatgcaggatcagcatagcatgtctctaaccaaattgtgggtcagtcaattatgttgctcttttgggtatacgctttcaccggattctcgagaaatcgtataatgcatgccccaaagcagtggccgttctcggaaaaataaaaatagtttatatctcaatttagttatatggctatgacggaaacgacaaaatcaaattgaaacttagaaaaaataaaaaacagcgcattattaaggtttcatgactccgtattcgctgtcctacgtgtaaataggaagaagaaaaaagtgaaaaaggaagaacccttcttttgaaggaaagcataactcgttactcatacgacggatgcgagatatactctctacgtagttgtactagccgaatgaaaaaagagaaagttccgaatatgtaaaattgaaatttctcttctttataatagaactaacaattgaactttccttttcttttgaagctaccgtcaatgacaaagaaggcagctttgataaagtactcaataggtaaagcaaacttcaattcagttagcgaatgcattgcgtactagcgcgaatattgttatggttcttaatagtagatctaagcgtcatacgggcgcttgtccttccaccattgaaagattatgatccgttagagcctttgatgaaaagagacatggccatgggtcaacggaacagattcaaagtcgacggccaattgccgcccatactaaattccacagatgtgacagatgatcagagaagtctgcatacgcctggagagattccatcttatgtcatcaatcattgtcccttagtgcacttgtatagcgaagagaaatattggccatcggacattgctgagtacgttcaaaacttccaaattaaagataaaaacggcaattctatatccactcatgaaaatttgacactgcatgacttgaaggcggaataccacgtagatttatttggcaacaaaacggaaacgcatatccccagtagcgaggtatttttaaccagtttggacgatttcgacaaggaccctaaatggttgctcggtcatctacccgaatacggaacaggctacaactctaaggcgcctgctattctgatcgtagtcgacaaggggaacgggtgggttgatgcgttctggtttttcttctacccattcaatcatggcccttttattatgggccatggaccctggggcaatcacgtcggtgactgggaacactctttggttcggttttataaaggtattccaaaatatctttggatgagtgcgcattccagtggaacaggctacagatacgaagctgttgagaaatttaagaaactacggaaaagaaaacagcaagatagtgacgatggtggggatactatactggaaagaccgttgatttttagtgctagaggcacgcatgctaattatgcatccgctgggcagcatgctcatgacattcctttttttttcatgcctttgagtgattttaccgatcgtggtcccctgtgggatccatctttgaacttttactcctatacttttgatggtaaaactgtgacaccctcctcagagagagaagaatctctcggtttggattggttgcattttcaaggtggatggggtgatcaacaactaccagctagagatccaagacagaaatggtgcgtagctcaatggaagtatatcggaggtcctcgtggccccctgtttaagaaattggatagattgaatctatgcggcggtgtgaaaaagtggaatttctggaatggtggctgccccgcaagaagattgataaaaaaagcagaaggcttggactctgagagcactgatcttatgggtgataattgtggtgtcctactctatagaatcagaccaaaatggctgagaggaattctaagatttctaatgtggagaggtatactctgttctcttatggaatttttcaccaattgaagaactttatgacaacagaatgttctgattgtaatataatgacaaattttaatctttagtaatatctaatataatagttaatgataaatagttaattctaatgtttaatgatctgcaaatactttttatgtttttcaacatagtttttaatgtgtttctacacttgatcgcaactaaatctaaataaacacacaagcacaaaatatgataaaaaagcaatttggctagaagcacaggaaccaaatatgacgttcaattcaaatagacccttatttctggtcttgttcatcagtccctgatgtcttgctctttccttctgcaattgatagcgccacacttctcaaaagcagtggaaaaaaaaatcatttcccagaagaacgcgagagaactccatagaaaaaagggaactttcctactcaaaagagaaagggaaaaataattgcgatatatcttatagcctttttttttttccaactttctatttttgtaaaaatgaaaatttccttcataagctacaataagactactccatcccttgtttcctcaacgcaccgaactcgataggactggtcgtaaaacagaaaactgactaatggctgccgcatgcatttgtcaacctaatcttcttgagattaatgtatctgatggaccactggatatgatccgcaagaaaagaaaaatacaacagccgcaactacgtccaccccttcgagagaataaatgccaaccacacttttctgtacgaaaggtaaaccagtcttacataatttctctccataaagaaatcacatgccaactcattgcagaaattgtcaaacaaaagttatcgaggatttgggaaaaagtatacataccatcttatgaactgatatcagacaaagacggtaatcaaatttatgtggaacagagtgtcgacgaaaataggctaacttctgagattatggagaaactggaccccaacaatattgatatagaggcgatcgaaatattattcgacgactatcacctagaattatcacgcttgacaaacggtattattatatctagtgccaatgatcacttttacagggaattctccttcaataacataattgatgacaactttaaaatttgtggaacaagcatgtctgcagacagttttgataagatttatggcgttatgtggattgaagtacctttcaatggcaatggcttacagaatgatagcgccgttaatagggtttcaacatctcacaatcagatagaagaattgaatgacatagagcaggagataagagcttttaatattagtcgaagtaatcaagaaagtatcatcaaaaaggaagtatctagaagattgaatgggcggtaagaaatacgggctacggaatttaccgtgtgtcttcaaattgagtgtcaccctgtaaggctttctactctatcacaaaatattacatattctaattctacaattatagatatcaaacttgataaatttagtagcaaatatgaagtattattatgcatttcaaaaaattccattgtcccttctcttgggcgcttgaattctaaaaaaaattagcgcatcgctaatagcgcgtttgaacccgtcttaagaatgttcataccagtatcaacaaggggtatgttcctcagcattatctgaaggtactcctctaaatttttaagtaagaaaaggcgtatagtcatataattgttgggaatccaccactgataaaggttataatatcaggtaaagaaattgttggaataaaaatccactatcgtctatcaactaatagttatattatcaatatattatcatatacggtgttaagatgatgacataagttatgagaagctgtcatcgatgttagaggaagctgaaacgcaaggattgataatgtaataggatcaatgaatataaacatataaaacggaatgaggaataatcgtaatattagtatgtagaaatatagattccattttgaggattcctatatcctcgaggagaacttctagtatattctgtatacctaatattatagcctttatcaacaatggaatcccaacaattatctaattacccacatatatctcatggtagcgcctgtgcttcggttacttctaaggaagtccacacaaatcaagatccgttagacgtttcagcttccaaaattcaagaatatgataaggcttccactaaggctaactctcaacagacaacaacacctgcttcatcagctgttccagagaacccccatcatgcctctcctcaacctgcttcagtaccacctccacagaatgggccgtacccacagcagtgcatgatgacccaaaaccaagccaatccatctggttggtcattttacggacacccatctatgattccgtatacaccttatcaaatgtcgcctatgtactttccacctgggccacaatcacagtttccgcagtatccatcatcagttggaacgcctctgagcactccatcacctgagtcaggtaatacatttactgattcatcctcagcggactctgatatgacatccactaaaaaatatgtcagaccaccaccaatgttaacctcacctaatgactttccaaattgggttaaaacatacatcaaatttttacaaaactcgaatctcggtggtattattccgacagtaaacggaaaacccgtacgtccgatcactgatgatgaactcaccttcttgtataacacttttcaaatatttgctccctctcaattcctacctacctgggtcaaagacatcctatccgttgattatacggatatcatgaaaattctttccaaaagtattgaaaaaatgcaatctgatacccaagaggcaaacgacattgtgaccctggcaaatttgcaatataatggcagtacacctgcagatgcatttgaaacaaaagtcacaaacattatcgacagactgaacaataatggcattcatatcaataacaaggtcgcatgtcaattaattatgagaggtctatctggcgaatataaatttttacgctacacacgtcatcgacatctaaatatgacagtcgctgaactgttcttagatatccatgctatttatgaagaacaacagggatcgagaaacagcaaacctaattacaggagaaatccgagtgatgagaagaatgattctcgcagctatacgaatacaaccaaacccaaagttatagctcggaatcctcaaaaaacaaataattcgaaatcgaaaacagccagggctcacaatgtatccacatctaataactctcccagcacggacaacgattccatcagtaaatcaactactgaaccgattcaattgaacaataagcacgaccttcatcttaggccagaaacttactgaatctacagtaaatcatactaatcattctgatgatgaactccctggacacctccttctcgattcaggagcatcacgaacccttataagatctgctcatcacatacactcagcatcatctaatcctgacataaacgtagttgatgctcaaaaaagaaatataccaattaacgctattggtgacctacaatttcacttccaggacaacaccaaaacatcaataaaggtattgcacactcctaacatagcctatgacttactcagtttgaatgaattggctgcagtagatatcacagcatgctttaccaaaaacgtcttagaacggtctgacggcactgtacttgcacctatcgtaaaatatggagacttttactgggtatctaaaaagtacttgcttccatcaaatatctccgtacccaccatcaataatgtccatacaagtgaaagtacacgcaaatatccttatcctttcattcatcgaatgcttgcgcatgccaatgcacagacaattcgatactcacttaaaaataacaccatcacgtattttaacgaatcagatgtcgactggtctagtgctattgactatcaatgtcctgattgtttaatcggcaaaagcaccaaacacagacatatcaaaggttcacgactaaaataccaaaattcatacgaaccctttcaatacctacatactgacatatttggtccagttcacaacctaccaaaaagtgcaccatcctatttcatctcatttactgatgagacaacaaaattccgttgggtttatccattacacgaccgtcgcgaggactctatcctcgatgtttttactacgatactagcttttattaaaaaccagtttcaggccagtgtcttggttatacaaatggaccgtggttctgagtatactaacagaactctccataaattccttgaaaaaaaaaatggtataactccatgctatacaaccacagcggattcccgagcacatggagtcgctgaacggctaaaccgtaccttattagatgactgccgtactcaactgcaatgtagtggtttaccgaaccatttatggttctctgcaatcgaattttctactattgtgagaaattcactagcttcacctaaaagcaaaaaatctgcaagacaacatgctggcttggcaggacttgatatcagtactttgttacctttcggtcaacctgttatcgtcaatgatcacaaccctaactccaaaatacatcctcgtggcatcccaggctacgctctacatccgtctcgaaactcttatggatatatcatctatcttccatccttaaagaagacagtagatacaactaactatgttattcttcagggcaaggaatccagattagatcaattcaattacgacgcactcactttcgatgaagacttaaaccgtttaactgcttcatatcattcgttcattgcgtcaaatgagatccaagaatccaatgatcttaacatagaatctgaccatgacttccaatccgacattgaactacatcctgagcaaccgagaaatgtcctttcaaaagctgtgagtccaaccgattccacacctccgtcaactcatactgaagattcgaaacgtgtttctaaaaccaatattcgcgcacccagagaagttgaccccaacatatctgaatctaatattcttccatcaaagaagagatctagcaccccccaaatttccaatatcgagagtaccggttcgggtggtatgcataaattaaatgttcctttacttgctcccatgtcccaatctaacacacatgagtcgtcgcacgccagtaaatctaaagatttcagacactcagactcgtacagtgaaaatgagactaatcatacaaacgtaccaatatccagtacgggtggtaccaacaacaaaactgttccgcagataagtgaccaagagactgagaaaaggattatacaccgttcaccttcaatcgatgcttctccaccggaaaataattcatcgcacaatattgttcctatcaaaacgccaactactgtttctgaacagaataccgaggaatctatcatcgctgatctcccactccctgatctacctccagaatctcctaccgaattccctgacccatttaaagaactcccaccgataaattctcatcaaactaattccagtttgggtggtattggtgactctaatgcctatactactatcaacagtaagaaaagatcattagaagataatgaaactgaaattaaggtatcacgagacacatggaatactaagaatatgcgtagtttagaacctccgagatcgaagaaacgaattcacctgattgcagctgtaaaagcagtaaaatcaatcaaaccaatacggacaaccttaagatacgatgaggcaatcacctataataaagatattaaagaaaaggaaaaatatatcgaagcataccacaaagaagtcaaccaactattgaaaatgaatacttgggacactgacaaatattatgacagaaaagaaatagaccctaaaagagtaataaattcaatgtttatcttcaacaggaaacgtgacggtactcataaagctagatttgttgcaagaggtgatattcagcatcctgacacttacgactcaggcatgcaatccaataccgtacatcactatgcattaatgacatccctgtcacttgcattagacaataactactatattacacaattagacatatcttcggcatatttgtatgcagacatcaaagaagaattatacataagacctccaccacatttaggaatgaatgataagttgatacgtttgaagaaatcactttatggattgaaacaaagtggagcgaactggtacgaaactatcaaatcatacctgataaaacagtgtggtatggaagaagttcgtggatggtcatgcgtatttaagaatagtcaagtaacaatttgcttattcgttgatgatatgatattgttcagcaaagacttaaatgcaaataagaaaatcataacaacactcaagaaacaatacgatacaaagataataaatctgggtgaaagtgataacgaaattcagtacgacatacttggcttagaaatcaaatatcaaagaggtaaatacatgaaattaggtatggaaaactcattaactgagaaaatacccaaattaaacgtacctttgaatccaaaaggaagaaaacttagcgctccaggtcaaccaggtctttatatagaccaggatgaactagaaatagatgaagatgaatacaaagagaaggtacatgaaatgcaaaagttgattggtctagcttcatatgttggatataaatttagatttgacttactatactacatcaacacacttgctcaacatatactattcccctctaggcaagttttagacatgacatatgagttaatacaattcatgtgggacactagagataaacaactgatatggcacaaaaacaaacctaccgagccagataataaactagtcgcaataagtgatgcttcatatggtaaccaaccatattacaagtcacaaattggcaacatatatttacttaatggaaaggtaattggaggaaagtccaccaaggcttcattaacatgtacttcaactacggaagcagaaatacacgcgataagtgaatctgtcccattattaaataacctcagtcaccttgtgcaagaacttaacaagaaaccaattactaaaggattactaaccgacagtaaatctacaatcagtataattatatccaataatgaagagaaatttagaaacagattttttggtactaaagcaatgagactaagagatgaagtatcaggaaatcatctgcacgtatgctatatcgaaaccaaaaagaatattgcagacgtaatgaccaaacctcttccgataaaaacattcaaactattaacaaacaaatggattcattagatctattacattatgggtggtatgttggaataaaaatccactatcgtctatcaactaatagttatattatcaatatattatcatatacggtgttaagatgatgacataagttatgagaagctgtcatcgatgttagaggaagctgaaacgcaaggattgataatgtaataggatcaatgaatataaacatataaaacggaatgaggaataatcgtaatattagtatgtagaaatatagattccattttgaggattcctatatcctcgaggagaacttctagtatattctgtatacctaatattatagcctttatcaacaatggaatcccaacaattatctaattacccacatatatctcagaaattttactagaagttcattatcctattacttatcaatccttgcatttcagctttcattaaatgtgctcactgtttctcaatctttatgccatatttttgcaccgtatacgataacatgcaaatagtacgaatactaatcgatatgtgatggttgattcttattccaacaattatcttgaacttcaatcaactctcgcagttgtcacgtgcaatttgatacatgtcgcgttgatatacaagtactaaatacggtacacaatggattatttctgttgtatctcaaaatgagaaatgggtgaatgttgagataattgttgggattccattgttgataaaggctataatattaggtatacagaatatactagaagttctcctcgaggatataggaatcctcaaaatggaatctatatttctacatactaatattacgattattcctcattccgttttatatgtttatattcattgatcctattacattatcaatccttgcgtttcagcttcctctaacatcgatgacagcttctcataacttatgtcatcatcttaacaccgtatatgataatatattgataatataactattagttgatagacgatagtggatttttattccaacataccacccataatgtaatagatctaatgaatccatttgtttgttaatagtttgaatgtttttatcggaagaggtttggtcattacgtctgcaatattctttttggtttcgatatagcatacgtgcagatgatttcctgatacttcatctcttagtctcattgctttagtaccaaaaaatctgtttctaaatttctcttcattattggatataattatactgattgtagatttactgtcggttagtaatcctttagtaattggtttcttgttaagttcttgcacaaggtgactgaggttatttaataatgggacagattcacttatcgcgtgtatttctgcttccgtagttgaagtacatgttaatgaagccttggtggactttcctccaattacctttccattaagtaaatatatgttgccaatttgtgacttgtaatatggttggttaccatacgaagcatcacttattgcgactagtttattatctggctcggtaggtttgtttttgtgccatatcagttgtttatctctagtgtcccacatgaattgtatcaactcatatgtcatgtctaaaacttgcctagaggggaatagtatatgttgagcaagtgtgttgatgtagtatagtaagtcaaatctaaatttatatccaacatatgaagctagaccaatcaacttttgcatttcatgtaccttctctttgtattcatcttcatctatttctagttcatcctggtctatataaagacctggttgacctggagcgctaagttttcttccttttggattcaaaggtacgtttaatttgggtattttctcagttaatgagttttccatacctaatttcatgtatttacctctttgatatttgatttctaagccaagtatgtcgtactgaatttcgttatcactttcacccagatttattatctttgtatcgtattgtttcttgagtgttgttatgattttcttatttgcatttaagtctttgctgaacaatatcatatcatcaacgaataagcaaattgttacttgactattcttaaatacgcatgaccatccacgaacttcttccataccacactgttttatcaggtatgatttgatagtttcgtaccagttcgctccactttgtttcaatccataatgtgatttcttcaaacgtatcaacttatcattcattcctaaatgtggtggaggtcttatgtataattcttctttgatgtctgcatacaaatatgccgaagatatgtctaattgtgtaatatagtagttattgtctaatgcaagtgacagggatgtcatcaacgcataatgatgtacagtgttggattgcatacctgtatcgtacgtatcaggatgctgaatgtcacctcttgcaacaaatctagctttatgagttccgtcacgtttcttgttgaagataaacattgaatttattactcttttggggtctatttcttttctgtcataatatctgtcagtgtcccaagttttcatcttcaacagttggttgacttctttgtggtatgcttcgatatatttttctttttctttaatatctttattataggtgattgcctcatcgtatcgtaaggttgttcgtattggtttgattgattttactgcttttacagctgcaatcaggtgaattcgtttcttcgatctcggaggttctaaactacgcatattcttagtattccatgtgtctcgtgataccttaatttcagtttcattatcttctaatgatcttttcttactgttgatagtagtataggcattagagtcaccaataccacccaaactggaattagtttgacgagaattgatcggtggaagttctttaaaggagtctgataattcggtaggaggttctggaggcggatcgggaagtgggagatcagcgataatagattcctcggtattctgttcagaaacagtagttggcgttttgataggaacaatattgtgcgatgaattattttccggtggagaagcatcgattgaaggtgaacggtgtataatccttttctcagtctcctggtcgcttatctgcggaacagttttgttgttggtaccacccgtactggatattggtacgtttgtatgattagtctcattgttactgtacgagtctgagtgtctgaaatctttagatttactggcgtgcgacgactcatgtgtgttagattgggacatgggagcaagtaaaggaacatttaatttatgcataccacccgaaccggtactctcgatattggaaatttggggggtgctagatctcttctttgatggaagaatattagattcagatatgttggggtcaacttctctgggtgcacgaagattgatttcagatataggttttgaatcttcagtatgagttgacggaggtgtggaatcggttggactcacagcttttgaaaggacatttctcggttgctcaggatgtagttcaatgtcagattggaagtcatggtcagattctatgttaagatcattggattcttggatctcatttgacgcaatgaacgaatgatatgaagcagttaaacggtttaagtcttcatcgaaagtgagtgcgtcgtaattgaattgatctaatctggattccttgccctgaagaataacatagttagttgtatctactgtcttctttaaggatggaagatagatgatatatccataagagtttcgagacggatgtagagcgtaacctgggatgccacgaggatgtattttggagttagggttgtgatcattgacgataacaggttgaccgaaaggtaacaaagtactgatatcaagtcctgccaagccagcatgttggcttgcagattttttgcttttaggtgaagctagtgaatttctcacaatagtagaaaattcgattgcagagaaccataaatggttcggtaaaccactacattgcagttgagtacggcagtcatctaataaggtacggttgagccgttcagcgactccatgtgctcgggaatccgctgtggttgtatagcatggagttataccatttttttcaaggaatttatggagagttctgttagtatactcagaaccacggtccatttgtataaccaagacactggcctgaaattggtttttaatgaaagctagtatcgtggtaaatacatcgaggatagagtcctcgcgacggtcgtgcaatggataaacccaacggaattttgttgtctcatcagtaaatgagatgaaataggatggtgcactttttggtaggttgtgaactggaccaaatatgtcagtatgtaggtattgaaagggttcgtatgaattttggtattttagtcgtgaacctttgatatgtctgtgtttggtgcttttgccgattaaacaatcaggacattgatagtcaatagcactagaccagtcgacatctgattcgttaaaatacgtgatggtgttatttttaagtgagtatcgaattgtctgtgcattggcatgcgcaagcattcgatgaatgaaaggataaggatatttgcgtgtactttcacttgtatggacattattgatggtgggtacggagatatttgatggaagcaagtaccttttagatacccagtaaaagtctccatattgtacgataggtgcaagtacagtgccgtcagatcgttctaagacgtttttggtaaagcatgctgtgatatctactgcagccaattcattcaaactgagtaagtcataggctatgttaggagtgtgcaatacctttattgatgttttggtgttgtcctggaagtgaaattgtaggtcaccaatagcgttaattggtatatttcttttttgagcatcaactacgtttatgtcaggattagatgatgctgagtgtatgtgatgagcagatcttataagggttcgtgatgctcctgaatcgagaaggaggtgtccagggagttcatcatcagaatgattagtgtgatttaccgtagattcagtaagttcctggcctaaggtgaaggtcgtgcttattgttcaattgaatcggttcagtagttgatttactgatggaatcgttgtccgtgctgggagagttattagatgtggatacattgtgagccctggctgttttcgatttcgaattatttgttttttgaggattccgagctataactttgggtttggttgtattcgtatagctgcgagaatcattcttctcatcactcagatttctcctgtaattaggtttgctgtttctcgatccctgttgttcttcataaatagcatggatatctaagaacagttcagcgactgtcatatttagatgtcgatgacgtgtgtagcgtaaaaatttatattcgccagatagacctctcataattaattggcatgcgaccttgttattgatatgaatgccattattgttcagtctgtcgataatgtttgtgacttttgtttcaaatgcatctgcaggtgtactgccattatattgcaaatttgccagggtcacaatgtcgtttgcctcttgggtatcagattgcattttttcaatacttttggaaagaattttcatgatatccgtataatcaacggataggatgtctttgacccaggtaggtaggaattgagagggagcaaatatttgaaaagtgttatacaagaaggtgagttcatcatcagtgatctgacgtacgggttttccgtttactgtcggaataataccaccgagattcgagttttgtaaaaatttgatgtatgttttaacccaatttggaaagtcattaggtgaggttaacattggtggtggtctgacatattttttagtggatgtcatatcagagtctgctgaggatgaatcagtaaatgtattacctgactcaggtgatggagtgctcagaggcgttccaactgatgatggatactgcggaaactgtgattgtggcccaggtggaaagtacataggcgacatttgataaggtgtatacggaatcatagatgggtgtccgtaaaatgaccaaccagatggattggcttggttttgggtcatcatgcactgctgtgggtacggcccattctgtggaggtggtactgaagcaggttgaggagaggcatgatgggggttctctggaacagctgatgaagcaggtgttgttgtctgttgagagttagccttagtagaagccttctcacattcttctgttttggaagctgaaacgtctaacggatcttgatttgtgtggacttccttagaagtaaccgaagcacaggcgctaccatgagaaatgggtgaataattagataattgttgggattccattgttgataaaggctataatattaggtatacagaatatactagaagttctcctcgaggatataggaatcctcaaaatggaatctatatttctacatactaatattacgattattcctcattccgttttatatgtttatattcattgatcctattacattatcaatccttgcgtttcagcttcctctaacatcgatgacagcttctcataacttatgtcatcatcttaacaccgtatatgataatatattgataatataactattagttgatagacgatagtggatttttattccaacacaaaatgagatatgtcagtatgacaatacgtcatcctgaacgttcataaaacacatatgaaacaaccttataacaaaacgaacaacatgagacaaaacccgtccttccctagctgaactacccaaaagtataaatgcctgaacaattagtttagatccgagattccgcgcttccaccacttagtatgattcatattttatataatatataagataagtaacattccgtgaattaatctgataaactgttttgacaactggttacttccctaagactgtttatattaggattgtcaagacactccggtattactcgagcccgtaatacaacaatttacaacaagattcgggcgtgtggcgtagtcggtagcgcgctcccttagcatgggagaggtctccggttcgattccggactcgtccattttaatttttgattatggaatacaaaatgtatatttcgtataaaattatctttattgtttttgtggcttagtgattttcattcccctcttttctttttcctctcagcctgcaagtgtgacgcgatctgaaaggcgttttacccgcaaaacgccaaagaatcatcctgaagcggtaaattctagacttcagatcacatacgctctatttggacagtttttttttttttttcatattcctgatcagatgaaagttaacgctatttttggtgaaaacacagaataaaacagcttctgataaaatttaactaggaacgtcgaaaacaacaaccgttaaaatatttttagcttacagaagcacttaagaatcactaacgttttcttctttttttattttcagtccaaagctttcgtattgctgcaagtgctcgagaaagctgcatattgttattgtattcgtcctctcgtactagtgttcattactttatcgtctataaatatattgttgttagaatttttctactaaggcaagttagtagttgcacaacatttctctcgttaaatcatctaaagtttacagaataggtataccactcactcctttactctaatgcctttgagaaatctaactgaaacgcacaactttagtagcacaaacctggacacagatggtacaggcgacgatcatgatggtgctcctctttcctcatctccttcttttggacaacaaaatgacaatagcaccaacgataatgctggtctcacaaacccttttatggggagtgacgaagaatctaatgcgcgggatggagaatctctgtcttcttctgttcattatcagccacaggggagtgactcttcactacttcatgacaattctcgtctagatctaagtcaaaataaaggtgtatctgattacaaaggttactattccaggaacaatagtagagctgtgagtacggctaatgataactcatttcttcagccaccacatagagctatagcctcttctccttctttgaattctaatttatcgaagaatgatattctctcaccgccagaatttgatagatatcccttagtgggttccagagtcacttctatgactcaactgaaccatcatggtcgctcgccaacatcatctccaggaaacgagtcgtccgcctcattctcttctaatccgtttttgggcgagcaagatttttctccatttggtgggtatcctgcttcatcgttcccacttatgatagatgaaaaggaagaagatgattatttacacaatcctgaccccgaagaagaggcaagactggatagaaggaggttcatagatgacttcaagtacatggataaaaggtctgctagtgggctagctggtgtattgctcttgtttctggcagccatctttatttttattgttttgccagcgttgacctttaccggtgctattgatcacgaaagcaacactgaagaagttacatatttaactcaataccaatatcctcaactatccgccattagaacatctctggttgacccagacacacctgatacagcgaagacaagagaagctatggatggctctaagtgggaattagtattttctgatgagtttaatgcagaaggcagaacattttatgatggggatgatccatactggacagcccctgatgttcactatgatgctactaaggatttagaatggtacagtccagacgcttccacaactgtgaacggaaccttgcagctgagaatggatgcctttaagaaccatggcttatattacagatcaggtatgttgcagagttggaataaggtttgtttcacgcagggtgctctagaaatctctgcaaatctaccaaattatggccgtgtttcaggtttgtggcccggtctttggactatgggtaatttagggaggcccggttatttggctagtacccaaggtgtctggccttattcttatgaatcgtgtgatgctggtattacacccaaccaaagttccccggatggtatttcttacttgccgggacaaaagttaagtatttgtacttgtgatggtgaagatcatccgaatcaaggtgttggtagaggagctccagaaattgatgttttggaaggtgaaactgatactaagattggtgtaggtatagcctctcaatccttgcaaattgcaccttttgatatctggtacatgcctgactatgattttatcgaggtttacaatttcacaacaacgaccatgaacacttatgctggcggtccatttcaacaagccgtatctgctgtctcaactttgaacgtaacttggtatgaattcggtgagtacggtggctactttcaaaaatatgccattgagtatctgaacgatgacgacaatggttatatccgttggtttgttggtgatactccaacttatactattcatgctaaagccttacatcctgatggtaatattggttggagaagaatcagtaaagaaccaatgtcgattattctaaatctgggtatttccaacaattgggcttatattgattggcagtatattttcttcccagtggttatgtcgattgactatgttagaatataccaaccaagtaatgctatatccgtgacatgcgatccaagtgactatccaacatatgattatattcaatcgcacttaaatgcattccagaatgcaaacttaactacttgggaagatgctggttacacgttccctaagaatatcctaactggtaaatgtactagctcgaagttcaagttatcctcttaagcgggtattttgatggtaaatctacaagccctcggctttaattattaccatggtcataaaaagttacttacaatgcatacatttttcttttaggaagaaataaaatataaaagacttatcgttcaaatcgggtcataaagggaactaaaggtatactaaggtaagacggggttctcatctgcacgtaattttttattatttttagtgagggagaactttacctctaagattgtttatataggtatacacatttttgtaaaactgattattcgtttttttttttgaaacaagttattagtacaaaaatcaagctctcactacttaccagtagttattttagtagaatattattaactctaccgaataagtacgatatgagaaattgctgatttacttgtgtgtgttcctattattatccaggagcgcctctaatctatgcttataattttacgttgaaaaaaaaggagtctgtataattatttcaaattcatccttttctcacggatattgtgtaccctatgaggtaaataattgcgctttattttctccctgtgtttgctcgctcatcttaagacgaaaaaagtaatggaacacctaccatcaatagaagtaccacactcatgtaaataacaagcgcaagtggtttagtggtaaaatccaacgttgccatcgttgggcccccggttcgattccgggcttgcgcagattttattttttgctcccttctaaagctctggatgattcaccaacttatccaaggcaaggtccaactaccgtttccttcgatgaaaaagacaataggtagctctgtcaaaccccgtggaaacgcaaactcatcgggagtgtcctactgctttccactagttatccgactagcaaggcaactagtcaagatgaaaccgtctcacgaacatttgtatacgatctcttctcctgatagacaatgaaatataccccggtgcttgtttcccactaaggaaaaaaggccgctgccccacagcgggaaggcccttcaaggggtagcggcatcgcctagtagcactgtggggggaagaatacaacgctcaacggaagaggaagctctgcgagatgcagccagcaccttctatgtttcaaggataacattttgaattaacaaggaacgccttccccaattaccgttattgtatttttactttttagagactctcgaggaaataagtaaggggtggataattttcgctaaaaaagtttcaggggaggttaataactaccatgtgcatgctacaaagataaggaaggaacaccgacgaatatattatatgtataaaaggagcatgaagtttgtatagcagtaaagcaagattctttgtgccttcccgtttcttgttgtaccttttgttttgattacgtacgaagtattataagttttttctgcttgctattgtaatataaagtaagcacagattgagaaggtaacgattactaaaaatatccaaaagaaaaacaattggatcttttttgacttctctacattacaatttcagtaaagcagctttcaacttaatttaattttgaacaatgccgccagctagtactagtactaccaatgatatgataaccgaagaacctacttctccacaccaaatcccaaggcttacaaggagacttacggggtttcttccccaagaaatcaagtcaattgacacgatgattcctttaaagtcaagagcgttatggaataagcatcaagtcaaaaaatttaacaaggcagaagattttcaagatagattcattgaccatgtggaaactacattagcacgttccctatataattgtgatgacatggctgcttatgaagctgcttcgatgagtattcgtgacaatttggtcattgactggaacaaaactcagcagaaattcaccacaagagacccaaagagagtttactatttgtctttggagtttttgatgggtagggctttggataatgccctgattaatatgaagattgaagatccggaagaccctgctgcctcaaagggaaaaccaagagaaatgattaaaggggctttggatgatttaggtttcaagttagaggatgtcttggaccaagaaccggacgcaggtttaggtaatggtggtctaggtcgtcttgcagcttgcttcgtcgactcaatggcaacggaaggcatccctgcctggggttatggtctacgttatgagtatggtatctttgctcaaaagattattgacggttaccaggtggaaactccagattactggttaaattctggtaatccatgggaaattgaacgtaacgaagtgcaaattcctgtcaccttttatggttatgttgatagaccagaaggcggtaaaactacactgagtgcgtcacaatggatcggtggggaaagagttcttgctgtcgcgtatgatttcccagttccgggtttcaagacttccaatgtaaataacttaagactatggcaagcaaggccaacaacagaatttgattttgcaaaattcaataatggtgactataaaaactctgtggctcagcaacaacgcgcagagtctataaccgctgtgttgtatccaaacgataactttgctcaaggtaaggagttgaggttgaaacagcagtacttctggtgtgctgcatccttacacgacatcttaagaagattcaaaaaatccaagaggccatggactgaatttcctgaccaagtggctattcagttgaatgatactcatccaactttagccatcgttgaattacagagagttttggtcgatctagaaaaactagattggcacgaggcttgggacatcgtgaccaagacttttgcttatactaaccacactgttatgcaagaggccctggaaaaatggcccgtcggcctctttggccatttgctacccagacatttggaaattatatatgatatcaactggttcttcttgcaagatgtggccaaaaaattccccaaggatgttgatcttttgtctcgtatatccatcatcgaagaaaactctccagaaagacagatcagaatggcctttttggctattgttggttcacacaaggttaatggtgttgctgaattgcactctgaattaatcaaaacgaccatatttaaagattttgtcaagttctatggtccatcaaagtttgtcaatgtcactaacggtatcacaccaaggagatggttgaagcaagctaacccttcattggctaaactgatcagtgaaacccttaacgatccaacagaggagtatttgttggacatggccaaactgacccagttgggaaaatatgttgaagataaggagtttttgaaaaaatggaaccaagtcaagcttaataataagatcagattagtagatttaatcaaaaaggaaaatgatggagtagacatcattaacagagagtatttggacgacaccttgtttgatatgcaagttaaacgtattcatgaatataagcgtcaacagctaaacgtctttggtattatataccgttacctggcaatgaagaatatgctgaagaacggtgcttcgatcgaagaagttgccaagaaatatccacgcaaggtttcaatctttggtggtaagagtgctcctggttactacatggctaagctgatcataaaattgatcaactgtgttgctgacattgttaataacgacgagtcaattgagcatttgttgaaggttgtctttgttgctgattataatgtttctaaggctgaaatcattattccagcaagtgacttgagtgagcatatttctactgctggtactgaagcgtctggtacttctaatatgaagtttgttatgaacggtggtttgattattggtactgttgatggtgccaatgtggaaatcacaagggaaattggtgaagataatgtcttcttgtttggtaacctaagtgaaaatgtcgaagaattgagatacaaccatcaataccatccacaagatttaccatctagtttggattctgttttatcctacattgaaagtggacaattttctccagaaaatccaaatgaattcaaacctttagtcgacagtattaagtaccacggcgattattacctggtcagtgatgactttgaatcctatctggccacccatgaattagtggaccaggagttccacaatcaaaggtcagaatggttaaaaaagagtgtcctgagcgttgcaaacgtcggcttctttagcagtgatcgttgtatcgaggaatactccgataccatttggaacgttgaaccagtgacttagctgggagttttttttatctctttggcacccttctccccatttctagtaagcgcttttttctctttacttcttctcttatataaaacgcctttaaaataatcgttatcggttttttggcactcttttaaatggtatatatgatgttacaggaaaacttagttgttttcatattgaaaatccgcgcaggataacgcttgtgtaaaaccgagtgtcctgaaggtgggtaaggcggtccttattatcacttactcgaacgttgacattggtacagtccctatcaggtaggatgtactgacgttttgacaatagtttcgattttatggattgtttgaaaagagcgagacagtgacaaaacgtgatagattacatagtagtcagtatacaactttccgtaattagccacgaggccagaaaggaagagagaatagtataacctaatatagatctgcaatatcactattttggaactccttagactcatctggtttcgctctttcatccttaaagcttccattttttttctctattggtttactcgtaagctgatgctgcccctgtgagggcgagattgggaattgtggatgagaaggtctcgagccttgatgatgatcaccagccatattgcgagaaccgtttgaaggattataatttttattgattggcgcattggattcttggcgactatatttctgtggttgcctattgaagttggtttccggcttgttcacgtacctagggttatgatatctagagtcatttggcgagtttttgtaccgggactcatttgaattaccctggtatcttgactgaggccccaatggcaaaggtactttattatatttagagctgacatttgtctcaggatgaaatcgatttacgggattcctgctgttgttgggtgcagtgctgttgccgctgaagcgattatttctggaactattgttgggtccgtatctattaactcctgcaggggctgctggcggtggaatcgcagttttagcatatccgctgttcacatgatacggtctaggattttgatgtagttctcttattttcgaaggaggcggcttagccaatacgttctttgatggaggcaaaaaacttgcgtcatctttcttggggcctcttgggatcgccccaagatttttcacgacaggtgattcacccttttcaactatatgacctcttggcgcagtaggtactctttgggacaatgattggtgcatttcttccttgtacctcttaatatcagcttcatgactttcttccgtcggtaatgttatcttctctgatggtaaagggtcctctttaaaccaaggatggtgtttagcagacatagcggtcaacctcttgtaaggatctaacgctaacaactgtcctaaaaaatctagacctgtttcacttagatatttaccaaatctttccctcaacgttggcttgtaattagttgttgttagttcagcacctggcaaatatctagccacggcccaatcttcttctgtcggtgtaccaagtagtttgaaaataacatgtccctgatcaatatccgtttttccctgtaaaataggttttttctcaaaaaattctgcgaaaacgcatccgacaccccatatatcaacagctgttgtatactgtttatcaccaagcaccaactcaggtgctctataccatctcgttacgactactgatgtatatttggcgccggaacctgcaccaccaggatactttaagtttggaggacagccataatataatcttgctaaaccaaaatcagcaagctttaaaacaccgttgtggtcaatcaaaatatttgctgtctttatatccctatgcatgaattttgcacaatgaatataatttaggccttctaatatttgtagcatcatattctttatatcgcacatctctaagttgattctcggattatgcaaaacgcccgacagatctgctaccatatacggcaggatcatgtagaatgacttatgtaggttgctggatgccgcatttgtaatatccggtgaatggtcatacaccatttcgattagtttaataatatttttgtggtttaaacgctttaaaatagtaatttctcgttgtgcagttataggaaacagatctttttcaacgctaactataatttttttcattgccacttgtctttgagtctctaaatgaattcccttataaacctcaccaaatgttccttgtcctaatttttcatcctcacgataatgattctggaaaactgtacacccgtaaactttctcactacttctttttcttagtttgatgtatgttaagttagtcttcgcatctcgctggatggctggtgtactcttcactttgccgattttgtatttattaaattcggtttttggaagaaccgcgggggaaccattatcactcatattattttactgttattctgcttgaccacgaatgtactgctaatactatacaatttcttttgctggtgtttggtaatatttcttttcaccattgttaatttctctctctacattgcctatgctctattaaatgcatatgtgaatttttcaaattcacagaggtttggtgtatgggtgtatttccgttcgacgcgatgaccacataatcttgaacttacttattaggaaagctgaacagtggaatatcagagttgctaccgccaataaaatgtctgtatattgttcccaagattcacagttgtgtccaggagtagtacatattagatttggggataattcttcttaattcctgaagaatgatctgcatctggtaacttctcaagtcaaacgggatcatggtgccctgaaattgataattgctagcgtaaaatgctgcggtcgcattatctctcaaaccaacggctgatttctcggtaaaaaaatccagttgcactaaattttcccaaacgttcttgacgtcctttttcaaccatagtttgatagtattgtcgatagaaaaagtactttgacctgttcccacatttgtagtaggagccacggtgggaattctggagttgatagctttaatcatcttttcatactctgcataagctaaattaaaattaaaagatccgtctttcgcccttaaggcaaccctagcggctgagatcaaaatggctaactctaaatcggataaagattggagccttcctgttaaattattagatagttggttcttattgtatatgtcaagaaaagaacacgattttatggcagtgcagagtgaaccaaaatttttggatgtcgctactaatggaattatgctatttttcaatgtaggtaatgacctaaaggtttcgaaattcatcctaatatgtctattcaaattcgatcgagggtcggatagttctttttccaacgtttcattccattgtgaaacccagggggagatttcagagcgaactgtaagtaaatttctgacggcgtcaaccatatcgtctagattctgtatttgcggcatataaatcactctttgagaaaatctactctttaccctcttttctaaatattccaagatatttaatttcgttgtgcagccaaaaatgcaaacaggtacccgagaatgttctaccatgtcaaaaagattgtataataaagtttgcctcacaggcccagcaaatgtatcaatttcatcgaatataaaaacaactgttatctttgttatactctctctgtcaacctcaccactatcttcatttcttgtcttcgtggtcgaatctaagagtaaaagaattttctcaaacacttctgtcaaagaaccactgctaatagtctctaatgaagtatcgtcaattttttcttcactgccatgaattttctgcaactgctgttccaattgagttgctataccgttaatagctgtttgttcggagtgaataaacccattcaacctgatagttataaactgctctttataagattgttgcaacaaagacagttcatagtctaataagtatgttttgtaactttgtctgggccccacgagaattactgaatgactctctttctgaataatggattgtttaatgattctatcgatctcttgttgacaatcttgtaaatatgtgaagattatcttttcgtccgtaggaagtgtgccataaagttgctgcagtaaccttctttgaagggaaccaaaaccagggtcgctgtctttacacttttcattatctatagtacgcttttttagaatcgctgcagtctcctctacctcttcgtttgagtgcctctttattgggagaagattgacttgcggtgatagacgagcttcgcttatagtcatgcttcttcttttgaatattaccgatattagtagtttatatttgatatttctatcagtattatttagattttttttttttttttaattgttaatgctttttcttagaactttccaaaaacgaaaggaaaatgggacattcaaaaacttacctcacatagaaaaatgataaatccaaaaatacacttgaacacatgtatgaaacttaatacaaaatatatggttattttttttttaattatataatagagttagaatacctggtagaaaggagagtagaaaaacaagaaagaaaaaaagcaaacagtaaatacaaatgtacattttatcatcatacaacactctatttcttaccaacaacttcccaattgtcaccatcttcaacagtcaattgagcagttttatcctgtagcttttcaactgccgcatcaactttgttttcttttgcgtctccattttgcttttcagcctcttcatcttcatcatcatcttcagtacgtaaaacatcataaacagacttctggatttttggttgctcatcagtagtctttttgttagttagagacctatccttgtaggtatttttggtttgttgaggcttaccaaactgagcacctctggcagcaccccaatccaaagctggttcttccttttctctttctcttcttggtggtcttgaggagctttggaagttggaacctctggctgcactccagtcaatatctggctcttctctttctcttcttggtggcctcgaggagctttgaaagttagagcctctagctgcactccagtcaatatctggctcttctctttctcttcttggtggtctggaagagccttggaaattggagcctcttgcagcgctccagtcgatatcaacttcttctctttctcttcttggtggtctggaagagccttggaaattggaacctcttgcagcagtccagtcaatatcaacttcttctctttctcttcttggacctctgaagttagaacctctagcggcaccccaatcaagatctggtgcatcttctcttccatcaccttggaaattggagcctctagcactactccaatcaacatctgcacctccccctcttcttggagccgcaacagaaacgtaaacagttctctcattcaatttagtaccgttgaacttcagaacggcgaccaaatctgctctttctttcaaagtaacgaaagcattaccctttaatcttgttgggtctcttagattctttggcaaaacaacttcttcaaccgcttcaggcttaactaaaccatcttcaacccaggcttgaacaccctctggggtaatatcccatggaatgttgtttatgacagccctatatggtggagcatctggaacagggtattcctctcttctatcggaagaaccgccccccaaagcagggtctaatctagatctacctccaaaactgccaccaaagccgcctgaacgcgtgttattgctgttgtttttagcatgagccaattcggacaatggaatagtgtttgcattagcggtttcaataggaattgtgatcttattcaaatcgacatcttcttcagcccaagatgaaccaaaggtgtcatcatttaaaaatgacgtaaggtccatcttctttacggttttctttggtggagccatgatgtgtcctttttattatggtattattttcctaaagacagatgaaagctaatataaactcgagttttatgataatcccgcttattggtctactgatcttctctaactctgtagttatatctatctcttctgcttctatttctgcttttctttagcgatgctgatttccgcaaaaaaattttcattccgtggtgcgtgatctgatgagaaataaagccaaaaagaaaaaaagacaagaagacaaaaaggttgggcggctaagtagcgccaggatataaaaagcaacatagatttcagtaccctattatcctgccaaaatttactttaagaagtctctatgaatatacaggctaaatttggaaacatgagaaaggaaagatgaagatacaaagattgcaagcagtcaagaagatttaggaaaaaaggaaaaagcaaaaaatatcgatttttatgacttacaaactaaattgatatgttcgaaataattttgagaagctgagctcaatctggtactaatcacttcaagttagatgtgcaaagaaagagaatagcataaattcaaaaccaaaggaagtgcgaggcattacccgcatattatcgggaaacagaagccatgttagagtgatttccaacaaatggccctttgccagagatgggctctgcaaaagaattggaagaagagaagaaatcgcttcacattccgtttcgtttctgggtctaattaaagtagtacggtgtcaattaggtatgctaggtttgcgaactcatggtttagacaggtatgaacattatattcgtcgcccgtcggattttggcaaacttgagctgcaagattggttgaatcataagtcattccgagtttcccccaatttattaattgattcaagcaccacacgtgagtggaatgaacctgagcttttttatcaaaataccgaggatgaaacttgggtgagaccttgtgtagggccaaagctagaaccatcaatgatgatgctcagatatcacgattcgaatattggtcaaatgcctcaattttgttatccaatctcaagtccgataaattttaaaccagtattaaaatacattttgcaagaacgttctgaactgtcagacggcttccctcaaaagtataacacactaataggtagtctttttgacattgataaaaacccagaaaccttagatgattcagatatagaagcattggatgacatagaaatgagcagtgacagcggtaatgttaaagaaccaaaaattgaattgcaggcgctggaagaaatccaacaaaagcatttcagtttaatagtatccaacaatggaatctttcaaacaggtagcacttcaataacatacatacagtctggcatatctggcagcatagctataaaacccaacaacgttgcaattttaatattactcactcaaccaagtggtcacttattgtctattttaccgcttgatgacggtaaagagacatatttgctacaatattggaacctgggacaaaaaggtcagtggaacataatcaagcaccaaaacgagaagcagtttgttcttatacataaggaactaggcatttgcaaattttttgaattccatttaccatttacttttcaattagtaaacaatttaacattgaccgattccgtgattatgaacggatcctttttcccaacaaattacactgatttagatccctatttcattatatttataacagccataagatatgaaaggatagtctactttgtcatagaatggaacaacaacgaaataaagaaaaaagaggtatatcaattgacagtatttgatggtgagaagactaatatgacaatacccattggactaaatgcatgtttagtcgaaacacccctaaagttctctttagtttctgcaaatcaaattatgtcaggagagactgaattccactcattccaattgaaggctctcaagggaatcaagtcattttttccagctcctttattgttattaaaattacaagaactacacccacatacatttaaaaaattccaatattgtaccataatatcctcctcgacaggaaatatttgtttttgcgtcaccgaacgatcgacaatagtaaatggtaatttaaaattttacgagctaactaggttcaaaggattgaaatccatttcaccactaccttcaaatccgataaatttagactccagatcctcaagttatgtactggtggtcataagttttagtagaacattagagctaacattatctctagaagatttgagatgtttagataaaaaagacgttattaagcctttgaaaaatatcaccttcaagcacacaattgatagttccacagaggagaactctcaaattttagcatttacgtcttctaaattttataacacacacacaggctctaacatcaatgacacgagaaattctcaagtttggcttacctcaccaaatgcaataactcaaccttgcattgattataaactcaggaaaactcatcaacttatccacttaaagcaatttcaaatttttagacatcttaggatatggaaatgtaagaaccttgatattgctctgttacagagacttggaataaaccagtcaaataccgaaagttcgttaatttttgcgaccgacgctgtttctaacaacagaatatttttattagatttaactatgacaacgacaatcgataatgatgatcccgttcaaggactgataaatatagaagatttactatgtgatactgaaaacgaaactatccttctaaattttacgaaaaataacttgattcaagtaactagggatacgatatacatcgatcccattggtggggacaaagagttgcgtaagatttctccaggttgggaattcgaaaacgttacatacaatgatggtattttaatagtttggaatgctgggcttggctgtgtctcttatattgaaaatatagacgctgttgatgagtctggcgccttagtttcaaacttaagcagcagcaaaggcatgagcaagttcttcaagcagttaggaactgtcacgagtgtcaattttcaaatcaaagagtctacagatgatccaaccaagtatgacatttggatccttttaccagactgtgtcattcgtacacccttttctgactggattagtgattcacttgatttttctgatgtgtatattttgagtgttcagcaggcgttaataaacggcccttatttttgctctctcgattatgaatcatattttgaggtgcacactttacagaacaactgcttcaaaaaaggatccagatgtacaagcagagttaattttcaagggaaagatattaaatttagaagctttggtgtgaatcaatgtttggcatttagtgcatttgaaatttttgtcatcaatttaacgccaattcacgacagtagagaattggatttttacaagctaaaattaccgcacctaggtaataacaattcaattcttgaagtctgtccggacatagaaaacaaccaattattcatactctactctgatggcttaagaatcctcgaactatcatacctaacatcaaataatggaaatttcttattaaaatctacaagaagcaaaaataagaaatttttatatctagacaaaataaatcgaatgctggtattgaatcaggacttgagggaatgggagtgtattagactatcagatggtaaggcagttggtttagattctcaacttcttaaggatgattctgaagaaatcctagaaataaaggaattaccaatagcaacagaggacaatcctttagaaaagaaaactgtattattgatctcttttactagctcattaaaactagttttattaactgctgcaaaaaacaaaatttccaatcaaataatagattcgtataaacttgacaattcaagactcctcaatcatttggtcattactcccagaggtgaaatattctttctggattataaagttatgggcaccgataacgaaatgtcctttaacaagttgaaagtcacaaaacattgcattgaccaggaggagagaaataatacgactttgcggctcactttggaaacccggtttacatttaagagttggagtacagttaagacgtttactgtagtaggcgataatatcattgctaccacaaatatgggcgaaaagctctacttgattaaggatttctcttcatcatctgacgaatcgagaagggtgtatcccttggaaatgtatcctgattcaaaagttcaaaagataataccattaaatgaatgctgctttgttgttgccgcttactgtggaaataggaacgatttagattcaagattaattttttactctttacccaccatcaaagttgggcttaataacgaaacaggcagcctaccagatgaatatgggaatgggagagtcgacgacatattcgaggttgactttcctgaaggatttcaatttggcactatggctttgtatgatgttttacatggtgagaggcacgtaaatcgttacagcgaaggcatacggtcggagaatgacgaagcagaggttgccctaaggcagcgtagaaatttactactcttttggcgaaaccactcttctacaccaaaaccttcactacgccgagccgccactatagtatatgaggatcatgtatcatcccgttattttgaggatataagttctatattaggaagcactgcaatgagaactaaaagactatctccctataatgcggtagcattggacaagcctattcaagatattagttacgatcccgcagtacaaactttatatgtgctaatggcagatcaaacaattcacaaattcggcaaggacaggttgccttgccaggacgaatacgaaccaagatggaattctggctatttggtttcaagaaggtcaatagttaaatctgacctcatctgtgaggttgggttatggaaccttagcgataactgcaagaacacagtataattccctcatttccaataacattgtcgctgataaaatcgtgattctcgatcaatgtgctacgcgtcgtgcagcgtgacaaggggctaaaaaaagatacaagaattcttgttgtttccaatttgcttcgcctcagaaaaaaaaataaacagattatacaatttttgtttgatttgtattgggtactacatgttttagtagttgatacaaatacttctttatcctaatcgtatatatttattttaccagcaggaattcgtctttaatatcgtttcgaccatcgatcattcctctgagtattgcaaaaacatttttggaacaacccaaacttaaagttacaaaactcaaaaaaggaacaaaattaataaaacaaaagaatcgctgttagaggtttattgttgcactaatagaaaatcatagaactttaaaaattatactagaaagatgtcacaacaagttggtaacagtatcagaagaaagctggtaatcgttggtgatggtgcctgtggtaagacatgtttattaatcgtcttttccaagggccaatttccagaagtctacgtaccaactgtctttgaaaactatgtagcagatgttgaagttgatgggcgtcgtgtagagctagcgctatgggataccgctggtcaagaagattatgatagactaagaccattgtcatacccagactccaatgtcgtattaatttgtttctctatcgatcttccagattctttagagaatgtacaagaaaaatggattgccgaagtattacatttctgtcaaggtgtgccaattattcttgttggttgtaaagtggatttgagaaacgacccacaaaccattgaacaattaagacaagaaggtcaacaacccgttacatcacaggagggacaatctgtagcagaccagattggcgcaaccggatactacgaatgttcggccaagactggttatggtgtcagagaagtgtttgaggccgccactagagcttcattgatgggtaaatctaaaacgaatggtaaagctaagaagaacactactgaaaagaagaagaagaagtgtgtcttgttataggagtgtctcgatctctcagtcgttaacttagtggcagatactgccctttttcaatcccattccttttctcattgtatgtacgtatgcctttttttgttattttagctctaactatagctacttgtttttctcccagtatgtgtataatcttattcttctctacatataagtgtattgctcagtaagtattatcatctattaaagaagaataaaaattatcatgtatttatttacaagtgcgtatcctatatatatatatatatatactttcgcgataaaattttttaccaaatacccttcttaacacctggcaaattacccttcagagcgttttctctaaattgatacctacacaacctaaaatcacttagaacaaatcttgcatgtccagagtccacgcacctatttttgatctgcgtagatctcatgtagtttggcaatgcatttagttttaactgagcctccaacctcagttttgttggaaggttcatatttctagcgatgaatttcaaagatttaacaaggatttcattctctttaaattgttgtcttttgaagttatccctaagtatgcgagcattgataaaccctggtggtagcttggtttttataggaaatctgaaattacccatcggttaatgtatatatttgtcagtttaccttttctttcgtttttcctttcaatcctctttatcgcagtttggttcttagtttgaatattcctctgttttcgctcttttctcgtacagcgcgaattctccgccagctttagaaagttgtaatcattggtgttattaaggaataaataattagtcacatacatatggttatatatcgtactctatctatctaggcatcttgctttaaaaattgcgcgaatcggctggcttcatgaattccacactcggtcttggccttgcccttccatcttcctgctctctcatcttcaccttccttgacgggttgtgtggaatggtaatcaccaatggatctatatccaaggtccaaaagttcgttgtatggtacattgtttgcatctatatactgtttaacctgctcgaacgtccaattgatcaatggatttatttttaagattccattaagttcgtctatttcaataatcgacagttgggagcgggcagaaccttgtgattttcttctaccagtaaacacagcacttatatgtagctctttgtaggcacgatgtgcaggttccactttggccagataatcgtacttgtcatcatctttctcccataagaaatccccgtatttcgaggcaaaatctgcctccgattcacatccatccggcttatatacgtgaatggtttgatttttaggctggtagtattttttctcaatctcgttttttagtgttaaagtttgtgggaaatggtgcaaagtgtctataaataatagttctggcatgtagtatttttcagatagctttgacaacatatcgatagtaaccaagccagtcaaaccaaatgcagtggtttggaaaaggtgaggaaacgttacgatagaccatgcaataatctcctgtggcgtttccagcttgattagttgttcattccaatgatccaactgttcttgtgtgacaattatatcattattcaaatgataggtcttcattttatgagttgctatgggttgatacctttgctggccttagttttgatcttaaagcattgaaaaggttacaaacagtacagtatactttttttatatcaatataatactatctctatgagcttttactttgtcgagatttgctgagtcatgttgtggcttttcttttactagccacgtgaaatgatgataaaaataaaaagaataacgacggaataaagaacagtatgataaaccgtaaagatatttagaatcaataggtgatgtccacccggtaacaagatgccattcatgttaaactaggacaaatttccttcttgtccccccaccattctcttttatccaattcttttgtcagcgcgcattaaagaacaagaacttcgtacttttaactactaactcctgtttgagaaagaggcaaatatatagaaaaataaaccgataagatgaatggaaacagcactaacaatgaacaattgcagcaagaactggccactactcaagaccaagtggcttcgattattgagtccttcgttgaattaggtgtctcgatatatgattttcctggtactccagaagccaccaagggaatgatcaccaacttgcaaagaaatgtggatcgcttgtacaagctgaacgtgagaagcaacgatcctcaatccagcttgtctaaggtggacattcccttggaagttgttcaatacattgaggacggtagaaatccagatatttacacaagagagttcgtggaagccataagaagatccaaccaatatcaaagaggcaagatgcatggattgaagcaattaagagattcacttgctgacaagattgtggatgaatttccagagttgaaagaacctgttgaagatattataaagagaacatctcccattgacaatgtctccaatactcactaatagtaatttttctgattttttttctcgctagaaaaaaaaaatttcatggttagaaaaattttaacatagaaatcatggcatcatcgccacaattggaagaggaagcagctgggaaattagaaacaatccacgcatcagctatggcaaagagcaaaaaaaaaacagatgttgtcgattcaacaaacctgcccattctagaattactatcattaaaagctcccattttccagtctcttttacatcctgaactgcccattataataactggctttggtacaggacatattgtgtgccatcgttatgaccccgctaagttgcaatcgcacctagatcgtagacgtagaattgacactgcaactacaggcaaggatgcaaagaaaggtgtatgcccttggattagattagatatagacctagaaactggagatttgaaatttgttgatattgaagaacaacagcaacaaaagcaaacaggaaaagatgaagacttgggcgtaaaaacactttggaagactaaaagacataaaggtagtgtccgtgccatgtgctttgattctaaaggtgacaatattttttctgttggatcggataatgttttaaaaaaggccaatactatgaccggcaaagtcgtcaaaaaggtaaacttaagctcactgtttaattctgaagagaaaaaaaatgataaatttacgaaattatgcgcctctcaaactcacccattcattttaataggcgatgaatccggtaatatacacgtaataaactcggaaaacttggcattatcaaattccattcgttcgatacattttggcgactctatcaacgatattttccactttgataaaagatctgcatataaattcatttctttgggccagacaacgttagcttattttgacgttcgcgacaaagatgccaaaccgaacgtagctggaaacgaggatggtaaaattttgatcagcgatgatcaggaggacgaagttctttgtggttgtttcgtcgatcccgaagtagcagatacccttttgtgtgggatgggcgagggtattgttaccgtctggaaaccgaataagaatgatttggaagatcaaatgagccgtattaaaattagcaaagatgaaagtatcgattgcattgttcctactttacaagatgataactgtgtatggtgtggttgttccaatggtaacatttataaagtaaatgccaaattgggaaaagtcgtcgagataagaaaccacagtgaattggatgaagtcagttttgttgatctagattttgaataccgtgttgtttctggtggtttggaaaacatcaagatatgggaattatcgagtgatgatgtagaggaaaatgcatcggtagagtccgatagcgacgaacccctctcccactctgatgaggatctaagtgatgacactagttctgatgatgaaacgacgcttgtcgggctctcaaaggaagagctattagacgaattagataaggacctcaaggaagatcatcaagaggaaaaagaatccaactcaaaatctgtcaaaaaaagaaaaataatgaaggagaacaacaaaaaaaaggacctgtatgagcatgggatcaagaagtttgatgatttatagattatttcttttttactaagaaaaacatatatcatttatattcagaaataaataggattattaacctagtgctcccaaaaaaaataagttgaactgtctctttcgagaaaaagaaagagaaaagaaatggtctctagcgggatcgaaccgctgatccccgcgttattagcacggtgccttaaccaactgggccaagagaccattatattgttaaagatgttgtatctcaaaatgggatacgtcagtatgacaatacttcatcctaaacgttcataaaacacatatgaaacaactttataacaaaacgaacaacatgaggtaaaacccggcctcccctagctgaacaactcaaacgtataaatgcctgaacaattagtttagatccgagtttccgcgcttccaccatttagtatgattcatattttatataatatataggataagtaacatcccgtgaatcaagctgataaacagttttgacaactggttacttccctaagactgtttatattaggattgtcaagacactccggtattactcgagcccgtaatacaacagtgagctattaaaagagcttaagtattacagagtaatatcaatcatcaatcttggatctaaagtaatcgtcgagacatttatacacttaagtgattcctctttacaagcggagcttactctatatattcattcttgtcagtttcataacagttgtttcatacgatttccacatgtgtctcatatatattttatgtttaggttaataactttggtaatgctaaattatcttaatttgacgtacacaaattcttcctactgttatatatgttcgaattatcttttaaattgttgctaaaaaagttagagttatcaccaaatcagttgagcagatcaccattattcttatgtaaatacttgttaaaagaagtagctttcgcaaatacaccaatgcattcgttgataatttacgcagtaacctcttacagaacgcctacatacaacttaaactcgtaatgttcaggcttataatgtcagtatgcattgttacgcttagtatagttattaaactacggaccaaattatactttaagcagtagttaaagaaagagattaaataaagaatgatttacaatctagtcgcaaaaacaagtacagtgctgacgtcccatcttttaatgcctactcttttgatgttcacttacatgttacaatgaagccaaatcacaaacattcaaatatattccatggcctcttagtttggcaacccaagactcggcataccatattggtaacgctgtattggagagatatattctaaaatattgataattaatggcaaaaaggcagtattaatgaaggttgaatatggatcttaatataatcgtataagaggggcataaaatatacgccgattggttcaacattaattatgatcaatataacaatgcgtctggtaattaccataacacttaatgtagcaactcgtataacaaacgtatcatgctcaattaatataaccttatctctgcttcagcactgtctgagctactcttttaacgtttccttttgcaataggtaccttcacactaaaacatatacaatgggtgcatttaaattgttaccatagcaactcatattacgattcattaccactcatttcaacacaacaacctcttgctatcaaacttacttttgcttttattgcagatatctcgttatttctgcaaaaacagcattcattggtaatgacaaggtcaattttggcttttatacatttcacatgtacaggatagtggaacacattccaaggaggtgaagaacgtcccctttgatacttccatacaaggacgattaaaaatacataagagaacagatctgcaaaaatgcgttttacttcctttacaatctcaatgccgataaataagcgcaatgaagattactcagcaactgtatgttggctcatgcgaaatatgaatgtttcattcgagattacttatcttgtttaacgcttgaacagcgtactgtaacttcttgctacagaatgatggaccccattataatactaccgccttgcgaatgcgcaatttattatgatcatgaaccctgagaaatcaaatgaatatttaaagtgtatgcaaaatggacaagaacattatggtaacattgtctacgacagaatttattttctgactttaatagtgacggttatacgaaattaatgattcttcgagaggcaactcactttactgcaaatggacctgcagagtttgcatctagaggacaatatgctgcacaaaaacgaccaatatttaccttcaacgaaaacaaccttaagaaaccccttcaacaacaacgcagctatcgtatcgtagtggtctccataatgcgtgcacctcctttagcacttatcgagtaataacatacgctagataagtaaagtgtccaggatattataattatatgatatttcgggaatggtttctatatctagttttttaacttagcctagacattcgcctcgtattataaaatacatgaaagtgacttgactgcttcatgagagttatactaagagcattcataactagaagacacattttagtttttattactgagtaagggtttagtttgtacatacaaggcaacatgaaattcaaggtgctgatgttcagtaaagccgcctagctttacgtgccgaaatattgataatatgtctcagccacttcctggcttaactatttaaatgatatttctgcatccatcggtatggcgcacaataaacggtatctgagaatatcgaaaagaacaccacaatactactgagtgcaaacacagaagagcgtaggtgattcaactaattgagttagaaactgcatcaacgctgcataataaagatgctgctgttcaggatcattttttttaaagactgaaaaaaattgcttatcgctttgcacgcgactcttttttctattatttgaaaaatagcttaagggaaaagaaaagaataggtagctttcaaagcaagaacctctacgataaaggacaaagctagaagcaaacaccgcaaaaaaaatgagacccgttgtatccactggtaaggcatggtgttgtaccgtcctatcggcatttggtgtagtaattctttccgtcattgctcatctcttcaacacaaaccatgaatcctttgtaggatcaataaacgatcctgaagatggacctgcgtatgttatattttcttatttatttcgccgttacccatttaccatctcttatatctctcctccttactaacaattatattttaaccctattgtttatagtgttgcacatactgtttatttggctgccttggtatacctcgtgtttttcgtattctgtgggttccaagtttacctagccagaagaaaaccttcgatcgagttgcgttagtcttgaagccaataggataataccaaatgcattaatatcgtccaactgttctatatacttatcgtaacctcgttccatgtgacattcttttttattacacttttcgacaatagcgaattgagtgaaatattatgaaagaatatatagtataaatatatacatttatatatgaattctaatcaataaaagtcacagtaaccagcttttcctagcttttcgaagtttcggaagtatgacaaaatatgagcgtgaccctgaattggtgaactttctatcgaaagtggaggatttgaactctaagagatacagtaatattcctagttcaaaaccagcgggggaagcgctttcaccagttagaagtcacaactctggggaatacagaagggctgatatgatgacagggaaaaatgtggaaggttgcgacaatttggcctaccgatctgcgtacaattatgaaatgacgttttctccaaagaagactcattactcattaagtgagctgaatctcgaacgaataacgccaaggccggatttggagggaagtgcctctcaaaaagaaaaaaaatttttaatttctgaagaagattatttattattgcagaaattgaaagcctctcaaacatataatgattccaatgctgacaaaaatttgccttcctttgaaaaaggtcctcgtatgcccagtcggggtcgacccagaccgagagagaaggaaataatcaccatccaatatgattttgaattaccaggaagagccgatataccctcctcctcctcttcttcatcaccaccgcctttgcccacaaggcgtgatcatatcaaaatcacagatgggaatgaagagaaaccgcttcttccaacaaggcctaacaaagcagaagttacagaaagtccgtcatcaaggtcaataaaaccggatgctgtggtacctgagcgcgttaagcctgctccacctgtctcacgctctacaaaaccggcgagctttttaagttctttggaagataacaaattgacaaaggcgaagagttataattcggaaatggaaactcccaaaacaactgtaaaaagttctcatatcgattacttggattccatacaactaaaaccaaccaccttatctcctacaatgaaaaataaacctaaaccaacccctccttctccacctgcgaaaagaattccaagatctgaaagttttatcaagtctatgctaaactcgaatctcacgacaacttccaagccttctttgcctgaaaaacctcaaaagctacggaatgcaaatttggccgcccataagaccaaaccaagcataccgccaaagaaagtggagttgaatatagtattacctgagctacgtcccgtagaaacttctccaacaaagcagaacttcgaaaactcaatcgatttgcccaagttacgatccagcaaccgtaacattaaaaaagaagaggaggacagtattccagaagcaataaaaggtatacaaaatctgaagaaaaccaaacagcagaagcctgcaatccctcagaaaaaatcatttctaacaaataattcgaaaaatactacactcaaaaatggtgatgatattaacaagttaaatgacgaaattgaagctctatcattgcggaataacctgaagaaacggccaccaacggcgccacaacgtaaaatttctttgccagaggcattgcgaaaagtcgaattgatgaaaaaatctaaaaccgagcctgttttagagtcctcaaacgaactgagcataaacgcaaaattagacgcaataattgcctctagaaacttaagagcatctaatactctaccagaacttagcggtgttaacactaatattgcaacttctgacaagtatactacttctagagatgaaacagtgaaggaaactaaaccattagttcacccgaataaaaataggactcgtggtcccagaagaaaacttccaacacgcgtgtaactacagagtagacctccgtattttacacatgtatgtacgtacatatgatgtaacaataatatgataatttaatgggatacatgtattatcgtcacttcccacgtttgcgctttgacatttgctccccttatgaacctgaaggaatataaatcatcgatctttttgctacacttttcctcccttattagaaaatagcagtaaaattacaggctattcaaaccctgaaacatctcaattatggcttggactagtacattaccagcgcatctactgaacctgatcaaaaactccaaatatgttcacgtggccacctgttctaaagactgcatcccttcagtggcattgatgaactatatctatgtgccaggtgaaaaactgttcggtcaaacagataataagaatgactacattatatttgtttctcctcaggacacacaaaagttttacaacatcaaggagaaccctaaggtcgccctgttgtttcacgattggatcatcgcgaataatttgtcagtgggcaaggaaagcatctctgggactccgacgccgacttctattcctcatgaagagcaacgtcaaagcgagcttttaaatttgttacaggagttaaatcaagccgaattgaaccaaatgagcgcatctattggtggcgaaaccgaaattgtcaatcctgaaagtgaagaatccaagtactataaagatttaatactaaaggctaatcctgatgcgaaagcttttatatttgaaaagaacaccgccgttgttaaagttagaattgataatgctagggtatccaataatgagaacagaacaatgtttctaagtaaagggaagagttaactgtcctctgcttttctttatctattttgcatacgattctgtatttaattattctgttttttttttttttttattttttattttcatgtacacaagaaatctacattagcacgttaatcaattgactagttaccttcttgaccaaaatctctagtgaactgttcttgcttcagcaagtcatcctcattcacggtaggtctcgtcgatttgatagcctttaagaaatcctttatggtgagatctggttcttttaattcatcagcttcaatatccgtccaactcatctcgatggcgccatcatcacctggagagcatggtgttagttttcttgtttcgtcgtcctccgtagagacatctttgaaatgtgtcgcgctttgaatttttcttatcggttgcattagcgcatctttcaccactacagcaatatcactcccggaataaccttcagtcattgcacctaaagttctataatcttccttggtcaatacgcatggagtgtcgccgacgttaatctcgaacatggtggttcttgccgccaaatctggtaatggtatatatattcttctttcaaatcttctcctgatggcactgtccagttgccatgggatatttgttgcgccaaggaccaaaacaccttgggagtcattcccaacaccattcatttgtaccaataattctgttttaattcttctacttgcttcgctctctccttctcctctggtacctgttagcgcatccacttcatctataaaaataatagaaggtttattttctcttgccatcgcaaataactgtttgacaagtttttcagattcacccatccacttagaaaccaaatcactggaactaacactgaaaaaggtagaattggcctcggtggccactgcttttgccaaatatgatttacctgtacctggtggtccgtacaataagattcccgaagtgggcttacggttacctttgaacaaatgtgggaacttgacaggtaaaataacggcttctttaagggcctctttggctccttccagtccagccacgtcttcccacttaacattgggcttctcagacaaaatagcactcgataaggcacctcttagctttttgttgtcttctccaccattatcctcaccctcttcctgagagattttcttattaccaccgttggaaccactaccagcgctaggagatttctttgccgcgtttgcctcttcactttccaagtgctttttcaactgctctgcacggtttagatactctgtaaacttcgctcttatcaaatccttcgacttagggtttttctcgtatttcaaagccaacatcaaataatctaatccgttatagtatgctgtatacgcctcctcatactgcgtggctgtgtccaggtcaatggccttttgaaccagttctattcccttagttaaaaaatctcccgtgctcatttgtaccccatctactataggcactctatgctgctttatttttgtcttccatgtcctcaacccacgattaaatcgttcgatatcatgaagttcttatttttttttttttttcacccagcgggggtacccgtaaagcaatacaataaatatcatcaagcaagaataaatagatgtacagaaagaacaaccatgacgtgttgtgtttctattcagcgtgcggaaccgaatcctcagtcggagattctctgagaatgttcgtttgaggaagcttaggatacttggcgtagaagttggggccctttgggggctgtagggaagaaactggtcgttggcgcgactggagtggcgacatgtgaatcggacttgaagtcactaacgggtttactgctcttactggcgaaggtggtaaattttctgtcggtttgaggttgtctcgctcaatatttttcatgtctcgacgagactccaggtatctttgatcgatgtttgcgtcgtccaacaccgactgcaacagatgacacttttccttgacaaattgtagttccttttgtgtagagtgcagctgctgccgcaattgcgcaaactttgcttgccattgtagaggcacacaatcctgagaatttttagacaatgggacaacgctttcttcttcctcatctgcgggagacccccatacaaacgcttggatcttggcaagagtcttagcaatattgaatccaaacgcgtgttgttgagccctctttttggagatattcttgtagtttttagaacgtgtcctttgtgaagcgtgtctaacatgatttctttcgcgaggcacaaccaccaatttgcgctcttttcgtatccccaatgtcttttcctgaattcccattgtgatcttcaatgccaacccaaccttctttttactttgttgggtctaaattatgttactttgtccatttcatctcttttcaagatggaatctaaaagaagaaaaacgacaaaaggaacaaaagtgatgtgacgcgttatttttcgcgtgacataatagaaaaatatttcaactgggcatctttaacacatgttacaataaagttgagatgacttgtttatgcctttaaagtttgtaagtggaactagaagcgtctatgtgtgaaatgtttggctctgggaatgttctgcctgttaaaattcagcctccgctgcttaggccactggcgtatagagttttatcaagaaaatatggtttatcaattaaatctgatggactgtctgctcttgcagaattcgttggcactaatataggtgctaactggagacaagggcctgctacaataaaatttctcgagcaatttgctgcagtatggaaacaacaagaaagaggccttttcatcgaccagagcggggttaaagaagttatacaggagatgaaagaacgtgagaaagtcgaatggagtcatgaacaccctattcaacatgaggagaatatcttgggacggacagatgacgatgagaacaacagtgacgatgaaatgccgatcgctgctgattcatccttacaaaatgtttcattatcttcacccatgcgacagcccaccgaaagagatgaatataaacagcctttcaagccagaaagctccaaggcgttggactggagggactacttcaaagttatcaatgcttctcagcaacaaagattctcatacaatccgcacaaaatgcaatttattttcgtccccaataaaaagcagaatgggctaggaggcattgcgggttttctaccagatatagaggacaaagttcaaatgttcttgacaagatattacctcacgaacgacagagtcatgagaaatgaaaacttccaaaacagtgacatgtttaatccattatcatctatggtgtctttacaaaatgaactgtccaatactaaccgacagcagcaatccagcagtatgagtatcaccccaataaaaaacctactaggtagggatgctcaaaactttctactattggggctcttaaataagaactttaagggcaattggtcactggaagatccgtctggatctgtcgaaattgacatttcccaaactatccctacacaaggccattactacgtgccaggttgcatggttcttgtggaaggaatatactattctgtaggaaataaattccatgttacctccatgactttaccccctggtgagagaagagaaattacattagaaacgataggtaatctcgatctcttaggaatacatggcatttctaataacaatttcattgctcgtttggataaagatttgaagattagattacaccttttggagaaagaattaacagatcataaatttgtaattctcggcgcaaatttgttcctagatgatttgaaaattatgactgcactcagcaaaattttgcaaaaattaaatgatgacccaccgaccctattaatttggcaaggttctttcacttcagttcccgttttcgcatcaatgagtagccggaatataagtagttccactcaatttaagaataatttcgatgccttggcgacgcttctgtcaagatttgacaatttgaccgaaaataccacaatgatatttattccaggtcctaacgatttatgggggtcgatggtgtcattgggggcaagtgggacattaccgcaagatccaattcctagtgcgtttaccaaaaaaatcaacaaggtctgtaaaaacgttgtatggagctcaaatccaactagaatagcatacttatcccaagaaatagtcattttcagggacgatttatccggaagattcaaaagacaccgtttggaattcccattcaacgagagcgaagatgtttatactgaaaacgataacatgatgtctaaagacaccgatattgtaccaatcgatgaattagttaaagaaccagaccagttaccacaaaaggttcaagaaacaagaaaactcgttaaaacaatactagaccagggtcatttatcgccatttcttgattccttgcgcccaatttcatgggatttggaccacactttgacactttgcccaataccatcgacaatggttctttgcgacactacttctgcacaatttgatttgacatacaacggttgtaaagtaattaaccctggaagtttcattcataatagacgtgctaggtatatggagtacgttccatcctcaaagaaaactatacaagaagagatatatatctaaataatgcatcaaaataagaacacttaaacaagcacggtagtgttggtactctgccatctatttgtatggatactttttgaattttgatgtaacggatttcggcatacaatatatgggatctatggggactaaattgtcgtatcccattaaacttaaaccagcaacaccaaaaactgtatggaagacatccacttcattttcaggcctgtcgcttattccacccttcttctcatcttgacatttgagtataaactcagttagcttctcataatttatccaatctagtctaccaataatagctaatgaagataaaacccaccaactatagcaaacatcgggcagtttacttggcctaccgtttagtccaccttctggtaattgtcgttcgcaaagccaccacccaatttcttctagttggtcgtcactaagcatatccaatttgttagcaattgccaaagcgccaagacaggtaaaagcttgagctgcatgggattcagcattaggacataatccaaagccaccatcaaaattataacacttgagtacaaagtctacagcagggtcaacaacttcagacgttaattcacccaaaattgatagtgcactcaaggctgtataaacaaaccttgtatctacctccccaaacctgtcaccctggaacgaaccatcttccaattgattcccacggatgaaggaaatcaagcgaaccttacgatcttttccaagaacatccaaagcatcataagtggccaagatctgtacggcggacaatgtagttaataaatgtgcatcatgtcttggaaatggtgcgaaagcgccgtatttgtcgtcccaacagctcagaacaaatgatataacctcttctttcacaaatgtctctggagaatcaagcacacacaaggcagtaagtccccaatatatcccattcaaacgaagatgctcggtaagccagtattcaaaattatgcttctttgtatccaatgattcaatataacgtatatgcttttccttaagtagcgtaagagatcctgacatgttcacaattttctagtggagaaaacagaatcattagtaacagtagtggtatctgaaatatatatatacacagtttcttaaattgttgtctttactactggtattactatcgctattacaagcgaagtcattaagtacggaaatgtttaaacgtagagagctagtaaaggaaaggctgttacatgatcactaatcgtaactttgcaacgagcctgagggaaatgactagtactattaccttgttgaacggaatatgagtaaatatattgcacttgaaaatcttccggtagatttgcaacataaaggagctacacaaaatgaaagcaccgctgatatactgaaacagttgccacatgaacgattacaagctgtcctggagaagataccagaagaagatcttgaggtgagacgattgctttcaattttaaagaagccggaagtagtggagaatgaagatgtacaacaaagaagaatacggttggctgaaattttaatggttgatgaaattgatcttgagaacattaataacatggaaaacataaatggggaagaagtagacgaagaggacgatgaggacttcttcactccagcaacatctgagctcatttttgcgagaagatttttgataaattattcacttgaaagatctcgaaagaggctacagaaagagatggaaagacatcaaaagttcaatacaagacaggaattactcagtcggcgtacagaattacagcgtatggctaatttagagcttgctggctctcaattagtatctacgaagcctatttccgcagtttctttatctaccgatgacatggttgtcgcaacgggaagctgggcaggtgatcttcaggtattaaattctcaaacactgcagccattgacacaaaaactcgactctcatgtagggaaaatcggagctatagattggcatcctgattcaaacaatcaaatgatttcatgcgcagaagacgggctcatcaaaaactttcaatactcaaacgaagagggcggccttcgattattgggagatcttgtgggacatgaaagacgtatttctgatgtgaaataccaccctagtggcaaatttataggtagtgcctctcatgatatgacttggagactttgggatgcgtcaacacatcaagaactgctgctacaagaaggccatgataagggagtgtttagtctgtcttttcaatgcgatggatctcttgtttgtagcggtggcatggactcgctttcaatgctatgggatataagatccggaagtaaggtgatgacactcgcaggacactcaaagcctatttacaccgtagcttggtcaccaaacgggtatcaagtagccactggtggtggtgatggaatcattaatgtttgggacatcagaaaacgggatgaaggccaactaaatcaaatattggcgcatcgtaacatcgttacgcaggtaaggttttcaaaggaagacggcggaaagaaacttgtctcttgtggctatgataatttgatcaatgtgtatagtagtgatacgtggttaaaaatgggaagtttagcaggccacactgataaaattattagcttggatatttcgaataattctcattttttagtgagcggcggatgggataggtctatcaagctctggaattgattgtgtaaagaaatgtatttagtatttttgaaactaacgttttattaacactgcattatttatttaattatacatttcctggtttttttgccctggattttttttttgtgttaccattttgagtacgaactcgtggaattgttaagttttccaagttgtccatcgtcttcgataactgtcccactaactcctcgtttagatcattctcaagctttaattcctttttcaaaaagccaattttctcattcaattcttttgtagagatttcagacttttcgaatttcaatttcaactcactttctaatccattttgtttctcattaagtttgtgtgtctcctcctcattttcccttatagcatcaacggctcttttgatttcttgttccatatatttcttctcagtatcccttgatacacttaccctttcttctttctcgatctcgtcttgtacattgtctgttttaacgaaagcgtcttttaactttgataatgtttcaccttgggccatcaaacttccctttaaagtttcaatgtctttttccagtgtttcgatttgggaaaacttcaaattgttttcaacttctagttcatgcgacctatttaagttttcattattggttcgcaatacggtttcatattcttttataattttctcatcttcatttgagaaaaatttcagatgatcattttgcaaatcatcaaggcaagaataatcatccagctcctgtttctgaacgcaaatatccatatacacttctcccattgattgaatcagtttgtgtgttatgattccacttgataagtggtaatttacattcgaggagttgtcagctgtagtaatacctgttagttgtgtcatgtcttgttttaaaggatttgtataataatcgttctttaatcttttggtagagtaaaaacttggagtaatattatcctcaattccggcaacagttgaagatgctgccttattagcaccatggcgtcctctttttttggaacagttggaaaaagcatcctctagttgatcatctgactttttgaaatgtacttccgttaacaaagacctttctacatccatggaagtatattgttttaaagggtaaatatctggtaatggccacggtactgttgggttttccaaccattctactaaataatgcagcttttgtgaataaatgggcctcaaatcaggtggaagtgtgcccagtcgatctcttaaaattaccatagctgcggtaacgttctccaagtattctctactgttcttgtcaaattttttaccaaagaataacctacaatgatcaattgaattaatggccactagcctaacaattggagcatatctttctaaacccttcctctccctcttatattgcaacaaatattgaatatctttttgacttgtatccactgtagtatctaagcagatcagcatgtcgaatcgagccttggattttatcggatattttgtgaaattaattccttcagaagaaaacaaatgaactgtacacgagaagtcatttgccttttgttttgacttgatagaatgaccgtcatatcttttgatatgcaccttatttcccaatagtaaggcttccagtaagtccattgttctcccaggtctacaaacaatggccgtttcagtttcatattcttgaacaagatttatgagatctctcaaaacgctgaactttccactattttccgctaaatgtgcaggaacatcacgagttattaacgatttaggcatataatgatctattagtaggtatggatgggttgctaccagtgaaccatttaaacacatggtcttcatagattcgagaatgacgtcctctttgtagtgtgacgtttcgaagtatctcaagatatctgagtagtgtaatgatactatttgatccgtgagttctttttgataaagcgacattgtagttggcagccaataatcaccggaagtatttcctgagattcccagagtagtagcatcaacaattgtaggtattggtttcgtgtctaaaatgcgtagtaaatccatactaaagggcaattagtttgtgcttctaactttcctttttatcatttttatagtctaaagtatttcttctctctattgtctttaattgaaactttggaaaaccgcggtgttatggatactagaacactaatgttattttttgcagttatcaattaaagtaaaagaagaacaaactgagtggattaaatcagtaactatggatatgaaagtagaaaaattaagtgaagatgaaattgcactgtatgatagacagattcgtctatggggaatgacagcacaggccaatatgagatcagcaaaagtattgctgatcaatcttggagcaattggttctgaaattaccaaaagtatcgtccttagtggtatagggcatttaaccatattggatggacacatggtgactgaagaagatttaggatcccagttcttcataggctctgaagatgttggccaatggaagattgatgcaacaaaagagagaattcaagacttgaacccccgtatagagttgaactttgataagcaggatttgcaagaaaaggacgaagagttctttcagcagtttgatttagtcgtggctacagaaatgcagattgatgaagcaatcaaaattaacacattaactcgaaaactaaacattccattatatgttgctggttctaatggattgttcgcttatgtttttattgatttgattgaattcatttcagaggatgaaaaattgcaaagtgtaagacctaccaccgttggtcccatttcaagcaataggagcattatagaagttactactagaaaagatgaagaagatgaaaaaaaaacatatgaacgaatcaagaccaagaactgctataggccactgaacgaagttttaagcacagcaacattaaaggaaaaaatgacgcaaagacagttaaaaagagtcactagtatcttgccgttaaccctgtccttattgcaatatggtctcaaccaaaagggcaaggccataagctttgaacaaatgaaaagagatgcggccgtatggtgtgaaaatctgggtgtaccagcaacagtggtaaaggacgattacatacaacagtttatcaaacagaaaggtatcgagtttgctcctgtcgcggccattatagggggtgctgtagcgcaggatgtcattaacattctaggtaaaaggctatctccattaaataatttcattgtttttgatggtattacattagacatgccactttttgagttttagatatatacatacctactatactgtagtttcagccaaaaaaaataataaaaaaagcataattggaggcagtaaagcattatagtcatacacaataataataataataataataataataataataataatagtagtagtagtaatggtaataaaaaagttagaaaagaaattagatacagatattcgtagtaaaggccacgcagtacaaaaaagacggagaatatattatataaaatcctctactcttttcgttcaggtccaaaggaaaattcttgcacgcgcaatggactgaacaggccttatattatacaaaaagcctaataacgatcaaataaaacaaaagaaagccgttgctcctatgcctgaccagagacggctacttgttgtaagtgagtcatgaaattttgtaaggaaacatcatctgttaagacaattgtagatcctccgcgcgccatgtcttgatagttatcggaaggattcaatttagataacaagaatctggcttgagaaccaccggcttcagtatcaatgaatcttggtagcgggaacctatctactaacaattctgcggcttctaattttggctcttcaagaagagctttgaaatctgcgtactgtggatcgtcttggtaaccggcttttctccattgagcgatttgctcaccgtggtatattaagatgaagaaaaatgtatctaataatagaatggtattgggtttgacggagatagagtctaataataccggttgtggatcgtcctccattgagaaagaagttagagttggttgaatcatgattaaagaattagtcgtatcctctcttgtgaaaatatgtctataaaatgcagtttcatccggagaattgttaaagacacttaagaattgggatcttcttaaataataggtaaattgaggatacagtgagaaatttggagccaacctgaaagattgaggatcatctttattatagtcggcgtacttttgacatagcttaatcaaagttctgtctaaccatctaataacatctgcaccatcatcggtttcagccttgtgaacagcaatacgagccatcaaaacggcagcagcttcttgatcgaaagaagctgcaatggcaggagtaccgaagggcaaaagctggtttgcgaccgtggtgactctgatacggttggtaccagaggagtgttgataagtagtgatgaattgagtatatgctagatgaggtctatctgctgaaccaggggcagacatcattgggttagaattagccgcagtgtttgcaatttcaaagaaaatcgcatacgagtgataaggcgataaggaagccatcttccaggtggacgttgcacctataccgatttcagattcactgatgttgttagcgtctgtcttctttacagcagaagcatgcccaatcaaaccttgtaccttcaagtctttacttgtcttgactgccatattaccattgaaagccatcttcaaatacccttcttcatccttggcaaacaatctcaagtatgattgcttaaaaatcgcggtagagaaggcatcggttagcaacaacacacctccagtagagtcggtcaactgtttcatttcagacataccgatttgatcgtaacaaccggcaaaaatatcaacagtgtgtccattggcggcaactctttgtgcaatctggttgtaaaacttacaggccttcttgtaatgttgcgcgtgatcagaatcgatgtcgtggtgggatcttaagggatcttttaactctgagttaacaatcaaacctggggccacggtgcctggaccggaggcgaaaagaatgattcttgctgggatgttcttatagcagccctgtaaaagcaaagatgcaatgttcaaagcggaacctgtggcccttaatggcctatgacccgctggaacagaccattggtctggagacagattttccagtaattgattcagtttgaactcgacctgttccaagggcaggaagaacctattcaaagagaagggcgtaactttgttcatggcgttcggtagatgagatgcagcaccgccggggccggtaggcttttggccggtcaacatttccgtcaacgcttcgagctggtactccctgtctcctctgaacacgttgcacctgtcaatagtttcgctggacagatcgtgcaattgaacaacgtttccgtaagtgatcaacccaatcagcgcgttgggaggtaatagagacaaagaagtgatgatagactcctttagcgaatcgaggttctcggtttccgaagtcaaatccacaacaaagaagaaaatgggaggaacggtaacgggcttattggtgatgtactcaatggtggtggactgtaactctagcggcatattctcctgtgacaagttggtgtactgtggaggtaaatggttcctggagttacagatgggacaactccaggacgaattgcgcggatcaatcacacagtaaggatttagaatcgacttacagtgtggaccggaacacacaactggattgtatggggcaacgttcaattcgtcatactccttcaaaggtgtgtacaaacagcccacagggacgacgttgctgttagcgtcgcttctagtagagggaaacacgttccaggtgaaacggaccccgttgatgtcttcattagtctcgaagtccatggctagaaaagaggaaggggaggcaggcgacagacagataaacactggcttcagttaattgtgtgtcttgctgaacgtggaaagatcacaacaagtatctttttttcttttttcaaacgtgtttttcttttattcttgctagaactttcctcctttgtaacaaacgagaggcggcgggctagtcgtcgcaagcgacaaatctcaactgacagtaaataacggtgataaaacaaaattagcgcaatctctcaaactactgaggacaaccaacttgaattgcactcttccaagttgtagcatggcttggggggtgtgtgatcccatcctgtattatggcaaagcaggcaaaacaaccgctctgccgtccgggtaacttttcttgttccacctcttttccccaacatatatgaacatgagatggtaagagcaagaaacaacggttctatgagcaacgcaaaaacagcacagcacacacagcaccgcgtactataccacaccacacactacgtcacaacacaacaagacaatgagcgagagcagtgatatcagcgcgatgcagccggtgaacccgaagccgttcctcaaaggcctggtcaaccatcgtgtaggcgtcaagcttaagttcaacagcaccgaatatagaggtacgctcgtgtccacggacaactactttaacctgcagctgaacgaagcagaagagtttgttgcgggtgtctcgcacggcaccctgggcgagatattcatccgctgcaataacgtgctgtacatcagggagctgccgaactaagacgactgtgctcatctcccttacataccagtatatttacatacgccctctactgtaatacaatatcattctatagcactcgcatcgcgtattttttttttattttcttgctttatattgttctatttttcttccttattcctgcctctggatttccctcgcatgacaaatagcgtggaaaaataaaggatttccagtatttgaaaaattttcagtattcttacgtgttcctaactcatatagaccgctattgtaataacgctatcgcttcaattacacacaaacatacacgcacccacaatgagcatcgaatactctgttatcgttcccgcttaccatgaaaagctgaacatcaaacccttaacaaccagattgtttgccggcatgagccctgaaatggccaagaagaccgagttgatctttgtcgatgacaactcacaggatggctccgttgaggaggtggacgccctagctcaccaaggctacaacgtccgcatcatcgtcaggacaaatgaacgtggtctatcctccgccgtgcttaagggtttctacgaggccaagggtcagtacctggtatgcatggacgcagacctacaacaccctccagagaccgtgcccaagttgttcgagtctttgcacgatcacgcctttactctgggcaccagatatgccccaggtgtcggcattgacaaggactggcctatgtacagacgcgtcatttcctccactgctagaatgatggccagacctttgaccatcgcctccgaccccatgagcgggttcttcggtctacaaaagaagtacctcgaaaactgcaaccctagggacatcaactcgcaaggtttcaagattgccctcgagcttctcgccaagcttcctcttccaagagaccctagagtggcgatcggcgaagtgccattcactttcggcgtgagaacggaaggtgaatccaaactgtcaggtaaagtcattatccaatacttgcaacaacttaaggagctctacgtcttcaagtttggcgccaataaccttatccttttcattactttctggtccattctgttcttctacgtttgctaccagctataccatttggtcttttaaaggaagtgaatggtaacgaaaaaaaaaaatctttctttatatgtctctttaagtactccctttcagttatatgccttttattgtctgtccctattctaatcctctactcgggccatcattgttaacgtaatatttgccctagggtaaaaacattaggttgattaggccataactcattctgccccacccccacacatagggttcaggaacttggttttcaaccctactgcattgtttcccacgcggcgctaccaaaatatatccaattttcttttttgtcacaacagcagcaaccccttgaaatggccaattcttctcgagactttgctcccttaatcttttcttcccccccggtttcttgatgattatatatactaacctcgtatattacacactgtacttgaagtcactcatatccgaatactacttctcttaacttccagtcaacccgacacccacaatcgtccttagtatataactgctttatgaatagatcattactgctacgtttgtcggataccggtgaacccattacaagctgctcttacggaaaaggtgtcttgacgctaccaccaattccgctccctaaggacgccccaaaggaccaaccgctctatacggtcaagctactggtatctgcaggttcccctgtcgctagggatgggctagtttggactaattgcccaccagatcacaacacgcccttcaagagggacaaattttacaaaaaaatcattcattccagctttcacgaggatgactgcattgacctgaatgtctacgctccaggctcgtactgcttttatctatctttcaggaacgataacgaaaaacttgagacaacaaggaaatactactttgttgccttgcccatgctttatataaacgatcagttcctacctttgaattccatcgctttacaaagtgttgtatcgaaatggctgggctctgactgggagcccatcctatcgaaaattgccgctaaaaactacaatatggtacatttcacccctctacaggaaagaggcgagtctaactcgccttactctatatacgaccaattgcagttcgaccaggaacactttaagtctcctgaagacgtgaaaaatttagttgagcatatacatcgcgatttaaacatgctttcattaacagatattgtttttaaccacacagctaataattctccttggttagttgagcacccggaggctgggtataaccacatcactgcgccacatctaatcagcgccatagagctcgaccaagaattgctcaattttagtaggaatttgaaatcctggggctatcctaccgaactgaaaaatatagaagatctcttcaagatcatggacggtattaaagtgcatgttttagggtcgttgaaactgtgggaatattatgcggtaaacgtgcaaacagctcttcgggatatcaaagcccattggaatgacgaatctaacgaaagttacagttttcccgagaatattaaagacatctcgtccgatttcgtaaaactagcttcctttgtgaaggacaacgtcactgagcctaacttcggcactcttggtgaaagaaactcaaacaggattaacgtgccaaaatttattcaactactgaagctcattaacgatggtggtagtgatgacagtgaatcttcgttggccacggctcaaaacatcttgaacgaggtcaacttacccttatatagagaatacgacgatgatgtcagtgagatactcgagcaactgttcaatcgtatcaaatatttgagattagatgacggtgggcccaagcaaggtccagtgaccgttgacgtgcccttaacagagccttattttacgaggttcaaaggaaaagatggtactgattatgccctcgccaacaatggctggatatggaatggtaacccactagtggattttgcatcgcagaattcaagagcttatttacgtagagaagttatcgtgtggggggactgtgtcaagttaagatacggtaaaagccctgaagactctccgtatctgtgggaaagaatgtccaagtatatagaaatgaacgccaagatatttgacgggttcagaattgacaactgccattctactccaatacatgttggcgaatatttcctagatttggcaagaaaatacaacccgaacctatatgtcgttgcagagctgttttctggttccgaaacactagattgtctgtttgttgaacggttgggtatctcctctttaatcagagaggcaatgcaagcctggtccgaagaagagttgtctagattagtccataagcatggcgggaggcccattggctcctataagtttgttcctatggatgacttctcatatcctgcggatattaatttaaacgaggagcattgtttcaacgactccaacgataactccataagatgtgtatcagagatcatgattccaaagattttaaccgccactccgccacacgctttattcatggactgtacccatgataatgaaactccctttgaaaaaagaacagtggaggatactttgcccaatgctgcattggtggctctttgctcgtccgccattggatctgtttatggctacgacgaaatttttccacatttactgaatttggtcactgaaaaaagacattatgacatttctacgcctactggtagcccctcgataggaataaccaaagtcaaggccactttgaattcgattagaacgagtataggagaaaaggcgtatgacattgaagactcagaaatgcatgtgcatcaccagggccagtacattacttttcatcgtatggatgttaaatccggaaaaggttggtacttgatagcaaggatgaaattttctgacaatgatgaccctaacgagactttaccaccagtggtgttaaaccaatccacctgttctctcaggttttcgtatgctttggaaagagttggcgatgaaattcccaacgacgataaattcattaaaggtattcccacgaaattaaaggagcttgaagggtttgacatttcttatgatgattctaagaagatttcaacgataaaactgcccaatgaattccctcaaggatctattgccatttttgagacccaacagaatggtgtggacgaatccttagatcattttataaggtcaggtgctttaaaggccacttcaagtttgactctagagtcaataaattccgtcttgtatcgtagtgagccggaagaatacgatgttagcgccggcgaaggtggtgcttatattattcctaattttggaaagcctgtgtattgtggtctgcaaggttgggtttccgtattaagaaaaattgtgttttacaatgatttagcacatcccctcagtgcaaatttaagaaatggacattgggctttagactacactatcagtagacttaattactatagcgatgaagcaggaatcaatgaagtgcagaactggctgcgttcaaggtttgatagagtgaaaaagttaccgagctacttagtgcccagttatttcgccttaattatcggcatcctctatggttgttgtcgcttaaaagcaatacagctaatgtcccgtaatattggtaaatctacattgtttgtacaaagcttatctatgacatcaatccagatggtttccagaatgaagtcaacctctattttaccaggcgaaaatgttccatctatggctgcagggttgccacactttagcgtaaactacatgagatgttgggggagagatgtattcatatcgctaagaggtatgctattaacaacaggtagatttgatgaagctaaagctcatatactagcctttgcaaagactttgaagcatggtttaattccaaacttgctggatgccggtagaaacccgagatataatgctcgtgatgctgcctggttcttcttgcaagctgtacaggattatgtttatattgttcctgatggcgaaaaaatattacaagagcaagtaacaaggagattcccactggatgatacttacattcctgtagatgatccaagggcatttagttactctagtaccttggaggagatcatttatgaaattttgagtaggcatgccaagggaattaaattcagagaggctaatgcaggtccaaatttagatcgtgttatgactgataaagggtttaatgttgaaattcatgtcgattggtcgactggcttaattcatggtggatctcagtataactgtggtacttggatggataagatgggtgaaagtgaaaaagcagggtctgttggtattcctggaacacccagagatggagccgcaatagaaatcaatgggcttttaaaaagtgctttaaggtttgttattgaactaaaaaacaagggattgtttaagttttccgatgtggagacgcaggacggcgggaggatcgatttcactgaatggaatcaattacttcaagacaatttcgaaaaaagatattatgttccggaggatccatcacaggatgcagattatgacgtgagcgctaaattgggtgttaatagacgggggatatacagagatttgtacaaatcaggaaagccttatgaagattatcagttaagaccaaattttgctattgccatgactgtggcaccagagttatttgtgcctgagcatgccataaaagcaatcaccattgcagatgaagtcttaagaggtccagtaggtatgcgtactttagacccaagcgattacaattaccgtccgtactacaacaacggagaagattcggatgattttgccacctcaaagggtagaaactatcaccaaggccctgagtgggtctggctttacggctactttttaagagcgttccatcatttccactttaaaaccagtccacgttgtcagaatgctgccaaagagaaaccatcctcttatttgtatcaacaattatactacagattaaaaggccatagaaaatggatttttgaaagtgtgtgggcaggattgacagagctaaccaataaagatggtgaagtatgcaatgactcaagccccacgcaagcctggagttctgcttgtttgttagatctattttatgatttatgggatgcctacgaagatgattcctgaaaatagctaaagcataaattaattgaacggtccctttttgccacccgctaatacttttatttctgttcaactatatatacatatatatatatttacatatttttacctccctatctctattgataataaaacaaataaaaatcgtatatttttgtatatgtattatcgttttgaggagcgagagcgaaaacgaaaataaaagaaataaagggaacacacgtgaaagtgaaggacagcaccaaccaagggggacaaaacgcgtcagagcaagaggtgaaagggttgccacgtacgtatttgaaccggagtgagccgtttgcgtgttacaatcaattcgatatctttgttgttttgtttaattcgctaagatctaagtttttaactaagtgagcagcggcagttacagaaagaggcgagaagtagaaacaagggtgtatagattttcgttacctcacatagatatagaacgaattcataggtaccaaatacattccacttacaccttccaggctcaagtcttgaaaagaaagcagaacatacagcccggttgaatagcatgagtcatggttgccgaagaggacatcgagaagcaagtccttcaattgatagacagcttttttctgaagactacactactaatatgctccaccgaatcaagtcgataccagtcttctacagaaaatatattcctatttgacgacacatggtttgaagatcactcagaattagtgagtgagctacccgagataatatcaaaatggtctcactacgatggtcgaaaagagttgccacccttagtggtagagacatatttggatttaagacagttaaactcgtctcatttagttagattaaaggaccacgaaggccatttgtggaacgtttgcaaaggaactaagaagcaggaaatcgtgatggaacgttggcttatcgaattagataattcatccccaactttcaaatcatacagtgaagatgagactgatgttaatgaactttctaaacagctagtccttctcttccgttatttgttgactttaatacagttactacccacaacagaattataccaattattaataaagtcttataacggcccgcaaaatgaaggaagttccaatccaataacttccacgggcccactagtaagtatccggacgtgtgtccttgacggatctaaaccaattttatcgaaggggagaatagggttgagcaaaccgattattaatacatattccaatgcgcttaacgaatcaaacctgccagcccatttagatcaaaagaagatcacacctgtatggacaaagtttggactcttaagagtctcggtatcatacagacgtgattggaagtttgaaattaacaatacaaacgacgaattattttcagctcgacatgcatctgtctcacataactcacaaggaccccagaatcagccagaacaagaaggacaaagtgatcaagacatagggaaacgccaaccacaatttcaacagcagcagcagccccaacagcagcagcagcagcagcaacagcaacagagacaacaccaggtccagacacaacaacaaagacagatacctgataggagatctctttcactttctccttgtacaagagccaattcttttgaaccacaatcttggcagaagaaagtctatccaatatcgagacctgttcaaccatttaaagttggttcaattggaagtcaaagtgcgagcagaaatccctctaattcatcgtttttcaaccaaccacctgttcataggccaagtatgagctccaactacgggccacaaatgaatattgaaggtaccagtgttggaagcacctcaaagtattcctcctcctttgggaacattcgtcgtcactcaagtgtaaagacgacagagaatgctgaaaaagtatcaaaagctgtaaagagcccactacaacctcaagaatcacaagaagatttaatggattttgttaaattactcgaagaaaaacccgatctaactataaagaagacaagtggaaataatccacccaatatcaatatttctgattctctaatcagatatcagaatttgaagccaagtaatgacttattaagtgaagatttatccgtaagtttatccatggatccaaatcatacatatcacagaggcagatcagattcccactcaccattgccttcaatatccccttcgatgcattatggatcgttgaactcgagaatgtctcaaggcgccaatgcaagccatttgattgcaagaggcggtgggaattcatctactagtgccttgaatagtagaaggaattctttagataagagctcaaacaagcagggtatgtcaggcttacctcctatttttggtggagagagtacttcatatcaccacgacaacaaaatacaaaagtacaaccaattaggagtagaagaagatgatgatgacgagaatgaccgtttgctcaaccaaatgggaaacagtgctacaaaattcaaaagttcaatatctccaagatcaattgatagcatttcaagttctttcataaaaagtaggatacctatcagacaaccataccattactctcaaccaactactgcgccctttcaagctcaggcgaaatttcataaacctgcaaataagttaatcgataatggtaataggagtaatagtaacaataacaatcataatgggaatgatgcagttggtgtgatgcataatgacgaggatgatcaagatgatgatctagtatttttcatgagtgatatgaacctttctaaagaaggttaaaaatggtaaagttttattttaaagggcacaactaaagaaaaataatcaaaaaaaaggtgaaatagatatgcaagaaaagaaaaaaaaatacaatactagtaaactgaaataaaaaagattagccataatggatttgtttctctttgttatcgatattcttacctcttgaagatccatgtgtctatcatttgaattgaatatataattatatacagtgagatataccaattgcagtaacaaaatggcaaatatgtatatcagtaatataattagcatataaaataaaaaaaaaaaatgcttatttgtcacccgctgactgcgtttccttttgaattataaaaggttccttatggttctggtccactagcgttttattttcttccttttcctgtaatatttttaactttagctcatgtactttgtgcttgtctatatgtttctcgtatttttcctttgtcttgaaagtcctagaacaattattgtaaaagcatctgtattttcttccaacggtattcaataaaaggtttagcccattttcaccagactcaagtcgcttttctaaatccacttcattctgtaaaaactctacattattgttttcggtaagttttctccttttcctcaacctattggaaatcttctcttcatcctgctcattcgagtgtttgctattccccagttgaactccgtggtcttggacaagttgttgaatatcagaaattttatattttagttccagtgggatatcttcttccgtatgaatagacccataatgcgtgagaagatcatgttttctagaaaaagacatatcaggacatatatgacacttccaatttttggttactagtgagtcgtcatgaataatcatgtgcatttgtaaaccattttcccccacacatggtttgctacaaataggacattttaatttaggatgatcattttttatatgcgattgcaattgtgaccatatccgaaactctttgcaacaaccagcaaaagtacattggtaaggattttctacctcaggatcgtgatgtttagaaatgtgatttcttagcctatatggcctctgaaagcttttattgcagtgtggacaggttagtttatgtaaatgaacagataaaatatgtgcccttaattgtggatgcttgtagaatcggaggttgcatccttcctctggacaaatgaaagatttggtatgcgttacttcgtgtcgcttcagttgctggcgagtcgtcactccttttccacaataagaacattggaatggtttcgtatcagaatgcgtatacaagtgtctctctaagtgactctttttaacgaaggattttgcacacttatcacactgaaatgctcttaaaccctgatgtacgcttaattggtgttcagtcaaaattgaaggtcttgtaaatgccttatcacagccatcatagtcacagaaatatgtctttggcctattgctcgatgagcttctagttgatgttaaactgttcaatgattctgaactctctgatcgtgatatgggaatggtctcctgtttaagttcggccagtggcattccttcattatttagaacctctcctcccatttgacagcgatttcaacagttactactgtgcttaatgcccttatttgatagttagttcttcttataataaataatcattgtatattgattattcgtatagtatgatatttaattgaaaaaaaaatttttttttttttaagaatatcattcaaaggcatcaatcacaaccttgaagaaaggctaaaaagacacattttgcaggtaacagtgtaaagattaaggctacaagtgatcatgtcagactacgaggaggcgtatgtgcattcatattggagaaattgcgtgctttagttttaattatatttactaacttctatcattgtgatacaggtttaacgacggtaatgagaacttcgaagattttgatgtagagcatttttctgatgaggagacttatgaggaaaaacctcaattcaaggatggtgaaacaaccgatgccaacggtaagaccatcgttactggtggtaatggcccagaagattttcaacagcatgagcaaataagaagaaagacacttaaggaaaaggccatcccaaaagaccaaagagcaactactccatacatgaccaaatatgaaagggcaagaattttaggtacaagagccctacaaatttccatgaatgcgccagtttttgtagatttagaaggtgaaactgatccattgcgtattgccatgaaggagttggctgaaaagaaaattcctttggttattagaagatatttaccagatggttcctttgaggactggagtgtggaggaactcattgtggatttgtgattacacctgcattttcctttatgtgtatttgctttgtttgtatattattataactataaagaacgatttattttgtaatgcaaataactggacgagagaaccacgctataacctatttggtaataaaaatgtttgtatgaataaaaaagctgctgactgctttctttgatatgtgtatatagaatatttaatcggtgattgaatctaagaaaagcttacctctgaaagttctctcttcggtcgcttgctgatttgtagtaaacaatttgaaaagtttagcaaattcttcctcaggattttcaaaaccggcttcctttaaagaatcaatgacctcattcaagggaacgtttaaatcgtgtcctcttccaatggcttttaaactttcttccaattcttcacgctcgggaaactgcgataagttcttccccatgatagataagaatatgggaaagcttacaccttcttctccaacttccgcggtactggtgtcattgtcaggtaccattttggaccattcctcatctgtcaatgtcttccccaatgttgcatatatcttggtaagatctcccctactaatcagaccatcctcatcctcatccagcatttggaaagcatctttgagtttatttatgtagtcctgcgtaagttggttaaacgttagcgattcactatggtccatatctacttcaagtttgctcaataaacgattcgaaattactcttttcttagctgtgcattgtatagtttagaaatacgagaaatgtaaaaaaaaaaataaagttggaaaacaactaactaataaaactttcttgtcaagaaagacactaagaacacagaaaagaaacacgaagagcagaggaaatatgtcggatattaaacagctattgaaggaagccaaacaagaattgacaaatcgtgactatgaagagaccatcgaaatatcggaaaaggttcttaaactagatcccgataattatttcgcacatatttttctagggaaagcactttcgagtcttccagctagtaataatgtcagttcaaatcggaacctggagagagctactaatcattacgtgtccgctgccaaattagttcctgataaccttttagcgtggaaaggactttttctcttatttagaaccactgaggttgtcccagacatactttcgtatgatgaatattttgacctgtgtggccaatatgcagacgcacttttaaagcaggaacagtctcaagtagaactaataaatgacataaaattactaaagaaaacgcatccagattgtcaaaaagccttttatcagcatttgaaacctgggtcgctaatggcggaaactattggtcgtcatctatctacaccccaggacgctttattaaatcttataaagatactgtctaatattgaaacaacggaaataggtaagacccttagtcagaacaggttaaaactaaaagctagtgatcctgattatcaaattaaactaaattcattctcctgggaaataattaaaaattcagaaattgatcagttatacaaccagttggtaaatattctcgctgacgatcaaaagagaagtgaaattgagaaccagtggttagaatatagaatcaaagtgctaaaatcaatgccgctggatgtaaaaaaagattttttcacgaaagttaaggaaatggtcgaggatatggttcttgtgaatcatcaatctttgcttgcatggcaaaagtatttcgaatggacagattacgaagatctggacaacatggatgccccattgataataaagtactttaagaaatttcctaaagatccattggccatgatcctctattcctggctttcctcaaaactatcgaaatatgatattaaaagtttggaatcggctaataaaccacctgaaggccataaaaagacggagaaggaaacagatattaaggatgtagatgagacaaatgaagatgaagttaaagatcgcgttgaagatgaagttaaagatcgtgttgaagatgaagtcaaagatcaagatgaggaggcaaaggaagatgaagaagaagaccttgatgatatagaaattggtttattagaggaagaggttgtcactgtattgacggagaatatcgtaaaatgtaaaaataatatcttagcgcatcgcattctttgtcaatattacctactgaccaaggagtatgaggcagctttaccatacatcaaaaatggtatttctttaattgcctataatataaaggacctgggggtacatttgccattaacaaaaagagaattttctctggatttggctaccgtttatacatatgtcgatgccccaaaggaccacaatgctgcattaaagttatatgataacattttatccggtgattttagtaatatacaagcaaaaatgggcaaaggtataatttttattgaaaggaaaaattggaaggatgctatgacattactaacacaggtgcatgaacaatcgcctaataatctggaagttttatctgaactgtcatggagtaaagcccatatgggttatatggacgaggcattagctggcttagatactgtcatcaagggtatcaaaggtatggatttacgttcgatagatttcagagcattaaacttatggaggcaagccaaagtttacattatgaagcatgcttccattaacgatgctaaacaggaaaacgtcaagtgcgcattcaaattactcattcagagtattaaaatattggacacttttgctcccggattttcgacactgggcgatatttattgccactattataaagaccatttgagggccttcaaatgttatttcaaagctttcgatctggatgcgggggattacacagcagcgaagtatattaccgaaacttatgcaagcaagcccaattggcaagctgcttcttccatcgcttcaagattaattaaaggtgaaaaagcaaaggcagaactgcgctcaaataactggccctttagggtcgtagggattgctcatttggaaaagcaagaagaaagtgattctattgagtggtttcaatctgctttacgtgttgatccaaatgatgtagagtcatgggtgggcctgggacaagcataccacgcgtgtggtcgtatagaagcatctatcaaagtttttgacaaggcaattcaattaaggccctctcatacttttgcccaatactttaaagctatttctctatgtgacgtaggtgaatatcttgaaagtttagacattctggaaaaggtatgtcaagaagccgctacagaagagtcattccaaattggtttagtggaagtgcttatgagatgttccttggatttatattcgcaagggttcttgctcaaatcagtttcaattgcaaaggacactattgaacggatcaagataattatcagtgaattaaaatgtgagaaccaacaggtttggatctacctttcacaagtactgagattatttatttggatagagtcaaaggttgatactttacctgttgaatcactagtatcaatttttgaaaattctcaattttctggtagtgaagaaattgattctgtcgacaatatcaaaatcgatactttactcgatagcactactgatgataatgtgtccattgcgtgcaagtttttgatcttagcttcaaaatatagtgtttcggatcaaaaatttacagatatagcaggaacggtcagggcctcatactggtataatataggtatctcagagcttactgctttcataacattgaaagaaccgcagtatagagatgctgctatttttgcttttaagaaatccattcaattacagtctaatacaagtgaaacttggattggtctagggatagccactatggacatcaactttcgtgtctctcaacattgctttattaaagcaactgctttggaaccgaaggcgacaaatacatggttcaacttggctatgctaggtttaaagaaaaaggatactgaatttgctcaacaggttctgaataaattacaaagccttgccccacaagattcgtcaccttggctaggtatggccttgattcttgaggaacaaggagacattatcggaagttctaaactttttgcacactccttcatattatctaatggaaggtcaaaggctgcgcaatttatgtatgctaaaaatgtccttgagaatcacattaataatggtgacgatgaaagagatattgagacagtggaaaaactaaccactgcttcaatagctttagagcagtttttcaaaaaaagtcctgatagtcaatttgctcttcaatgtgctcttctaactcttgaaaggttacatcactatgaaaatgcaaacgaactggctaatcggttgataggcattttggaaaaaaagtttgagaaaactcaagatgaaagagaactgtttaattttgcgataattaaaggacaattcgctcgtattcacttaggtttaggaaatttcgaactctctattgaaaacgctgatctttctcaaggtattatatctgaatcgagcgacgaaaaatcaatgaaaaccaaaatatccaatcacatttgcttaggattaagttatttcttcttaaacgactttgatcagactttgaaccaattccaagaactgctaagcatttcaaaggattctaagcacctagttgttttaattgcgaaggtgctttatgatgtaggtgaatctgacacaaaggaaattgctttacaggaactaacagaatatatagccacaagcggcgcagacttgttagtaacactaacgattgcagctatgtcaattctagacgataagcgtgaagatttaagcattattttagaagaattgaaagctttgccattatccaaacaaataatagataagcacaaagacgcaccatatctgatagaagaaattactaagagactttatcgtaacgataccggtaaacaagtatggcaaaggagtgcgtactttttccctaataacctcaaggtttgggagagattagataagaatattcaacgaagaatagcttctaatggacaaaataaagttactgcggaggagatgagtaaactatattgtgagagtaagaatttgagaagcatacaaagaggtatgtttttgtgcccttggaacgttactgcagtgaaggcgctaaacgaatgtttctaaaaatttggattcgagatagtcaatcaaaccttaatgtaacattagtaataaattttatcttttctatagagtataaaaggttattagacagagtttatcagctgtatagagtaatcatgccatttggaaaacttcccaaagcgatagcaacctcgataaacgagcgaaaacatttagctctctttcattgaccatctttaattgattcaattcgcttggtaatagtagttcgttctctcttcctttaacatcatctctatttgccttttttaataatgtagagttttcttgctttaatttctcctttttaaaaagtaaatttgccatattccattccaagttttgtctcatgaaattataggaatgcgtttctttgcatctaaacaaaaaaactgcccttgatgctgatctatcggctgttcttggaacttcctggatttccacagaattgtatctaattaaagatgctaatgtagatcttatatccttttccttcattaacgcagttgagttgataattttctcagacaccagcttgttatcacgaatacaacggcttaaacgcattgctgagggtcccaacgtagacgcgataacatactcataaacagatgactttaatactggcattagtttgctatatggaacatagtaaacacctggtttggtttcgttcaaaaaggggaaatttgatgatgctaggatttttaaatgactatttatcaaagaagctgagtgaggatcctcagtgtctgcatccaaatcctcctcctcttcgtcttcttcttgtgtatctccactttcttgaagagatttggaaacagcagcaggtagcgccgggatcacaaatccatcttcggtttttaattttttactgggtaatgatgcagcagcgtttgagccagaacgctttttattgtcagagggctttctagataataagcttccacgcaagtccaattctgcggggagatgtcttgccaagtcaatagcattaaaggtaagccctggtgtcttctcctcaacaagttcggcttcgtcttgaaacgattttgcttcctccaaatcttgtaaaagcccagtttgagttagtggatctctaattttaggagacttttgctctgtgagtcttaatgcaattttgtaaacttgagctgtgacggagccgactcttgtcttggccaagttaatcaattgtttagatcttctacctttcataaatctatccaaattaatcgtcagagagactgtaggtttaacaatcctcaatgaggtctttggatcaaccgttaagatttgtgaaagctcatttggtttatttatgattttggcaaaatcagttttcgcattcatcttggcttgggatcttttcttcaaatcggacaacggggagtttctgggaatatttttgtaatgtttttcatataaaaattgccagagatcttcgattggggtataatgcaattttgatatttgaataagatatcccatttcacacagttgcacgaatagtgatgaaatggtgtacttcatggaatctgacgtgacactacttagataatcttccactgttaaggaccctaatgatataacgttttgtacaatttcagccaccagctgtttatgctcctcttcgtcgtttacacgcatttgcgtaataatttcgtcaataatcaaccctgagtagagtaaaatgtgtatcccttcctcgttatagtaataataagtcgtttttttcccggatattgctgtttcttgcaggtacttaacacaccttaattgagttaatgagactagtgtcgtcttgacgctgtctacatccataccatctattttctccactaactcgcgcacactcaatctgcccagcgcaaccaacatcccaattacagaagctgctctttcacccagatgtgccttcaccaactctttgtaaagaaacaaatcgggattcaaggttctctgttccaaggatgatatggtcataacatcttcgggggtgaccaacttctcagattcgacagtgctctcacctgtttggttctctgcactaagcgcttctcccagtaactcgtccatttggatcttgctcaacaaaaatttttccctattcctgtgtcagcaattctctattgttctcaatatttcttccactattattattttgatccaaaattatttttttccttcaatgcgatgagcttttgaaaaatttctgatcattcccaacgaaccaatagaaggcccgccccgtcttatatccgttagcctaccaaatatatatataaagaacaagggcctttcctcagagcgtttgctgacgaagttttagaagttaataaggtttttaacagcagtgtgctcgaacgattaggacgggagagttaaaattattaaaaggaaaaaagaagaacgttgatgttgtcagcagctagattgcaatttgcccaggggtcagttagaaggttgaccgtttccgctagagacgcacctactaaaatatctacattggctgttaaggtccatggagggtctcgttatgcaaccaaggatggtgtggcccatcttttaaacagattcaactttcaaaacacgaacactagatcagctttgaaattagtcagagaatccgaattattagggggaacttttaagtctaccttggatagggaatacatcactttgaaagctacctttttgaaggacgaccttccctactacgtcaatgccctagcagacgtgctatacaagactgccttcaaacctcacgagctcaccgaatctgttttgcctgctgctagatacgattatgcggtcgctgaacaatgtccggtaaagagcgccgaagaccaattgtatgccattacattcagaaagggtttaggaaacccattgttatacgatggtgtggaaagagtcagtttgcaagatatcaaggactttgcggacaaagtctataccaaggagaaccttgaagttagcggtgaaaatgttgttgaggccgatttgaaaagatttgttgacgagtcactgttaagcactttgcctgcaggtaagtcattggtgagtaaatccgaaccaaaattctttttgggtgaagaaaacagggtaaggtttatcggtgactccgttgccgccattggtatcccggtaaacaaagcctccctagctcaatatgaagtattggccaactatttgacctctgccctatccgagctttccggtttaatcagctcggctaaacttgataaattcactgacggcggcctatttactctgtttgtaagagaccaggacagcgccgtggtatcttccaacatcaagaaaattgttgcggatttgaagaagggcaaggacttatcccctgcaataaattacacaaagttaaagaatgccgtccaaaatgaatctgtttccagcccaattgaactaaattttgacgccgtgaaggactttaagttgggaaaattcaactatgtagccgtcggtgatgtttccaacttgccatatttggacgaattgtaagaggaaagtatttgtacaaaacgaaaaactaaaggcaaatatatatatagatgttgccgcgcaccttttttttaatgaatattcacacaaatattgaaaataaaaacaaacaaaattcaaataacaacatgtaagaccaaaaaaaaatccctcattatttattccttaccctttccaaattcttactatactagtaaatatatatttaattatccttttttctacttcagcatacaatccttcttttgccgcaggtttatagttagacccctcaattctgtcaagtttcagtggtacgttattttatgtctcatctcacgatcctggcaaaaaaagaaaggcatgtaatttgaggaggcgattcaccctcatttttacgcaacaacaatgctgtgtggcttacacgcctctgcgtacatatctacatatttaacggtcctgtattttcaagcacgcaaggctgaaataaacggttgtttgcttatgcgcgatgcactccgccgaacatcaccgcaaaagcaccgtaggcggagatctcccagctagtatgggcatgacggaaccacgatttccagatatagatacttaaaagcactaaaaggtctatacataaaacgcagacttacgtaagatacatagcaactgccgatatggacgccgccatgccgaatgacaaagggagaatgtagtactaattgatatcgtcttatcctctcaggaatgcaaacttaaaacatactttctcccgtcctaacaacgccggttgtcgacgataaataccccaagaaatgcccgcacagaatctcctccgttaggtggtcatgccccgagggtgcgaggttgtttcctgcacggtaaatcgggatgccatgaaagccggccctccccacgcgtcccctaatttttttccaagtgaatatctgcatcggccaccgttttatattacttcgataagcttgccttaaactcattattgccgtcgtttatccctcaaagcttaatcttacaagaattagaaagaagaaaagtttattcgtatagacttccttatgcctgatgtccttccaccctcttacacagtaggattagtctagaagtggtaaattgcaggatagcatatacgcgacaaggaaaagaaagaaggaaaaatattttacgtcggaaattgtgtgatatgccgtttgaattcgaggtatattaagcgcagtgcttttccctgcatcgcattctgtctgttcttccgagtgtcgattcccacaattcgtcttgtccttttgatattttgttttttttttccttctctttttttattctttgtatttggtgctgtctgtcaatacggcacataaagtaacatgtaattaactataacatgtcttcgaacgattcgaacgataccgacaagcaacatacacgtctggatcctaccggtgtggacgacgcctacatccctccggagcagccggaaacaaagcaccatcgctttaaaatctctagggacaccctgagagaccactttatcgctgcggtcggtgagttctgcggcacattcatgtttttatggtgcgcttacgttatctgcaatgtcgctaaccatgatgtcgcactcgttgcagcgcctgacggttcccatccgggtcaattgattatgattgccatcggtttcggattttccgtcatgttttctatctggtgttttgccggtgtctctggtggggctttgaatcctgctatgtcgctttcgctgtgcttggcgagagccgtctctcctacaagatgtgtcgttatgtgggtttcgcagattgttgctggaatggccgctggaggcgctgcaagcgccatgacacctggtgaagtcctctttgccaattctttgggcctgggctgctctaggacgaggggtctgttcctggagatgttcggcaccgctatcctatgtttaacagtcttaatgacggctgtggagaagcgtgaaaccaactttatggctgcgctgcccatcggcatctccctgtttatcgcacacgtcgctttgactgcatacacaggcacaggtgtcaaccctgcgaggtccttgggtgctgctgtcgcagccagatacttccctcattaccactggatttattggattggcacgctgttaggatccattttagcatggtctgtatggcaattattgcaaatcttagactacacaacctacgttaccgctgaaaaggctgccagcaccaaggaaaaagctcaaaaaaaaggtgaaaccagcagttcctctgctgtggctgaagtctaatttttccctccttttctttatttctcgctcactagcacttaatgttataatactcggcaaaaactagtaagattaattgtttttaatttttttttttctatacatccatactactgaggtaattagtgtttttaatatcccttcctcttgtataatatttttggggctttatagccgaccttgacgtatagcagctgagctctatggtttgactcatccgtacaccaatacacgcttggtgtgcccagtttatcagcttcgtcgtagacaaattggattagtttgccgcccgcgcctttgaccctagaattctcatcaacatagagatcgttgatgtatatcttgtccttgaaatcccaagtagtcatatggttgaaaaagtttatcattccaataattttttcgctcgaactttccacagctacggctgcccacattttaatgttaggatctaggaatctgccgaaattgaaatcgtccaagtcatcgggaaaagagacttcataaaaatcttgataggatttccaaagcctttgccaaccctccttatcgttttcggttacaaaccttacggtaatgttatcttcgctagtgttggacatgctacacagaaagggctgtttgctttcttggcatataaaatactaagagcaatacttagccctttttgctctatttatagcgttccctctcttaatgattgccgctcccctaatataattggtagttcttgccacccgttagttccgtccataaaaatgttcaaccaataaaagcaaatcaagaagtgactgagaagtacaatgaactatgacgttaaaaggctaacccaatgcagaaattaaatagaaataaatacattgtgtagtcggcctgtaacttgtatttcgcaaacgtcttataaaggcaagaaaatttcaaatgttcgaaatctgacatcagccgcatgctatgttgtcaatctctctcaatactcggctggcttaaccctgaatcatcccaaaaaacggtgatactgtatttgaatatgcttcaaccggagtaattatccagtagtgcaacgcatctcattccaacttgaaatatacgtttacaaaactatttaccacttgtatttctgcaataataccaaaattcatgcaaaataaacaccatcattacttgtagttggaagcaaaaaatattcttgattgattttcaattgccaggctccttatcacttcgtcgatgagccaaaaaaaaatgtagttcctattctggtatcaaagcatttttctttattgataacatccgcatacacagagaaaaggcgagaagcatgaaaagtgtcaaaaatattgaactagagtgtactgttatagttttggcaggtatgaagacaaaatgatggctttttacatatcaaagtaactctgtactatagatagaagaataaaaactaaatacatgcaggtgactgatagaaaagacaagtgcaggggagaaaaaaaaataaagaaatgatagcgttctaagaaaagttctagtcatggatagtgtcctggagcatagccgaaatagccatttgctgtatcagttatgttctttagaggatagccaacgccatcggcaccagcatacggaactgtattgccccaccaattaaaagctgtgtctttatattggacagcaaagaaaatgataatagctgataaaaccaagcccgttgaaaagcctgccgataaaacataattatatttctcccacagatttaaatggtgtcttttcatgtagtactgggaaatgtaactaacaatcataccagaagtgtaatacatcaggttatatggagggctcatattaagcattccacctacaaataacattgggtcaaaatatctgggataaaacttaccccagcgcttccaaacaccaaaaaatatgccaatgcatgcgcctatcaaccaacaccatttaaatattggataaatgtaattgaaaattctttttggcccaattgcaccccagacaacggaagcattatagtaggtcacagcatcaggacaggtgaattttgcgttttgatgaggtgtgcaaaagtctttgatattggagatttgccaattcagaacacctagattgacaaatatctgaatgaaaactataacacattgtcccctgaatagcgccattggcggaatcttacaataatgcgctatttttaagttagaaacgtaattatctgcttggccgtcgatgttataaccaaaagccttcaaaatcattatggcgattggattacctggtaaagcgtaccccatcaccatttcaattagtagattcaaaccaaacgaataaccagtggttgcttgaaggatagtagttggaatcaagaaaacaaaattaaatcctaaacaaacaaaaagaccccaaactggtgtatttgttgggtagtgctctacaacagctattccaacaacaagtgaacctatcaatatggcaaaataccaccaatctggaacttctttatagtttttcatggcattagaatgtgggtcatcataatcgtcgagcgccctgtaatcgcttttgaacattgtgacccaagatttaagttttctcatggcccacaaattcaaagcccaatctttgaaagcattgaacaataactttgagtgtacaataaacgaccatgtaatcatcagaggatatgcgcaaatgaaagcaccatatgataccaaatttccagcactatagtatggtggcgagtagctttgatattttttcacatctagcttattgtcactgtctaatacctcagtaactttaaaggaatggccagtattagtatacaaagaatttgtgaatattggcaggtattggcaactcatataattactatagtatactgcaataacaattaaagctgctaatatgcaaccaagatattgtgttaagtatgaccaaaatgggtaaactaaaggagaattaaacgaaataacattccagtcaaaagatgagataggattaatcccaagaccagtgactcctcccgtgatgtttgcgagattaatgttacttggcttgatccaggtcatccaattgaaagtgtttagaatattaataatgtaagtgggaaaccagttatagatgaacatgataaaaaaagtcaagaaaaagaatttatacctgctcattccagattcatgcttttctttacccaatagtgccttgttgatagcaatagttggcatgactgttggccatagtgcacgggctggataaacaacgaattttctaaggatgccagcaaatccaaatccaataaattgtacggataacgaaagtaaaaattggtagccaaacgagaaagcagaatggtaaaagagtttttgcgttagaatattgtaatgagtatagaacgcgccttgacaaattgcatataacaaggttgaaaacatttgctctttttgggtccatggtttatcgatattgataccatactttctgcccctgatggttatagtccaacaggggatagttttagcccaagccttaccacagatatataaaaacatttggataattggagtattcagtgaaattgaaaccaccctgtgtgaaaaaaactcattaaatcctgaaccgatgacagaccaaattattgccagaaaatatgctcggaatgtctccactggaatggtgggatcatcttctggatcaacaacagctctaacctcttggtaaggcgaatgaaatttaatagcagaagcaaatgctctaatgtcaaagctatcatattcatctatcccctcttttgaatccaagtcctccaagtcaaccaatctcttccactcctcatattgatcgtgtggaatgttctcatcatccttgaaatagatgatagagtcttttagtattttgaaggaatcctcaagtgtcaattcaggcatttttttgaggatatacgcaacgtcttccggaatatcataaagagtgcgattttcataacccagcttcttcataaagtgcagtatctgttcatccgtataccactgagaaaagtctgatgaatgatttgaaagcctctcagaatactcagcaccctcggcgtaatcaacagtaccttttgtggataccttctcatcaattataactttatctttgactgtttcactcataatttctaataattcaacagcaatattgcgtataacaaaccctactagttgtagaataagctaatatgttcgtttctgctattaaaaaaatgccgccgttgtttagacgttcaatgtatgattgtaagtgtttcaaatattattttttgggatgtttcgataggaatgaatataagtaacaactgacttgagacatgacttaagtttacacaggatagtgttccattcccatttataaatttttttgaagcgagaagaaacctagcaagttgatatcaatattttttttaatgttacttatcttcattgctaataattcgtgaaatgattgaaaatttccaatccatgaacattcagaagtaagataacagcgtccaattgtaaaagaacgctattattattgtagataagagaataaacttaaataatcgaaggtgttacgaatcttcataaaacccaatgggctgatattgacaaccgcaatggcgattcacgtgttcggtaaccacaacaggggccaagaggaaaacaaactacatcaatttttgcaaaaggttaacaacgaaatgtgggattattgaaaattataacgaagaaactacgtcggacagcaaccccccgatttttgtcggttgcttttactgacaccatgatgtgaaccaaattttcttttggtattcctcgcatagtgttgacttcttttaccatgataaaaataatgagataagaagtgttgcagtaatattatgtgtcacaccagcgtggctgccatatttgagacggattcgtccggtggatgtgatggatccgtttaatgctgatctctcctgcattttttgtgaaaaatcagatatcaattattggtctatctgcttttgcctgtttgtttttttttcattatagagttcctcagtgagtgggattgatgatgcgcacggcacaattgaagcatttgcttatcaaaacataaatatctccgtacccaaataggaaaaacgcgttaatgcaaagttgacacgttcagttactatttcctgaaataataatacagcccacaaaaacccaccaatgacgcttttgttgctgaatcagacgttaagtgctgctgcctcctctgttctgcgccgccggttgtctcattaccttttctgcctatgatgattgtattgcaaggcccgagtggttgcgtatgccacgtacgaaaagttgttaccgtgccgtcacatcccctgcaaagaatgtggtacggcacactcctgctagcttgaggccctattccaatggcaattgagatgctgctttctcctcttacaatgtatgttgatgcttccactaaaagagggatgagagaattcatttgactgtgcagtcaaatctgtgatctttctattcttgcttatctatattctgccctatttatttttagtaaagtttcgtatttacatttttcatcatagatcgcaccagcgcgtggggctctttcattatcatctcaactaaatgacatacattgcaaatacgtgaaatgagctgactcaaaaagaaatattctgaactgtgaataccaaacaaacttaaaatagctgaaattcacgtgttgaattaccgcatcggttaaggaaagggaaagtttcttctctaaataaggaggagcctttgcacatatgtagattatgtaaatactatactctttttttgcttttagtacttggtatcctactaaatctttattttctttcgttagtgaaaaatatgaattgaaggatcagttccttcaaaaaggtaagaaaagaaatggaccattcgattaatgctggcaccaacattccacagcacggaatacaatttttggtgtcctttacttcaagatttgttactacgtgcggcttagaataacttcattatttatctaaacgacccataattttcgatgctaaagtctaaagttgagcaggtaagtttattaaaaacgtctttttcattactgctctagcgggtaaaagtcaatgacagcagacgcggcaagttgtgacgcctcatcggatccaagaaacatttatttttgcgtgcacgagtaatctagcgaaacaatttccaaaaaataagtgaaagaatatctactaatgcttaggattaccaaattcaaaaataacccttttaaagtataaactttgcatttcagagattctctggcatggcaaatattacgaataaggaaagcaaggtaagatatattagaaggaccaaattgttaaagagacatctaacaggtgagtttgaaaagtaatatatggaaaggatggtaatacagatttagcgcaaataatagttgtattatcaaatgaaatgtgaacttttttatatgaaagtccatagggtagactactgtcgccataatttcgtagaagaagagaaattcatgataggcgtcagcattattacaggcgcgggtcttaaatttatggaactataattgttgtaattaagatgaggccaagattaggtgggtaatatgtttcatgctttttactactactgcaagatttttttttccacaaagtttatttgttggcatttctagttacgaaactctcgttgctaacatcatgttagtctgacaagttacatattcgtttcgacgtcgccattctacgcacttaggccaaataacacatctcttttacatttgaaattgctaccatttattcctgttcgatcttaagattgactaaaccataatccgagcctaatattcacgtttaggcggggggtactaaatcacaaaaaacaagtggcgagcgaagaccttttcaattctaataactcagttacaccctcaacttgtaatcaatgtacaaaacacagtaaaatcgaagataagagatgtaaaaccatagagacaatttgaaaacctataaacacacgttttatactttatcgttattacgaaaaatcaatttttgctcgaccaaaagcagccttcggactgatatatctaggtccgttagtttagtagctgttgaggtcattgtaacctcatgtacacccttaggatcttgaagttgctgctctttacttcagagcatctctcatttcgatgacttcgcatttttttgaatactgccttcccactcccatcttttacagcttcctaacgatactacgatactacgatgctacatattacagagatacaaaataataactcttataagaaagaaaaataatatgtattgtacaaattacactattaacgaacaagaaatgggctctagtggaagagttaaatcacagagaaggggttaaatatctctttgagtaaaaagtttaaagagcaaagattatttgttttgtaagaaccattgcagataacttttcctgtttcttacctccgaacaaatccatgtcgcccatatcaccaaactttgaaccatgaccatgttggaggtacgcaattatctgtatcattatagatcaatttagtgctcggaagtcaagtgcacaatgaaagtcatgcaaaaagtttgtggcttagcatctcgtgaggatatggaagactatatggaaggctgctctgtttagtcacatgattctttcccaactctttcgccagcttgcgtgttcttttttactctagcaaaaaaatcgagccggagttaatgaccggaaatacacggatttcatattaaagttttttgagcaacacgtaaggtaaaagtcacaatcatgttcacctaagtgatatcgtacgatagttgcgtatctgtgctaatactcgccgaaacgtaatcctttaaaagtaccttcgtatcattgcatcattagagacgcctaataggaatgttataggtgtatccaaatctcaccttgaatgtgcttggcataagtatacaactgtagcataaagaaccctcgttttactttctccggcttatgcaaagtataagttaatccctgcctagtttttttctcaccgtttttcgtagtttaaatctgcaatgcagatttaaagtttttcttttctctagcagcactcgtggaagtaaaagattttttctttcaaattgcctacaccgaaggatgtgaacgattgccttcttgaactcaaactatggaagtcttcgtatgattttagatgatttgttttggctaatatcaaagtatccacgtatatccccatgacaccgcgatacatacttgcgatgcggcaattaaaagtcgtcattgtattgttcacacttaaaaggttcaaacctgcaatatcgtccggatgactgcttgcgttactatatattttttgctgtaattcaggccactccgggtttaatcatccgttcctgtatattaatactatatacggaaagcagagacagagcttcgagaagttttatatcctgtggaaaaaaactaacaatcaaaatttctgccttgaaggaatatgagtattgtaagacagtcatgtgattgctgtcgcgttcgtcgagtgaagtgtgataggaatagaccgtgtgatcgttgccgtcagcgcaatttgagatgcacttatttacaaccgttaaggaaacgaggtcccaagtccatcggagaaagcaaccttgaaagagcagctgaaatacagatggtgactgtaaacaataacatcatggcggccccagtaatgtataaaaaggttccaaagaaggtgattgatcaatgtttgagactatatcacgatcaactatacgtgatttggccaatgctcagttacgatgatctttacaagcttttggaggaaaattatgaggactgcagcacttattggtttttagtgtctctatctgcagcaactcttagtgatctgcatacaaaaatagaatacaagaagggatttttttttgctggagaacaattgtgtaatctttgtatgtcatcgcgacggtttttcgacgatctcagtaatagtgatatatttcgaattatgacatattattgtttgcatcgttgttatgcacagtttgctgatacaagaacctcatacagactttcttgtgaggctattggcctcataaaaatagctggatttcatcgggaagaaacttatgagtttcttccatttggtgagcaacaacttataagaaaggtttactatctgcttctcatgacagagaggtactatgccgtatacattaaatgtgtaacaagtttggataccactatatctccaccacaacccgaaatcgtaactgattcccgactttctttggatagttttcttgaggtgattaaagtattcactgttcctgggaaatacttttacgatgccttagctaccaacagtgttaatggttcctatactgaagactctctaaaaaggatatggaatgaacttcacataagctcacttgatatagagccatactcttacggatacatagactatctcttttctcggcactgggtcaggactctagcatggaagttggtactaaataagaaggatatgcggatgaattttttttcgaatactaacgccacacacattccagtcgaaatagccaaggatatgttacaggatacacttttaactccaatcgacctatatgatgtgcatggtcctgtgataccaatgaaggcgctagaaatagccaatgcattggtagacgtcgtaagtaagtatgatcacaatatgaagttggaggcttggaatattttgtgcgatgtatctaagttcgttttctccctgaaacattgcaatcataaaatgtttcaaaggttttcaactaaatgtcagagtgctctaatcgatttgcctatctctagaccactgcgcctaaatgatgattccaaggatgaagtcgacattattccctaaatgaactttatcttcttacagtttcaacatcttgtgacctgatgattttcctcaaatgaacttttgcgttttcattgagaaaatttcattatactttattttttttataaatgggtaccaaggcattaaatatagatctggtttactaatctgaagaaattgttttcaaccacataatttgtgcaatttggcgctatacaaagcccatgttggctacattagtctttgaatcctttagattgcctgaatcaatagctcattcaaaatattttggacaatcgatagttaactgtaacatgtgctgctatatagtggcaatctagatgcatgtatcttatatgattaagtataaaagaaccacagcaaagctaaacgtaaataagtagtttagaaagtactggatatgagttaagaatctgttaattgagcatgacatgaaaattttgtattaaagcaatatgagtcgtcacattaaatatatgaaactacgggaattaccatcatattggtcatgattaataataaaccaatcagcatgtttttacctctattatattagtcttggacccgtattcaaccttcattaatattatctttttacctttgttcataaacacaatacattgtttttgcaaaatataacaaaaaagattaaggaagaggaccatgtacactacgatcttacttttgaaatagaatttgtttattttttcaagatgttaaacgaagatggtgagtaatattcacaaaacattgtaaaaatattacttgcttcattctgcgaattgttcaaacccgtaaagaaaatttctagtatatgatatatgcataatatcaatagctttacaaaaatagaatccgaaaactatctagaagtttactcgtttctcaagttttatttaacaaaacatagacgagctttatttcgtgtgaagaagtgaagaagctttaacaaaactgtatttctaaaagaacgttactatacaataaattataaaactgcattaaccaatgaaaaaaagcactattaatcgaaactcgaatatgcaatattgttaatgtaaattaagctatcggtccgtttatttttctatcgaaaagcggcttagttagaatggttgataaacggctgcgcttcgtaaaaagaaatgacatcttggaactactttaaatagaagtttaaatctcatgatcatgctcatctgtttgtacaacacataagcttcaccgtcagacatatatgcaatgaagagtactttgagtttaactttatgtgttatatcgcttctattaaccctttttctggcggccttggatattgttatagtggttactttatatgatacaattggcattaagttccatgacttcggcaatattggttggttagttactggatatgctctttctaatgctgttttcatgttattatggggtcgcttggccgaaatacttggtacaaaggagtgcttaatgatttctgttattgtatttgaaatagggtctttgatttctgctctttcgaattcaatggcgactctgattagcggaagagtcgttgctgggtttggaggaagtggaattgaatcacttgcttttgtagttggaacatccattgtccgagaaaaccatagaggaattatgataacggcactcgctatatcgtatgtcattgcagagggagtcgggccttttattggtggtgcatttaatgaacatttgtcttggagatggtgcttttatataaatcttccaatcggtgcgtttgcgttcataatattggcattttgtaacacatctggagaaccacatcaaaaaatgtggctaccatcaaaaatcaaaaaaattatgaactatgactatggcgaattattgaaagcaagtttttggaagaatacatttgaagtacttgtatttaaactagacatggttgggattattttatcttcagcaggctttacactactgatgttaggtctttcatttggtggaaacaacttcccatggaattcgggtatcattatttgcttttttaccgtgggccctatcttattgttactattttgtgcttacgactttcattttctgtcattatcggggcttcactatgacaacaagcggatcaaaccgttactgacatggaatattgcctcaaattgtggcatatttacaagctccataacaggattcctttcttgctttgcttatgaattacagtctgcttatttagtccagctttatcaactagtatttaaaaaaaagcctacattagcgagtatacatctttgggaactatcaattccagctatgattgcaactatggccatagcatatctaaattcaaaatatggcatcatcaaaccggcaattgtttttggtgtgctttgtgggattgttggatctggtttatttacgctaatcaatggcgaactctctcagtcaataggttattcaattctcccaggaatagcttttggtagtattttccaagcaacgttattaagctcccaggtgcagataacatcagacgatccagactttcaaaacaagtttattgaagtcacagctttcaactcgttcgccaaatccttgggctttgcgtttggagggaatatgggggcaatgatattcactgcatcactcaaaaaccagatgcgctcttcccaattaaacataccacaatttacgtctgtagaaacacttttagcgtatagcacagaacattatgatggcccccaatcttcactatcaaagttcataaacacagctatccatgacgttttttactgcgccttaggatgctatgctctttcattcttctttggaatattcacttcgagtaagaaaacaacaatatcagccaaaaagcaacaatgaacaattttccaacgtataaattaacttatcgtagttcgataaaactagacagtacttatatattatctaacatcagatggtttgtctttcattatttatttagtgattaatgctagctttaagcaagcttagttgcctcaagaaagattaatattaagctactgaggatatagcattcgaatataaagatataatcaaagctcataattacaaaataccctgtgattaggatatcattattactaacaacaccgttcctaaactagcagaaagttgaccaactgtataaaaattaaatttgttcgtaaatacatatacataaaatccgcattaaatgtggactttcagttgagcaagtgttaatgaatatcgtaggatagcaaatgaagattcgaatttgatgaggtctcttgttccgagaactattgtttaagccaaaccagattcagtgtctgtactaaacagttgtcacagaaaggtggtagctttactttccgtacattaaatacagaaaaattaccacttctgttgaaaatactgttttgtgggttgggataatataatcgtatataatatcaataaaactgttaataaactctcgaggatctgatgttgatttttcccgtcattccacaaactctgatgcctgaaaaggtgaaatataaaaagcgggacattgataatccttggattattccatctccaatattggaacaatagagatcgtgagtcttgaactatagctagtaaaggcattttctttttgccgccctttcagtgttactttctttcaactagtttatcgatacttttcgggcttacagctcctatgtggatatgtgaatactcatgctgacactgaaggattattggtattggccggttgtgttttttctatacatagcaatagttcaaatgtcaatgaccaaaagaataggaatttttttaaaatacaaggctgatgaagtatcagttactagatgaccactcttataaaaaaactcagaaatcttccaaacattgtctgctcaaagaggtacctattcgttttctgtgcaacttcatcaatttctcaaaaaaatctcattgatgttctcttaatggattgcccccctgagttgtacgctggacccattgactttgactggtagtgtcagaacaatcttgaatgattaaaaattggtaggtccccttgttttttgttttgtatccatccaatggtatgattctttatattttattaaacttatactcgggaaatcttaaaagagctgctttgacgaacgcttataagtacatacagaaattggaaatcattatcgcttatgttctgtgacctactaattgcattcttccttacgtaaaaagacctgaaactaaccaataaactgccatggatacgtccatacgaaggacgataaatcaatttgtaatagtccaaaaaaattccatcaaatatcagctccaaattggcaactgtttaacttgcgttgcccgattacttgatatcccttattgtgaacatcatgacaaaacgaaatgagaaaagacctttcctttccattaatcattagtaattaaaaatttcttaacttcttttcgatcaattacaatatatgtatacttgcgtgcacattgcaattttacttaaccatgcatagcagaggctcttctactttactataatatgtttacaacaaagttataaaaagttttctcaaaccttttccatggtgaatggataactaagggttccaatcaatgttatgaagaattccaagttaatcgacgaaaagcgtttggaaaggaattatataaacgtaaacatgaaaaatattcatcgaatactccacatcgatcgtattacagtgttttagtaaatgtttgtatttgaatcaaagtttcagcatttgttctacactgataaaatcatggttctagtatagtgaaacatacgcccaagttatcctagtacaagaccgccatattgtgctcataatcgggaacaatgaaaataacaccctaacaattgctgaaacttgtcgtacgcgatccctaattacattatcaagcattcagcattggtcaatacctcaatacctcgacaagaaaaaagaaatagacacgtgtatgtcaaggcattaagaagggtatcaggcctagtgctcgcctcttgccttcccaatttgttgaacatctttgacatataatttgattttgaaatagttattggacttccattttaaataaaggctctatcattaactatacagaatatactagtaacgtgaatactagtcgatagacgataaattaatactttttccaataaaatctaaacgcatgcaagtacataaataggcgaaggtatctgaccgtaataatcttcacgccatctatataaataaatgaaaaattcggcttttaacttatatattaacaataagaaagacaatgttgcgctgtgcttacaggaagaatattataattttgacgaaaagaccttaatgaaatgcttgaggctaattaaaatatcaaaattagaacacgtagcacttttcttaagttctgttcccaaaatttcaaggtcaaatgtgttaacctttggatgcactttcataaaactccaaatatccatcgcacttaataggacgtcccctccaaaagcatccactgtataatactgtcttggatggaaaccctgcctaatcaccatgctcgctgccgctgtttctattgcattagtgttttcagtaatgaaattatttggctcctttatttcagtcccactaaactccaaaaaggtactatcaagttccccattaaagtcaccaaacgtatgaatctcactcattgcatcatttagaaaagaatagcctggtatgtcatttgagagattcgtacagcctatgggatagaaggaccgatcaaaggaattcaacggtgacggcactgtacaattctttccaacacacactgagagcagttgcttgaaaaatacgtagcattgttgtatttcaagggaattatatgtggaggaaagaaccacactaccatcgagagtgttacatgtgggcggtttttcttcacaacaggccttactaatgttccgttcatcagaaggcatgttcctctcagtcaaaagactcctcaacataaaatggagaagttcattttccttctttaatatgtgaatttgatcatttgttaccgttagctgagcttctttcttctctagttcttctaatctttccaactttcgttttctaaatgcgttttgggatgctctaagttgcgcagctctcttatttttaggtggagtaagtgaaggcttcctgccgccttttcttccacgcggttttgccattatcttggtcacttatcttccgttttgacatgttttttcaacggccgctccttaaagaccatccgcatgctagaattatatactaatatgattttgtaaagataggaatattataattataattatatttaatttaataagaaaagaaacgaaaaaaaaaaaaaaaatggaattaaaaagttttgccgtacataaaatattgaaaagacttttacattaatgctggaacaataaagcttgaggagctcaaccactaacaatcaatttaaggttactctctctacaatgggtctcccaagcgtaaaaacctccaacgaggatgcaactctcaaacttacttgtaatatcttcttcttgtaagtaggtttcgaatttagcagctacttttggtcccctattcttggacccagtacaatgaaatatcactttgacgaattgagaacttgagaaagtatcggataaacctttaattaattgattcagttgcttctctgtaatctgtgctgttactggaacatgccaagcgtttgtaatatgatcacgtgcaaaatcttctcttcgaagatcaacaacttgaaaatccttcctctgattttcaattaggcccttgagttgcctagacgttatgaaacttaccattacgcttgctggattgtcaagttttcctcaatattagtttgttatacattagtttttataccgacttttcaaaagtgttgatttaaaatcaaattttgaatgctcttaattatctttttgtttgattaataatcaactttagcggcaacgctccttacataattataatgtaaacggaaaagaatataaatgaatgctctcgttgtaattcaagagaacccaaccaacaaatcatcaggttagtagaataatgtcagaagatcaaaaaagtgaaaattcggtaccttctaaggttaatatggtgaatcgcaccgatatactgactacgatcaagtcattgtcatggcttgacttgatgttgccatttactataattctctccataatcattgcagtaataatttctgtctatgtgccttcttcccgtcacacttttgacgctgaaggtcatcccaatctaatgggagtgtccattcctttgactgttggtatgattgtaatgatgattcccccgatctgcaaagtttcctgggagtctattcacaagtacttctacaggagctatataaggaagcaactagccctctcgttatttttgaattgggtcatcggtcctttgttgatgacagcattggcgtggatggcgctattcgattataaggaataccgtcaaggcattattatgatcggagtagctagatgcattgccatggtgctaatttggaatcagattgctggaggagacaatgatctctgcgtcgtgcttgttattacaaactcgcttttacagatggtattatatgcaccattgcagatattttactgttatgttatttctcatgaccacctgaatacttcaaatagggtattattcgaagaggttgcaaagtctgtcggagtttttctcggcataccactgggaattggcattatcatacgtttgggaagtcttaccatagctggtaaaagtaattatgaaaaatacattttgagatttatttctccatgggcaatgatcggatttcattacactttatttgttatttttattagtagaggttatcaatttatccacgaaattggttctgcaatattgtgctttgtcccattggtgctttacttctttattgcatggtttttgaccttcgcattaatgaggtacttatcaatatctaggagtgatacacaaagagaatgtagctgtgaccaagaactacttttaaagagggtctggggaagaaagtcttgtgaagctagcttttctattacgatgacgcaatgtttcactatggcttcaaataattttgaactatccctggcaattgctatttccttatatggtaacaatagcaagcaagcaatagctgcaacatttgggccgttgctagaagttccaattttattgattttggcaatagtcgcgaggatccttaaaccatattatatatggaacaatagaaattaattgttgactcaccaaaaaattacttgggcaccaatgaataataccacttataactctatattaatccaagttcaccctaaaaacagataaaattgacaattttttttgaaggacaactgattgatcttagtgatggttaggatgaaaaaatgggtttgttcacgccatcccgcatcattcaaaaactccgcacagttttggagttcagtaagaaggggacgtaatcttactattgcatttttgaaagtctaatgaactcaagtggcaaactgtgttacgtacatcacttctaaatacaatgtctttgaattagaaactcgctgaaaaattattattgcgtattgtatgtcatttttgagattttcctgcaagattagtaatgctttaaacccaagtattgtaagcccgatggaatagcacatggtgatggtacaacaatggcttcatagatcattcgcataaaaatggaattcgtgcatctagtgtctaattaaaattaacgtaacgaaataggacaagataagcttatgtcgtagtacccgcataagtacgtgtagctgccattttataatgcatgaagttgaagtcattaggatgaagaggtgacatataatgtttcaaaatggtgccagtataagtttgggatatcatggagcggcattcgttttagtaaatgactgtattgtatagtactgtctgtatgattatcagttgagttggtgagatgaagtaaagatattatagcatctgcgttaatgtgtattgctattatagtatagcatagtggtgttatatagtggcaccgggaatgagtatagggagtaagaagatcttgtagttgcgtttgaatagcgacatgaggacacgtcttatgtcgccattattaggctgaaattgcaagcataaactattcgatatcaaagataccacaagaccatgtatgcataattatagaataccaaggtggggagagattaaaaacgcaccatagcagctgcgcgagtatattctgctattaaattggaattcactgaaaggtgatgagaatgcaaatagctatgataccttatagtggttaatttgtatgaaaacgttataaagcatgaagttgagagtattgatatgataatggaggttctgtgatcaattttagaaaattaaaatgtggatgatcatgaatgttatgggtaaatggcacaagtaatagacaatttaatgaatagggtgttatgtttacgatatttcaattatgttaatatttagtatgtttatatcttctcattaatgaatggttaatttttatgtttaggtgattttggtggtgattttgtggttatattgacataagtgtgtataaattgagtggttagtatatggtgcagttatacaatatttggaaccgcaaaatgagatgtagatattaaaatgtggataatcatgggctttatgggtgaatggcacagggtatagaccgctgaggcaagtgccgtgcataatgatgtgagtgcatctagtactgatttagtgagaatggggccatggtgtggaatatgaaagtagggtaagtttgagatggtatatactgtagcatccgtgtgcgtatgacatatcagtagaagtgaaggtgagtgtggcaagtggcggtggtggtagtggtggtatagagtggtaggctcctttacttcgaagcgtgaggtcgtatacctaataaggaaatgtaatttataactttttattatattggtcttttcgagagcggaagaagttgtaggctaagcgcaggctaagcgtaggtccatgtttaaagtatccaagagaatatccacgaagcggctgagcaacgaacagaatcctggttctcctcgactaagcagatagttaagatactgtgcaccatggaaattgaaaacgaacgtacgtaccgactactttatttttgcaggccggaaatcaagcgatgaatgagacatccttctgttttctatgttgtgcttgaaggggacagacagtcgcttatcttagtgagattgcttactaactgaatttactttgctgctgctagagatttgcacctgcatagcgcagattctgcatcttctcaatagcttaattattacattctcagatgatgataagacggaaactggacaatcttttgtttatattgatggatttcttgtcaaaaagcataacaatcaacatactattgttaatttcgaaacttacaaaaataaaatgaaagtttccgataggcgtaagtttgaaaaagcaaactttgacgagtttgagtcggctctaaataacaaaaacgacttggtacattgtccctcaataactttatttgaatcgatccccacggaagtgcggtcattctacgaagacgaaaagtctggcctaatcaaagtggtaaaattcagaactggtgcaatggataggaaaaggtcttttgaaaaaattgtcatttccgtcatggtcgggaaaaatgtacaaaagttcctgacatttgttgaagacgaaccagatttccagggcggaccaatcccttcaaagtatcttattcccaagaaaatcaacttgatggtctacacgttgtttcaagtgcatactttgaaattcaatagaaaggattacgataccctttctcttttttacctcaacagaggatactataatgagttgagttttccgtgtcctggaacgttgtcacgaaatagcgagtgccaggccgaacgacagctctacgatgcgtactttcactgactttgtttctggcgcacctattgtaaggagtcttcagaaaagcaccataaggaaatatgggtacaatttggcaccccacatgtttttgttactacacgtagatgagctatcgattttttctgcataccaagcaagtttacctggcgaaaagaaagtcgacacagagcggctgaagcgtgatctatgcccacgtaaacccattgagataaagtacttttcacagatatgtaacgatatgatgaacaaaaaggaccgattgggtgatgttttgcatgtgtgctgcccaagttgagaagagatactaacaaaatgaccgcggctctcaaaaataattgacgagcttacggtgatacgcttaccgttatccagagctacagcgcaacgtatacgtcgacgatacaacaagaacggttcatcggagcctcgactaaagacgcttgacggactcacttccgagcgctggattcaatggttaggccttgaaagcgactaccattgttcattctctagtactcggaatgcggaagacgtagtggcaggtgaggcggcgagttcagatcatcatcaaaaaatttcaagagtaacgcgaaaaaggccccgagagcccaagagtacaaacgatatcctcgtcgcaggccagaaactctttggcagctcctttgaattcagggacttgcatcagttgcgcttatgtcatgaaatatacatggcagacacaccctctgtggcagtacaggccccaccgggctatggtaagacggagttatttcatctccccttgatagcactggcgtctaagggcgacgtgaaatatgtgtcgtttctgtttgtaccgtacacagtgttgcttgctaattgcatgatcaggttgggccgatgcggttgcttgaatgtggcccctgtaagaaactttattgaagaaggttgcgatggcgttactgatttatacgtggggatctacgatgatcttgctagcactaatttcacagacaggatagctgcgtgggagaatattgttgagtgcacctttaggaccaacaacgtaaaattgggttacctcattgtagatgagtttcacaactttgaaacggaggtctaccggcagtcgcaatttgggggcataactaaccttgattttgacgcttttgagaaagcaatctttttgagcggcacagcacctgaggctgtagctgatgctgcgttgcagcgtattgggcttacgggactggccaagaagtcgatggacatcaacgagctcaaacggtcggaagatctcagcagaggtctatccagctatccaacacggatgtttaatctaatcaaggagaaatccgaggtgcctttagggcatgttcataaaatttggaagaaagtggaatcacagcccgaagaagcactgaagcttcttttagccctctttgaaattgaaccagagtcgaaggccattgtagttgcaagcacaaccaacgaagtggaagaattggcctgctcttggagaaagtattttagggtggtatggatacacgggaagctgggtgctgcagaaaaggtgtctcgcacaaaggagtttgtcactgacggtagcatgcgagttctcatcggaacgaaattagtgactgaaggaattgacattaagcaattgatgatggtgatcatgcttgataatagacttaatattattgagctcattcaaggcgtagggagactaagagatgggggcctctgttatctattatctagaaaaaacagttgggcggcaaggaatcgtaagggtgaattaccaccgattaaggaaggctgtataaccgaacaggtacgcgagttctatggacttgaatcaaagaaaggaaaaaagggccagcatgttggatgctgtggctccaggacagacctgtctgctgacacagtggaactgatagaaagaatggacagattggctgaaaaacaggcgacagcttccatgtcgatcgttgcgttaccgtctagcttccaggagagcaatagcagtgacaggtgcagaaagtattgcagcagtgatgaggacagcaacacgtgcattcatggtagtgctaatgccagtaccaatgcgactaccaactccagcactaatgctactaccactgccagcaccaacgtcaggactagtgctactaccactgccagcatcaacgtcaggactagtgcgactaccactgaaagtaccaactccagcactaatgctactaccactgccagcaccaacgtcaggactagtgctactaccactgccagcatcaacgtcaggactagtgcgactaccactgaaagtaccaactccaacactagtgctactaccaccgaaagtaccgactccaacactagtgctactaccactgaaagtaccaactccagcactaatgctactaccactgccagcatcaacgtcaggactagtgcgactaccactgaaagtaccaactccaacactaatgctactaccactgaaagtaccaactccagcactaatgctactaccactgaaggtaccaactccaacactagtgctactaccactgctagcaccaactccagcactaatgctactaccactgaaagtaccaacgctagtgccaaggaggacgccaataaagatggcaatgctgaggataatagattccatccagtcaccgacattaacaaagagtcgtataagcggaaagggagtcaaatggttttgctagagagaaagaaactgaaagcacaatttcccaatacttccgagaatatgaatgtcttacagtttcttggatttcggtctgacgaaattaaacatcttttcctctatggtattgacgtatacttctgcccagagggagtattcacacaatacggattatgcaagggctgtcaaaagatgttcgagctctgtgtctgttgggctggccagaaagtatcgtatcggaggatggcttgggaagcactagctgtggagagaatgctgcgaaatgacgaggaatacaaagaatacttggaagacatcgagccatatcatggggaccctgtaggatatttgaaatattttagcgtaaaaaggggagagatctactctcagatacagagaaattatgcttggtacctggccattactagaagaagagaaacaattagtgtattggattcgacaagaggcaagcaagggagccaagttttccgcatgtctggaaggcagatcaaagagttgtattataaagtatggagcaacttgcgtgaatcgaagacagaggtgctgcagtactttttgaactgggacgaaaaaaagtgccgggaagaatgggaggcaaaagacgatacggtctttgtggaagcgctcgagaaagttggagtttttcagcgtttgcgttccatgacgagcgctggactgcagggtccgcagtacgtcaagctgcagtttagcaggcatcatcgacagttgaggagcagatatgaattaagtctaggaatgcacttgcgagatcagcttgcgctgggagttaccccatctaaagtgccgcattggacggcattcctgtcgatgctgatagggctgttctgcaataaaacatttcggcagaaactggaatatcttttggagcagatttcggaggtgtggttgttaccacattggcttgatttggcaaacgttgaagttctcgctgcagataacacgagggtaccgctgtacatgctgatggtagcggttcacaaagagctggatagcgatgatgttccagacggtagatttgatatattattatgtagagattcgagcagagaagttggagagtgaaggaaattgttgttacgaaagtcagtgattatgtattgtgtagtatagtatattgtaagaaatttttttttctagggaatatgcgttttgatgtagtagtatttcactgttttgatttagtgtttgttgcacggcagtagcgagagacaagtgggaaagagtaggataaaaagacaatctataaaaagtaaacataaaataaaggtagtaagtagcttttggttgaacatccgggtaagagacaacagggcttggaggagacgtacatgagggctatttagggctatttagggctatgtagaagtgttgtagggctaaagaacagggtttcattttcattttttttttttaatttcggtcagaaa

SEQ ID NO: 12220 - DNA, 201 bp, Saccharomyces cerevisiae
atgcaattcaagaccatcgtcgctgccttcgctactgttgccgctgtccaagctgctaacgtttctaccaatggttccaaccgtaccaacggttccaacaccaccagcaccaagatctccactggtgctgctgcttccaacgctttgggtgctggtgtcttcggtgctgccgtcgctgccggtgtcgctttcttattctaa

SEQ ID NO: 12221 - DNA, 246 bp, Saccharomyces cerevisiae
atgactccagccccaaagatctcctacaagaagggtgctgcctccaacagaaccaagttcgtcagatctttggttagagaaatcgccggtttgtccccatatgaaagaagattgatcgatttgatcagaaactccggtgaaaagagagccagaaaggtcgccaagaagagattgggttctttcaccagagccaaggctaaggtcgaagaaatgaacaacatcattgctgcctctcgtcgtcattaa

SEQ ID NO: 12222 - DNA, 180 bp, Saccharomyces cerevisiae
atggctaagtctaagaaccataccgctcacaaccaaaccagaaaggctcacagaaacggtatcaagaagccaaagacctacaagtacccttctttgaaaggtgttgatccaaagtttagaagaaaccacaagcatgccctacacggcactgctaaggctttggctgctgccaagaaataa

SEQ ID NO: 12223 - DNA, 207 bp, Saccharomyces cerevisiae
atgaccatggaccaaggccttaacccaaagcaattcttccttgacgatgtcgtcctacaagacactttgtgctcaatgagcaaccgtgtcaacaagagtgtcaagaccggctacttattccccaaggatcacgttccttctgccaacatcattgccgtcgaacgtcgcggcggtctttctgacattggtaagaatacttccaactaa

SEQ ID NO: 12224 - DNA, 255 bp, Saccharomyces cerevisiae
atggccagcagtacttccacttccgcttccgcttcctcctccatcaaaactaacagtgccttagtttccaacaatgtcgttgccgcctcttccgtctctgctacttctactgctagttccagtgccgctaagaacactacttccagttcaaagaacgctgctccaggcatggttgcaaaccctgtttcctcgaagtacggtatcatcatggccgcatttgctgctgtttctttcgtcctaggcaccggtatttaa

SEQ ID NO: 12225 - DNA, 117 bp, Saccharomyces cerevisiae
atgaatgtaatatttaaattgtatttaacgatagatgcaccaaaaaaaaagaaagttacagtaagagacttcttgtcgattcgttattccatgccatacaggttagcctcaaattaa

SEQ ID NO: 12226 - DNA, 84 bp, Saccharomyces cerevisiae
atgacacgatgtataagtaaaaaaatgcttttggaggtggatgcgctatccttgatctactcccctcatctttatatgtcatag

SEQ ID NO: 12227 - DNA, 225 bp, Saccharomyces cerevisiae
atggcgcctccaaccaccatccgcactagggaccaagcgctcgcaccgttagcaacgcttgactcacaaaccaactgccggctgaaagagcttgtgcaatgggagtgccaattcaaaggagccgaatacgtctgctcgccttttaagaggctttttgaacactgcattgcacccgacaaatcagccactaactacgaggtcacggacacatataccaatagttaa
